United States Patent 12,569,549 (FLAVIVIRUS VACCINE) - sequence listing, part 59

SEQ ID NO: 20742 - RNA, 9873 nt, synthetic construct
  misc_feature 1..9873: note = derived and/or modified CDS sequence (opt5) from DENV-3__EU529683__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccagaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctcggggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacacagggtgtgtcatcaattggaaaggaaaggagctgaagtgcggcagcgggattttcgtgacgaacgaggttcatacctggacagaacagtacaaatttcaagccgattcccccaagcggctggcgaccgccatcgctggcgcctgggagaatggagtgtgtggcattagaagcacaacccgcatggaaaaccttctctggaaacagatcgctaatgagctgaactatatcctgtgggaaaataacattaagctcacggtcgtggttggggacatcattggagtgctggagcagggcaaacggacccttacacctcagcccatggagctgaagtactcttggaaaacctgggggaaggccagaatcgtcacagccgaaacccaaaactccagcttcattatcgatggacctaatacacccgagtgcccgaacacctctcgcgcttggaatgtgtgggaagtggaggactatggctttggcgtcttcacgacaaacatctggctcaagctgcgggaagtttacacccagctgtgtgaccacagacttatgtccgcggccgtgaaagatgagcgcgctgtgcacgccgacatggggtactggattgagagccagaagaatggatcctggaaactcgaaaaggcctctctgatcgaggtcaaaacctgcacatggcctaagagccataccctgtggtccaacggcgtgctcgaatctgatatgattatccccaagagcctggctgggcctatttcccagcacaattatcggcccggataccatacgcaaacagccggcccttggcaccttgggaaactggagctcgactttaactattgcgagggaaccacagttgtgatcaccgaaaattgtggcacaagaggccccagcctgcgcaccacgaccgtctctgggaagctgatccacgagtggtgctgtcggtcctgcacacttccgcctctcagatacatgggagaagatggctgttggtatgggatggagattcggcccatcagcgaaaaagaggagaacatggtgaagtctctggtttccgcgggaagcggcgaagtggacaatttcaccatgggggtcctgtgcctcgctattctgtttgaggaagtgatgcgcggaaaattcggcaagaagcatatgatcgccggcgttttctttacattcgtgcttctgctctctgggcagattacctggagagatatggcccacacgctgatcatgattggaagcaacgctacagaccggatgggcatgggggtcacctacctggcccttatcgcgacatttaaaatccagcccttcctggctctcggatttttcctgagaaagctcacctcccgcgagaatctgcttctgggcgtggggctcgccatggccaccacactgcaactgcctgaagatattgagcagatggctaacggaatcgcccttggcctgatggctctcaaactgattacgcagtttgagacctatcagctctggacagccctgatcagccttacctgttctaatacaattttcaccctgacggtggcgtggcggacagccaccctcatcctggctggcgtctccctgcttccggtttgccaaagctcctctatgagaaagaccgactggctgcccatgacagtggccgctatgggggtgcctcccctccctctgtttatcttcagcctcaaagataccctgaagcgcagatcctggccccttaacgaaggagtcatggccgtgggcctggtttctattctggccagctccctcctgcggaacgacgtgcctatggctgggccccttgtcgcgggaggcctgctcatcgcctgttacgtgattacagggacgtctgctgatctgaccgttgagaaggccgccgacgtgacatgggaagaggaagctgagcagaccggagtcagccataatctcatgatcacagtggacgatgacggcaccatgcgcattaaagatgacgagacggaaaacatcctgaccgtccttctgaagacagccctgctcatcgtgtccggcatttttccgtacagcatccctgcgaccctgcttgtttggcacacatggcagaaacagacccaaagatctggggtgctgtgggatgtcccctcccctcccgagacacagaaggctgaactcgaggagggagtgtatcggattaaacagcagggcatcttcgggaagacgcaagttggagtgggcgtccagaaagaaggggtgtttcataccatgtggcacgtgacacgcggagccgttctgacctacaatggcaagagactcgagccgaactgggccagcgtcaagaaagacctgatttcttatggcgggggatggcggctttccgctcagtggcaaaagggcgaagaggtgcaggtgatcgccgtcgaacctgggaaaaatcccaagaacttccagaccatgcctggaacattccagacgaccacaggcgagattggggcgatcgctctggattttaaacccggaaccagcggctctcccatcattaatcgcgagggcaaggtggttgggctgtacggaaacggcgtggtcacaaagaatgggggatatgtgtccggcatcgcccaaaccaacgccgaacctgacgggccgacgcccgagctcgaagaggaaatgttcaaaaagagaaatctgacaattatggatcttcaccctggcagcggaaaaacccggaagtacctgcccgctatcgttcgcgaggccattaaaagacggctcagaaccctgatcctcgctcctacacgcgtggtcgccgcggagatggaagaggccctgaagggccttcccatccggtatcagaccacagctaccaagtccgaacatacggggagagagattgtggacctgatgtgccacgccacatttaccatgcgcctgctcagccctgttcgggtgccgaactacaatctgatcattatggatgaagctcatttcacagaccccgcctctatcgccgctagaggatacattagcacccgcgtcggcatgggggaggcggccgctatctttatgacggccacccctcccggaacagccgatgctttccctcagtccaacgcccccatccaggacgaggaacgggacattccggagagatcttggaatagcggcaacgaatggatcaccgattttgcggggaaaacagtgtggttcgtgccttccattaaggctggcaacgacatcgccaattgtcttcgcaaaaacggaaagaaagtcattcaactgtctcggaagacctttgatacagagtatcagaagaccaaactcaatgactgggatttcgttgtgacgacagacatcagcgagatgggcgccaactttaaggctgatagagtgattgacccccggcgctgcctgaaacccgtcatcctgaccgatgggcctgaaagagtgatcctcgccggacccatgcctgttaccgcggcctccgctgcccagcggcgcggcagagtggggcggaatccgcagaaggagaacgaccaatacattttcacaggacagccccttaataacgatgaagaccacgctcattggaccgaggccaaaatgctgctggacaatatcaacacacctgaaggcattatccccgctctcttcgagcctgagagagaaaagtctgccgcgattgatggggagtatcgcctgaagggcgaaagccggaaaacgtttgtcgagcttatgagacgcggagacctgcccgtgtggctcgcccacaaggttgcttccgaaggcatcaaatacaccgatcggaagtggtgcttcgacgggcagagaaataaccagatcctggaggagaatatggatgtggaaatttggacaaaagagggagaaaagaaaaagctgcgcccgcggtggctcgacgccagaacctatagcgatcctcttgctctgaaggagtttaaagacttcgccgccggccgcaagtctatcgctctggatctcgtcacagaaattgggagagtgcccacccacctggcgcatcggacgcgcaacgcccttgacaatctggtcatgctccacacctccgagcatggaggcaaagcttacagacacgccgtggaggaactgcctgagacaatggaaaccctgctccttctgggcctgatgatcctcctgacagggggagccatgctttttctgattagcggcaaggggatcggaaaaacctctatcggcctcatttgtgttatcgcttccagcgggatgctgtggatggccgagattcccctgcaatggatcgcgtccgccattgtgctcgagttctttatgatggtgcttctgatccctgaacccgagaagcagcggacgccgcaggataaccaactggcttatgtcgttattggaatcctcacactggccgctatcattgccgcgaatgaaatgggccttctggagaccacaaagcgcgacctcggcatgtctaaagaacctggggtggtgagccccacctcctacctggatgtcgacctgcaccccgccagcgcttggaccctctacgccgtggctacaacggttatcacccctatgcttagacatacaattgagaactctaccgccaacgtgtccctggctgccatcgcgaatcaggccgtcgtgctgatgggactcgacaagggctggccgattagcaaaatggatctgggggtcccccttctggctctcggatgctattctcaggtgaaccctctgacactgaccgccgctgttctccttctgatcacgcactacgccatcattggccccgggctgcaggccaaggcgacacgggaggctcaaaaaagaaccgccgctggaatcatgaagaatcctaccgtggacggcattatgacaatcgatctcgaccccgtcatttatgatagcaagttcgaaaaacagctgggccaggtgatgcttctggttctctgtgccgtgcagctgctgctcatgcgcacctcctgggccctttgcgaggctctgacactggccacggggcctatcaccacactctgggaaggatctccgggcaagttttggaacaccacaatcgcggtcagcatggccaatattttccgggggtcctacctggctggagccggccttgctttttctatcatgaaaagcgtggggaccggaaagagaggcacgggctcccaaggggagaccctgggagaaaaatggaagaagaaactcaaccagctgagccgcaaggagttcgacctgtataaaaagtctggcattacagaggtggatcggaccgaagccaaagaggggctcaagagaggagaaatcacacatcacgcggtttcccggggcagcgccaaacttcagtggtttgtcgagcgcaatatggtgattcccgaagggagagtgatcgacctgggatgtggccggggcgggtggtcctactattgcgctggactgaagaaggtcaccgaggttcgcggctacacaaaagggggacctggccatgaggaacccgtgcctatgtctacctacgggtggaacattgtgaagctcatgagcggaaaagatgtcttctatctgcccccggagaagtgtgacacgcttctgtgcgatatcggcgaatcctctcctagccccacagtggaggagtccagaaccatccgggttctcaaaatggtggaaccctggctgaagaataaccagttctgtattaaggtcctgaatccttacatgcccgccgtgatcgagcacctcgaacgccttcaaagaaaacacggcgggatgctggttcggaaccctctgagccgcaattctacccatgagatgtattggatttccaacggaacaggcaatatcgtggctagcgtcaacatggtgtctagactcctgcttaaccggtttacgatgacccacagacgcccgacaattgaaaaggacgtggatctgggggccggaacccggcatgtcaatgctgagcccgagacacctaacatggacgttatcggcgaaagaatcaaacgcattaaggaggaacacaattccacctggcactacgacgatgagaacccctataaaacatgggcctaccatgggagctatgaagtgaaggcgaccggatctgccagctccatgatcaatggcgtggtcaagctcctgacgaaaccttgggacgtggttcccatggtgacccagatggctatgacagataccacaccgttcggccagcaacgggtctttaaggagaaagtggacaccagaacgcctcgctctatgcccgggacacggagagttatggagattaccgccgaatggctgtggcgcacactcggacggaacaagaaacctagactgtgcacccgcgaggaattcacgaagaaggtgcggaccaatgctgccatgggcgccgtctttacagaggaaaaccagtgggatagcgcgaaagctgccgtggaggacgaggatttctggaagcttgttgacagagaacgcgagctgcacaaactcgggaagtgtggatcctgcgtgtacaatatgatgggcaaaagagaaaagaaactgggggagtttggcaaggccaagggaagccgggctatctggtacatgtggcttggcgcccgctatctggagttcgaagctctcgggtttctgaacgaggatcattggttctccagagaaaattcttacagcggagtcgagggcgaagggctgcacaaactcggatatattctgcgggacatctccaagatccccggcggggccatgtacgcggatgacaccgccggctgggacacaagaattaccgaggatgaccttcataacgaggaaaaaatcacacagcagatggatcctgagcaccggcaactggctaatgccatttttaagctcacctatcagaacaaagtggtcaaggtgcagcgccccacgccgacaggaaccgttatggacatcatttctagaaaggatcagcggggcagcgggcaagtgggaacctacggcctgaatacattcaccaacatggaagctcagcttatccgccagatggagggggaaggagtcctgtccaaagccgacctcgagaaccctcacctgcccgagaagaaaatcacacagtggctggaaacgaagggcgtggagagactcaaacggatggcgatttctggggatgactgcgtggttaagcccatcgatgaccgctttgccaatgctctgcttgccctgaacgatatgggcaaggtgagaaaagacattcctcaatggcagccgagcaagggatggcatgattggcagcaggtccccttctgttcccaccatttccacgaactcatcatgaaagacggccggaagctggtggttccttgccgcccccaagacgagcttattgggagagctcggatcagccagggagccggctggtctctgcgcgaaaccgcttgtctcgggaaagcctatgcgcagatgtggtccctgatgtactttcacagacgggatctgcgcctcgccagcaatgctatttgctctgccgtgcctgtccattgggtgcccacatccagaaccacatggagcatccacgcccatcaccaatggatgaccacggaggacatgctgaccgtctggaaccgggtgtggatcgaggataatccttggatggaagacaagacacccgttaccacatgggagaacgtgccgtaccttggaaagagagaagatcagtggtgtggctctctgattgggctcacctcccgcgctacgtgggcccagaatatccctacagcgattcagcaagtccggagcctgatcggcaacgaggagttccttgactatatgccctccatgaaaagatttcgcaaggaagaggaaagcgagggagctatttggtga

SEQ ID NO: 20743 - RNA, 9873 nt, synthetic construct
  misc_feature 1..9873: note = derived and/or modified CDS sequence (opt5) from DENV-3__EU529684__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccagaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctcggggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagaaactggcgacagccatcgctggcgcctgggagaatggagtgtgtggcattcggagcaccacaagaatggaaaaccttctctggaagcagatcgctaatgagctgaactatatcctgtgggaaaataacattaaactcaccgtcgtggttggggacatcattggagtgctggagcagggcaagcgcacgcttacccctcagcccatggagctgaaatactcttggaagacatgggggaaggccaaaatcgtcaccgccgaaacacaaaactccagcttcattatcgatggacctaatacccccgagtgcccgtctgcttcccgggcgtggaacgtgtgggaagtggaggactatggctttggcgtcttcacaaccaatatctggctcaagctgagagaagtttacacgcagctgtgtgaccaccgccttatgagcgccgctgtgaaagatgagcgggccgtgcacgccgacatggggtactggattgagtcccagaagaacggatcttggaaactcgaaaaggctagcctgatcgaggtcaagacatgcacctggcctaaatcccataccctgtggtctaatggcgtgctcgaaagcgatatgattatccccaagtccctggccgggcctattagccagcacaactatagacccggataccatacacaaaccgcgggcccttggcaccttgggaaactggagctcgactttaattattgcgagggaacgacagttgtgatcaccgaaaactgtggcacacgcggcccctctctgcggaccacaaccgtctccgggaagctgatccacgagtggtgctgtagaagctgcacgcttccgcctctccgctacatgggagaagatggctgttggtatgggatggagattcggcccatctctgaaaaagaggagaatatggtgaagtccctggttagcgctggatctggcgaagtggacaacttcaccatgggggtcctgtgcctcgccattctgtttgaggaagtgatgagaggaaagttcggcaaaaagcatatgatcgccggcgttttctttacattcgtgcttctgctcagcgggcagattacctggcgggatatggctcacacactgatcatgattggatccaatgccagcgaccgcatgggcatgggggtcacctacctggcgcttatcgctacgtttaaaatccagcccttcctggccctcggatttttcctgagaaagctcacatctcgggagaacctgcttctgggcgtggggctcgccatggctaccacactgcaactgcctgaagatattgagcagatggccaatggaatcgctcttggcctgatggccctcaaactgattacccagtttgagacctatcagctctggacagcgctgatctcccttacgtgtagcaacaccattttcacactgaccgtggcctggagaacagctaccctcatcctggccggcgtctccctgcttccggtttgccaatctagctccatgcgcaagacggactggctgcccatgacagtggctgccatgggggtgcctcccctccctctgtttatcttctctctcaaggataccctgaaacggagaagctggccccttaatgaaggagtcatggccgtgggcctggtttccattctggcttctagcctcctgcgcaacgacgtgcctatggcggggccccttgtcgccggaggcctgctcatcgcttgttacgtgattaccgggacatccgccgatctgaccgttgagaaggccgctgacgtgacatgggaagaggaagccgagcagacgggagtcagccataacctcatgatcaccgtggacgatgacggcacaatgagaattaaagatgacgagaccgaaaatatcctgacagtccttctgaagaccgcgctgctcatcgtgtctggcatttttccgtactccatccctgctacgctgcttgtttggcacacctggcagaaacagacacaacggagcggggtgctgtgggatgtcccctctcctcccgagacccagaaggccgaactcgaggagggagtgtatcgcattaaacagcagggcatcttcgggaagacacaagttggagtgggcgtccagaaggaaggggtgtttcataccatgtggcacgtgacaagaggagccgttctgacgtacaacggcaaacggctcgagccgaattgggcttccgtcaagaaagacctgattagctatggcgggggatggcgcctttctgcccagtggcaaaagggcgaagaggtgcaggtgatcgcggtcgaacctgggaaaaaccccaagaatttccagaccatgcctggaacattccagaccaccacaggcgagattggggctatcgccctggattttaagcccggaacgtccggcagccccatcattaacagagagggcaaaatcgtggggctgtacggaaatggcgttgtgaccaagaacgggggatatgtctccggcattgcccaaacaaatgctgaacctgacgggccgacccccgagctcgaagaggaaatgttcaaaaagcggaacctgacaatcatggatcttcaccctggcagcggaaaaacccgcaagtacctgcccgccattgtgagagaggctatcaagcggcgcctcagaacgctgatcctcgcccctacacgggttgtggcggccgagatggaagaggctctgaaaggccttcccattagatatcagaccaccgccacaaagtctgaacataccgggcgcgagatcgtcgacctgatgtgccacgctacatttaccatgcggctgctcagccctgtgagagttccgaattacaacctgattatcatggatgaagcccatttcacggaccccgcctccattgctgcgcgcggatacatctctacacgggtgggcatgggggaggccgctgccatctttatgaccgccacacctcccggaaccgctgatgccttccctcagagcaatgcgcccattcaggacgaggaaagagacatcccggagcgctcctggaactctggcaatgaatggattacggattttgctgggaaaaccgtctggttcgtgcctagcatcaaggccggcaacgacattgccaactgtcttcggaaaaatggaaagaaggtgatccaactgtccagaaaaacatttgataccgagtatcagaagacaaaactcaacgactgggatttcgtcgttaccacagacatttctgagatgggcgctaattttaaggccgatcgcgtgatcgacccccggagatgcctgaaacccgtgatcctgaccgatgggcctgaacgggtcattctcgcgggacccatgcctgtgacggccgctagcgccgctcagcgcagaggccgggttgggcgcaacccgcagaaggagaatgaccaatacatcttcacaggacagccccttaacaatgatgaagaccacgcccattggaccgaggctaagatgctgctggacaacattaatacccctgaaggcatcattcccgccctcttcgagcctgagagagaaaaatccgcggccatcgatggggagtatcggctgaagggcgaaagcagaaaaacatttgtggagcttatgcgccggggagacctgcccgtctggctcgctcacaaggtggcctctgaaggcatcaaatacaccgatagaaagtggtgcttcgacgggcagcgcaacaatcagattctggaggagaacatggatgttgaaatctggacaaaagagggagaaaagaagaaactgcggccgagatggctcgacgctcgcacgtattccgatcctcttgccctgaaggagtttaaagacttcgccgctggccggaagagcattgcgctggatctcgtgaccgaaatcgggagagtccccacacacctggcccatcgcaccagaacagctcttgacaatctggtgatgctccacacctctgagcatggaggcaaagcctaccggcacgccgtcgaggaactgcctgagacgatggaaaccctgctccttctgggcctgatgattctcctgacagggggagctatgctttttctgatctccggcaaggggatcggaaagaccagcattggcctcatctgtgtgattgcctcctctgggatgctgtggatggcggagatccccctgcaatggattgccagcgctatcgttctcgagttctttatgatggtgcttctgattcctgaacccgagaaacagcgcacaccgcaggataaccaactggcctatgtggtcatcggaatcctcaccctggctgccattatcgcggccaatgaaatgggccttctggagacgacaaagagagacctcggcatgtccaaagaacctggggttgtgagccccacctcttacctggatgtggacctgcaccccgcttccgcctggacactctacgctgtcgccaccaccgtgattacacctatgcttcggcatacgatcgagaacagcaccgctaatgtttctctggccgcgattgccaaccaggctgtggtcctgatgggactcgacaagggctggccgatcagcaaaatggatctgggggtgccccttctggccctcggatgctattcccaggtcaaccctctgacactgaccgctgccgtgctccttctgatcacacactacgccattatcggccccgggctgcaggcgaaggctacccgcgaggcccaaaagagaacggctgccggaattatgaaaaatcctacagttgacggcatcatgaccattgatctcgaccccgtgatctatgattctaagttcgaaaaacagctgggccaggtcatgcttctggtgctctgtgccgttcagctgctgctcatgcggaccagctgggctctttgcgaggccctgacactggcgaccgggcctatcacaacgctctgggaaggatccccgggcaagttttggaacaccacaattgccgtgtctatggctaatatcttcagagggagctacctggccggagctggccttgccttttccattatgaaaagcgtcgggaccggaaagcgcggcacaggctctcaaggggagaccctgggagaaaagtggaaaaagaaactcaaccagctgtcccggaaggagttcgacctgtataaaaagagcggcatcacggaggtggatagaaccgaagcgaaagaggggctcaagcgcggagaaattacacatcacgccgtgtcccggggctctgctaagcttcagtggtttgttgagagaaatatggtcatccccgaagggcgggtgattgacctgggatgtggccgcggcgggtggagctactattgcgccggactgaaaaaggtgaccgaggtcagaggctacacaaaagggggacctggccatgaggaacccgttcctatgtccacctacgggtggaacatcgtgaagctcatgtctggaaaagatgtgttctatctgcccccggagaagtgtgacacacttctgtgcgatatcggcgaaagctcccctagccccaccgtcgaggagtctcggacgattcgcgtgctcaagatggttgaaccctggctgaaaaataaccagttctgtatcaaggtgctgaatccttacatgcccacagtcattgagcacctcgaaagacttcaacggaaacacggcgggatgctggtgcgcaaccctctgtccagaaatagcacccatgagatgtattggatctctaacggaaccggcaatattgttgcttccgtgaacatggtcagccggctcctgcttaatcgctttacaatgacgcacagacggccgaccatcgaaaaggacgtggatctgggggccggaacaagacatgtgaacgctgagcccgagacccctaacatggacgtcatcggcgaacgcattaaacggatcaaggacgagcacaattctacatggcactacgatgacgaaaacccctataagacctgggcctaccatgggagctatgaggttaaagcgacaggatccgcctctagcatgattaatggcgtggtgaagctcctgaccaaaccttgggatgtcgtgcccatggttacgcagatggctatgaccgacacaaccccgttcggccagcaaagagtgtttaaggaaaaagtcgatacacgcacccctcggtccatgcccgggacgagacgcgtgatgggaatcacagccgagtggctgtggcggaccctcggcagaaacaagaagcctcgcctgtgcacacgggaggaattcaccaaaaaggttagaacgaatgctgccatgggggccgtgtttaccgaggaaaaccagtgggacagcgcgaaagctgccgtcgaggatgaagacttctggaagcttgtggatcgcgagcgggagctgcacaaactcggaaagtgtggctcctgcgtttacaatatgatggggaaaagagaaaagaagctgggcgagtttggaaaagccaagggctctcgcgctatttggtacatgtggcttggggccagatatctggaattcgaggctctcggatttctgaacgaggaccattggttcagccgggaaaattcctactctggcgtggagggggaaggactgcacaaactcggctatatcctgcgcgatatcagcaagattcccgggggcgccatgtacgcggacgacacagccggatgggataccagaatcacagaggacgatcttcataacgaagagaaaattacccagcagatggaccctgagcaccggcaactggctaatgccatctttaagctcacatatcagaacaaggtcgtgaaagtccagagacccaccccgacgggcacagtgatggatattatctcccggaaggaccagcgcgggtctggacaagttggcacctacgggctgaataccttcacaaacatggaagctcagcttatcagacagatggagggagaaggcgtgctgagcaaagccgatctcgagaatcctcacctgcccgaaaagaaaattacccagtggctggagacaaagggggtcgagcggctcaagcgcatggcgatctccggcgacgattgcgtggtgaaacccattgacgatagatttgccaacgctctgcttgccctgaacgacatgggaaaggttcggaaagatatccctcaatggcagccgagcaagggctggcatgactggcagcaggtgcccttctgttctcaccatttccacgaactcattatgaaagacgggcgcaagctggtcgtgccttgcagaccccaagatgagcttatcggacgggctcgcatttcccagggcgccgggtggagcctgagagaaacggcttgtctcggaaaggcctatgcgcagatgtggtctctgatgtactttcaccggcgcgacctgagactcgcctccaatgctatctgcagcgccgttcctgtgcattgggtccccacctctcggacaacctggtccatccacgcccatcaccaatggatgacaaccgaggatatgctgacggtgtggaaccgcgtctggattgaagacaatccttggatggaggataaaacccccgtgacaacctgggagaacgttccgtaccttggcaagagagaagaccagtggtgtgggagcctgatcggcctcacatcccgggctacctgggcccagaatattcctacggcgatccagcaagtgagaagcctgattggaaacgaggaattccttgattatatgccctctatgaaacgctttcggaaggaggaggaaagcgagggcgctatctggtga

SEQ ID NO: 20744 - RNA, 9873 nt, synthetic construct
  misc_feature 1..9873: note = derived and/or modified CDS sequence (opt5) from DENV-3__FJ182015__SS-prME
  source 1..9873: mol_type = other RNA
accagcctgtgcctcatgatgatcctgcccgccgctcttgccttccacctgacatcccgggacggcgagcctcggatgattgtggggaagaacgaacgcggaaagtctctcctgtttaagacggcgagcggcatcaatatgtgtacccttattgctatggatctgggggaaatgtgcgacgatacagtgacctacaagtgtccgcacatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacatcattggagtgctggagcagggcaaacggacgcttacccctcagcccatggagctgaagtactcttggaaaacatgggggaaggccaagatcgtcaccgccgaaacacaaaactccagcttcattatcgatggacctaatacccccgagtgcccgtctgcttccagagcgtggaacgtgtgggaagtggaggactatggctttggcgtcttcacaaccaatatctggctcaaactgcgcgaagtttacacgcagctgtgtgaccaccggcttatgagcgccgctgtgaaggatgagagagccgtgcacgccgacatggggtactggattgagtcccagaaaaacggatcttggaagctcgaaaaagctagcctgatcgaggtcaagacatgcacctggcctaagtcccataccctgtggtctaatggcgtgctcgaaagcgatatgattatccccaaatccctggccgggcctattagccagcacaactatcgccccggataccatacacaaaccgcgggcccttggcaccttgggaagctggagctcgactttaattattgcgagggaacgacagttgtgatcaccgaaaactgtggcacacggggcccctctctgagaaccacaaccgtctccgggaaactgatccacgagtggtgctgtcgcagctgcacgcttccgcctctccggtacatgggagaagatggctgttggtatgggatggagattagacccatctctgaaaaggaggagaatatggtgaaatccctggttagcgctggatctggcgaagtggacaacttcaccatgggggtcctgtgcctcgccattctgtttgaggaagtgatgcggggaaagttcggcaagaaacatatgatcgccggcgttttctttacattcgtgcttctgctcagcgggcagattacctggcgcgatatggctcacacactgatcatgattggatccaatgccagcgacagaatgggcatgggggtcacctacctggcgcttatcgctacgtttaagatccagcccttcctggccctcggatttttcctgcggaaactcacatctagagagaacctgcttctgggcgtggggctcgccatggctaccacactgcaactgcctgaagatattgagcagatggccaatggaatcgctcttggcctgatggccctcaagctgattacccagtttgagacctatcagctctggacagcgctgatctcccttacgtgtagcaacaccattttcacactgaccgtggcctggcgcacagctaccctcatcctggccggcgtctccctgcttccggtttgccaatctagctccatgcggaaaacggactggctgcccatgacagtggctgccatgggggtgcctcccctccctctgtttatcttctctctcaaggataccctgaagagacgcagctggccccttaatgaaggagtcatggccgtgggcctggtttccattctggcttctagcctcctgagaaacgacgtgcctatggcggggccccttgtcgccggaggcctgctcatcgcttgttacgtgattaccgggacatccgccgatctgaccgttgagaaagccgctgacgtgacatgggaagaggaagccgagcagacgggagtcagccataacctcatgatcaccgtggacgatgacggcacaatgcggattaaggatgacgagaccgaaaatatcctgacagtccttctgaaaaccgcgctgctcatcgtgtctggcatttttccgtactccatccctgctacgctgcttgtttggcacacctggcagaagcagacacaacgcagcggggtgctgtgggatgtcccctctcctcccgagacccagaaagccgaactcgaggagggagtgtatagaattaagcagcagggcatcttcgggaaaacacaagttggagtgggcgtccagaaggaaggggtgtttcataccatgtggcacgtgacacggggagccgttctgacgtacaacggcaagcgcctcgagccgaattgggcttccgtcaaaaaggacctgattagctatggcgggggatggagactttctgcccagtggcaaaaaggcgaagaggtccaggtgatcgcggtcgaacctgggaagaaccccaaaaatttccagaccatgcctggaacattccagaccaccacaggcgagattggggctatcgccctggattttaagcccggaacgtccggcagccccatcattaaccgggagggcaaggtggttgggctgtacggaaatggcgtggtcaccaaaaacgggggatatgtgtccggcatcgcccaaacaaatgctgaacctgacgggccgacccccgagctcgaagaggaaatgttcaagaaacgcaacctgacaattatggatcttcaccctggcagcggaaagaccagaaaatacctgcccgccatcgttcgggaggctattaagcgcagactccggacgctgatcctcgcccctacaagagtggtcgcggccgagatggaagaggctctgaagggccttcccatccgctatcagaccaccgccacaaaatctgaacataccgggcgggagattgtggacctgatgtgccacgctacatttaccatgagactgctcagccctgttcgcgtgccgaattacaacctgatcattatggatgaagcccatttcacggaccccgcctccatcgctgcgcggggatacatttctacaagagtcggcatgggggaggccgctgccatctttatgaccgccacacctcccggaaccgctgatgccttccctcagagcaatgcgcccatccaggacgaggaacgcgacattccggagcggtcctggaactctggcaatgaatggatcacggattttgctgggaagaccgtgtggttcgtgcctagcattaaagccggcaacgacatcgccaactgtcttagaaagaatggcaaaaaggtcattcaactgtcccgcaagacatttgataccgagtatcagaaaacaaagctcaacgactgggatttcgttgtgaccacagacatctctgagatgggagctaattttaaagccgatcgggtgattgaccccagacggtgcctgaagcccgtcatcctgaccgatgggcctgaacgcgtgatcctcgcgggacccatgcctgttacggccgctagcgccgctcagagacggggccgcgtggggagaaacccgcagaaagagaatgaccaatacattttcacaggacagccccttaacaatgatgaagaccacgcccattggaccgaggctaagatgctgctggacaacatcaatacccctgaaggcattatccccgccctcttcgagcctgagcgggaaaagtccgcggccattgatggggagtatagactgaaaggcgaaagccgcaagacatttgtcgagcttatgcggagaggagacctgcccgtgtggctcgctcacaaagttgcctctgaaggcatcaagtacaccgatcgcaaatggtgcttcgacgggcagcggaacaatcagatcctggaggagaacatggatgtggaaatttggacaaaggagggagagaagaagaagctgagaccgcgctggctcgacgctcggacgtattccgatcctcttgccctgaaagagtttaaggacttcgccgctggcagaaaaagcatcgcgctggatctcgtcaccgaaattgggcgcgtgcccacacacctggcccatagaacccggaatgctcttgacaacctggtcatgctccacacatctgagcatggaggcaaggcctaccgccacgccgtggaggaactgcctgagaccatggaaacgctgctccttctgggcctgatgatcctcctgaccgggggagctatgctttttctgatttccggcaaagggatcggaaagacaagcatcggcctcatttgtgttatcgcctcctctgggatgctgtggatggcggagattcccctgcaatggatcgccagcgctattgtgctcgagttctttatgatggtgcttctgatccctgaacccgagaagcagagaaccccgcaggataatcaactggcctatgtcgttattggaatcctcacactggctgccatcattgcggccaacgaaatgggccttctggagaccacgaaacgggacctcggcatgtccaaggaacctggggtggtgagccccacatcttacctggatgtcgacctgcaccccgcttccgcctggaccctctacgctgtggccacaaccgttatcacccctatgcttcgccatacaattgagaatagcacggctaacgtgtctctggccgcgatcgccaaccaggctgtcgtgctgatgggactcgacaaaggctggccgattagcaagatggatctgggggtcccccttctggccctcggatgctattcccaggtgaatcctctgaccctgacagctgccgttctccttctgatcacccactacgccatcattggccccgggctgcaggcgaaagctacaagagaggcccaaaagcggaccgctgccggaatcatgaagaaccctacggtggacggcattatgacaatcgatctcgaccccgtcatttatgattctaaattcgaaaagcagctgggccaggtgatgcttctggttctctgtgccgtgcagctgctgctcatgagaaccagctgggctctttgcgaggccctgaccctggcgacagggcctatcaccacactctgggaaggatccccgggcaaattttggaatacgaccatcgccgtctctatggctaacattttccgcgggagctacctggccggagctggccttgccttttccatcatgaaaagcgtggggacaggaaaacggggcaccggctctcaaggggagacactgggagaaaagtggaagaaaaagctcaatcagctgtccagaaaagagttcgacctgtataagaaaagcggcattaccgaggtggatcgcacggaagcgaaggaggggctcaaacggggagaaatcacccatcacgccgtttccagaggctctgctaaacttcagtggtttgtcgagcggaacatggtgattcccgaagggcgcgtgatcgacctgggatgtggcagaggcgggtggagctactattgcgccggactgaagaaagtcacagaggttcggggctacaccaaagggggacctggccatgaggaacccgtgcctatgtccacatacgggtggaatattgtgaaactcatgtctggaaaggatgtcttctatctgcccccggagaaatgtgacacccttctgtgcgatatcggcgaaagctcccctagccccacagtggaggagtctcgcaccatcagagttctcaagatggtggaaccctggctgaagaacaatcagttctgtattaaagtcctgaacccttacatgcccacggtgatcgagcacctcgaacggcttcaacgcaagcacggcgggatgctggttagaaatcctctgtcccggaacagcacacatgagatgtattggatttctaatggaaccggcaacatcgtggcttccgtcaatatggtgagccgcctcctgcttaacagatttaccatgacacaccggagaccgacgattgaaaaagacgtggatctgggggccggaacccgccatgtcaacgctgagcccgagacacctaatatggacgttatcggcgaacggatcaagagaattaaagaggaacacaactctacctggcactacgacgatgagaatccctataagacatgggcctaccatgggagctatgaagtgaaggcgaccggatccgcctctagcatgatcaacggcgtggtcaaactcctgacaaagccttgggacgtggttcccatggtgacccagatggctatgacggataccacaccgttcggccagcaacgcgtctttaaagagaaggtggacacccggacacctagatccatgcccgggacccgccgggttatgggaattacggccgagtggctgtggagaacactcggccgcaataaaaagcctcggctgtgcaccagagaagagttcacaaagaaagtgcgcaccaacgctgccatgggggccgtctttacggaagagaatcagtgggatagcgcgaaggctgccgtggaagacgaggatttctggaaacttgttgaccgggagagagaactgcacaagctcggaaaatgtggctcctgcgtgtacaacatgatggggaagcgcgagaaaaagctgggcgaatttggaaaggccaaaggctctagagctatctggtacatgtggcttggggcccggtatctggagttcgaggctctcggatttctgaatgaagatcattggttcagccgcgagaactcctactctggcgtcgaaggggagggactgcacaagctcggctatattctgagagacatcagcaaaatccccgggggcgccatgtacgcggatgacaccgccggatgggacacacggattaccgaagatgaccttcataatgaggagaagatcacacagcagatggatcctgaacacagacaactggctaacgccatttttaaactcacctatcagaataaggtggtcaaggtgcagcggcccacaccgaccggcacggttatggacatcatttcccgcaaagatcagagagggtctggacaagtgggcacatacgggctgaacaccttcaccaatatggaggctcagcttatccggcagatggaaggagagggcgtcctgagcaaggccgacctcgaaaaccctcatctgcccgagaaaaagatcacacagtggctggagaccaaaggggtggaacgcctcaagagaatggcgatttccggcgatgactgcgtggttaagcccatcgatgaccggtttgccaacgctctgcttgccctgaatgatatgggaaaagtgcgcaaggacattcctcaatggcagccgagcaaaggctggcatgattggcagcaggtccccttctgttctcaccatttccacgagctcatcatgaaggacgggagaaaactggtggttccttgccggccccaagacgaacttattggacgcgctagaatctcccagggcgccgggtggagcctgcgggagacagcttgtctcggaaaggcctatgcgcagatgtggtctctgatgtactttcaccgcagagatctgcggctcgcctccaacgctatttgcagcgccgtgcctgtccattgggtgcccacgtctcgcaccacatggtccatccacgcccatcaccaatggatgaccacagaagacatgctgaccgtctggaatagagtgtggatcgaggataacccttggatggaggacaagacgcccgttaccacatgggaaaatgtgccgtaccttggcaaacgggaggatcagtggtgtgggagcctgattggcctcacctccagagctacatgggcccagaacatccctaccgcgattcagcaagtccgcagcctgatcggaaatgaagagttccttgactatatgccctctatgaagcggtttagaaaagaggaagagagcgaaggcgctatttggtga

SEQ ID NO: 20745 - RNA, 9873 nt, synthetic construct
  misc_feature 1..9873: note = derived and/or modified CDS sequence (opt5) from DENV-3__EU569688__SS-prME
  source 1..9873: mol_type = other RNA
accagcctgtgcctcatgatgatcctgcccgccgctcttgccttccacctgacatccagagacggagagcctcggatgattgtggggaagaacgaacgcggaaagtctctcctgtttaagacggcgagcggcatcaatatgtgtacccttattgctatggatctgggggaaatgtgcgacgatacagtcacctacaagtgtccgcacatcacagaagccgagcccgaagacattgattgctggtgtaacctcacctccacatgggttacctatggaacgtgcaatcaggccggcgagcacagacgggacaagcgctctgtggctctggcccctcatgtggggatgggactggataccagaacacagacctggatgagcgctgagggcgcctggcggcaggtcgaaaaagtggagacatgggcgctccgccaccccggcttcaccatcctggccctttttctggctcattacatcgggacgtccctcacacagaaggttgtgattttcatcctgcttatgctggtcaccccttctatgacaatgagatgtgtgggagttggcaaccgggactttgtggaagggctcagcggagccacctgggtcgatgtggtgctggagcacggcgggtgcgtcaccacaatggctaagaataaacccacgctggacattgagctccagaagaccgaagccacacagctggcgacccttcgcaaactgtgtatcgagggaaagattacaaacatcaccacggattccagatgccctacacagggcgaagccgttctcccggaggaacaggaccagaattatgtgtgtaaacacacctacgtggatcggggctgggggaacggatgcggcctgttcgggaagggaagccttgtgacatgcgctaagtttcaatgtctggagcccattgagggcaaagtggttcagtatgaaaatctcaagtacacagtgatcatcaccgtccatacaggggaccagcaccaggtgggaaacgagacgcaaggcgttaccgccgaaattacacctcaggcttctaccacagaggccatcctgcccgaatatggcaccctggggctcgagtgctcccctcgcacgggactggacttcaatgagatgattcttctgaccatgaaaaacaaggcctggatggtgcatagacagtggtttttcgatctccccctgccgtggacaagcggcgctaccacagaaacccctacgtggaatcggaaagagcttctggtcacatttaagaacgcgcacgccaaaaagcaagaagtggtcgtgctcgggtctcaggagggagctatgcacaccgccctgacaggcgccaccgaaatccaaaattccgggggcaccagcattttcgctggacatctgaagtgtcgcctcaaaatggacaagctggagcttaaaggcatgtcttacgccatgtgcacaaacacgtttgttctgaagaaagaggtgtccgaaacccagcacgggacaatcctcatcaaggtcgagtacaagggagaagatgtgccctgtaaaattcctttcagcaccgaggacggccaagggaaggcgcataacggaagactgatcacagctaatcccgttgtgaccaaaaaggaggaacccgtcaacattgaggccgaacctccgttcggcgagtccaatatcgtgattgggatcggcgataacgccctgaaaatcaattggtataagaagggatctagcattggcaaaatgtttgaagctacggccagaggggctagacgcatggccatccttggagacacagcgtgggatttcggctccgtcgggggagttctcaacagcctgggcaagatggtccaccagatttttgggtctgcctacaccgctctgttctccggcgtgagctgggtgatgaaaatcggaattggcgtcctcctgacctggatcgggcttaattctaagaacacaagcatgtccttttcttgcattgccatcggaatcattaccctgtatctcggcgctgtggttcaggccgacatggggtgtgtgatcaattggaaaggaaaggagctgaagtgcggcagcgggattttcgtcacaaacgaggtgcatacgtggaccgaacagtacaaatttcaagcggattcccccaagcggctggccacagctatcgccggcgcttgggagaatggagtttgtggcattagaagcaccacacgcatggaaaaccttctctggaaacagatcgccaatgagctgaactatatcctgtgggaaaataacattaagctcaccgtggtcgtgggggacacgatcggagttctggagcagggcaaacggacccttacacctcagcccatggagctgaagtactcttggaaaacctgggggaaggccaagattgtgacagctgaaacccaaaactccagcttcatcattgatggacctaatacacccgagtgcccgtctgcgtccagagcctggaacgtctgggaagtggaggactatggctttggcgtgttcaccacgaatatctggctcaaactgcgcgaagtctacacacagctgtgtgaccaccggcttatgagcgctgccgttaaggatgagagagccgtgcacgctgacatggggtactggatcgagtcccagaaaaacggatcttggaagctcgaaaaagccagcctgattgaggtgaagacctgcacctggcctaagtcccatacactgtggtctaatggcgtcctcgaaagcgatatgatcattcccaaatccctggcggggcctatcagccagcacaactatcgccccggataccatacccaaacggctggcccttggcaccttgggaagctggagctcgactttaattattgcgagggaacaaccgtggttattacagaaaactgtggcacccggggcccctctctgagaacaaccacggtgtccgggaaactgatccacgagtggtgctgtcgcagctgcacccttccgcctctccggtacatgggagaagatggctgttggtatgggatggagatcagacccatttctgaaaaggaggagaatatggtcaaatccctggtgagcgccggatctggcgaagttgacaacttcacaatgggggtgctgtgcctcgccatcctgtttgaggaagtcatgcggggaaagttcggcaagaaacatatgattgctggcgtgttctttaccttcgttcttctgctcagcgggcagatcacatggcgcgatatggcccacaccctgattatgatcggatccaatgcgagcgacagaatgggcatgggggtgacgtacctggctcttattgccacatttaagatccagcccttcctggccctcggatttttcctgcggaaactcacctctagagagaacctgcttctgggcgtcgggctcgctatggccacaaccctgcaactgcctgaagatatcgagcagatggctaatggaattgcccttggcctgatggcgctcaagctgatcacccagtttgagacatatcagctctggacggccctgatttcccttacctgtagcaacacaatcttcaccctgacagtggcttggcgcaccgccacgctcattctggctggcgtgtccctgcttccggtctgccaatctagctccatgcggaaaacagactggctgcccatgaccgttgccgccatgggggtgcctcccctccctctgtttatcttctctctcaaggataccctgaagagacgcagctggccccttaatgaaggagtgatggctgtcggcctggtgtccatcctggcgtctagcctcctgagaaacgacgttcctatggccgggccccttgtggctggaggcctgctcattgcctgttacgtcatcacagggacctccgccgatctgacagtggagaaagctgccgacgttacgtgggaagaggaagcggagcagaccggagtgagccataacctcatgattacagtcgacgatgacggcaccatgcggatcaaggatgacgagacagaaaatattctgaccgtgcttctgaaaacggctctgctcatcgtctctggcatctttccgtactccattcctgccaccctgcttgtgtggcacacatggcagaagcagacccaacgcagcggggttctgtgggatgtgccctctcctcccgagacacagaaagccgaactcgaggagggagtctatagaatcaagcagcagggcattttcgggaaaacccaagtgggagttggcgtgcagaaggaaggggtctttcatacaatgtggcacgtgacgcggggagctgtgctgacctacaacggcaagcgcctcgagccgaattgggcctccgttaaaaaggacctgatcagctatggcgggggatggagactttctgcgcagtggcaaaaaggcgaagaggtccaggtgattgctgtggaacctgggaagaaccccaaaaatttccagacaatgcctggaaccttccagaccacaacgggcgagatcggggccattgccctggattttaagcccggaacctccggcagccccatcatcaaccgggagggcaaggtcgtggggctgtacggaaatggcgttgtgaccaagaacgggggatatgtctccggcattgctcaaaccaatgccgaacctgacgggccgacacccgagctcgaagaggaaatgttcaagaaacgcaacctgaccatcatggatcttcaccctggcagcggaaagacgagaaaatacctgcccgctattgtgcgggaggccatcaagcgcagactccggacactgattctcgcgcctaccagagttgtggccgctgagatggaagaggccctgaagggccttcccatccgctatcagaccacagctaccaaatctgaacatacagggcgggagatcgtcgacctgatgtgccacgccacctttacgatgagactgctcagccctgtgcgcgttccgaattacaacctgattatcatggatgaagcccatttcacagaccccgcttccattgcggcccggggatacatctctaccagagtgggcatgggggaggctgccgccatttttatgacagctacccctcccggaacggccgatgcgttccctcagagcaatgctcccatccaggacgaggaacgcgacatcccggagcggtcctggaactctggcaatgaatggattaccgattttgccgggaagacagtctggttcgtgcctagcatcaaagccggcaacgacattgctaactgtcttagaaagaatggcaaaaaggtgatccaactgtcccgcaagacctttgatacagagtatcagaaaaccaagctcaacgactgggatttcgtcgttacaaccgacatttctgagatgggagccaattttaaagcggatcgggtgatcgaccccagacggtgcctgaagcccgtgattctgacggatgggcctgaacgcgtcatcctcgccggacccatgcctgtgacagctgccagcgctgcccagagacggggccgcgttgggagaaacccgcagaaagagaatgaccaatacatcttcaccggacagccccttaacaatgatgaagaccacgctcattggaccgaggccaagatgctgctggacaacattaatacacctgaaggcatcattcccgccctcttcgagcctgagcgggaaaagtccgccgctatcgatggggagtatagactgaaaggcgaaagccgcaagacctttgtggagcttatgcggagaggagacctgcccgtctggctcgcccacaaagtggcttctgaaggcattaagtacacagatcgcaaatggtgcttcgacgggcagcggaacaatcagatcctggaggagaacatggatgttgaaatctggacgaaggagggagagaagaagaagctgagaccgcgctggctcgacgcccggacctattccgatcctcttgccctgaaagagtttaaggacttcgctgcgggcagaaaaagcattgccctggatctcgtgacagaaatcgggcgcgtccccacccacctggctcatagaacacggaatgcccttgacaacctggtgatgctccacacctctgagcatggaggcaaggcctaccgccacgctgtcgaggaactgcctgagacgatggaaaccctgctccttctgggcctgatgattctcctgacagggggagccatgctttttctgatctccggcaaagggattggaaagaccagcatcggcctcatctgtgtgattgcgtcctctgggatgctgtggatggccgagatccccctgcaatggattgctagcgccatcgttctcgagttctttatgatggtgcttctgattcctgaacccgagaagcagagaacaccgcaggataatcaactggcttatgtggtcatcggcattctcaccctggccgcgatcatcgccgctaacgaaatgggccttctggagacgacaaaacgggacctcggcatgtccaaggaacctggggttgtgagccccacctcttacctggatgtggacctgcaccccgcctccgcttggacactctacgccgtcgctaccaccgtgattacacctatgcttcgccatacgatcgagaatagcaccgccaacgtttctctggcggccattgctaaccaggccgtggtcctgatgggactcgacaaaggctggccgatcagcaagatggatctgggggtgccccttctggctctcggatgctattcccaggtcaatcctctgacactgaccgccgccgtgctccttctgattacacactacgcgatcatcggccccgggctgcaggctaaagccaccagagaggctcaaaagcggacggccgccggaattatgaagaaccctacagttgacggcatcatgaccattgatctcgaccccgtgatctatgattctaaattcgaaaagcagctgggccaggtcatgcttctggtgctctgtgctgttcagctgctgctcatgagaaccagctgggccctttgcgaggcgctgacactggccaccgggcctattacaacgctctgggaaggatccccgggcaaattttggaataccacaatcgctgtgtctatggccaacatcttccgcgggagctacctggctggagccggccttgcgttttccattatgaaaagcgtcgggaccggaaaacggggcacaggctctcaaggggagaccctgggagaaaagtggaagaaaaagctcaatcagctgtccagaaaagagttcgacctgtataagaaaagcggcatcacggaggtggatcgcaccgaagccaaggaggggctcaaacggggagaaattacacatcacgctgtgtccagaggctctgccaaacttcagtggtttgttgagcggaacatggtcatccccgaagggcgcgtgattgacctgggatgtggcagaggcgggtggagctactattgcgctggactgaagaaagtgaccgaggtccggggctacacaaaagggggacctggccatgaggaacccgttcctatgtccacctacgggtggaatatcgtgaaactcatgtctggaaaggatgtgttctatctgcccccggagcgctgtgacacacttctgtgcgatattggcgaaagctcccctagccccaccgtcgaggagtctagaacgatccgggtgctcaaaatggttgaaccctggctgaagaacaatcagttctgtatcaaggtgctgaacccttacatgcccacagtcattgagcacctcgaacgccttcaaagaaaacacggcgggatgctggtgcggaatcctctgtcccgcaacagcacccatgagatgtattggatctctaatggaaccggcaacattgttgcctccgtgaatatggtcagcagactcctgcttaaccggtttacaatgacgcacagacgcccgaccatcgaaaaggacgtggatctgggggctggaacacggcatgtgaacgccgagcccgagacccctaatatggacgtcattggcgaaagaatcaaacgcatcaaggaggaacacaactctacatggcactacgacgatgagaatccctataaaacctgggcgtaccatgggagctatgaagttaaggccacaggatccgcttctagcatgattaacggcgtggtgaagctcctgaccaaaccttgggacgtcgtgcccatggttacgcagatggccatgaccgatacaaccccgttcggccagcaacgggtgtttaaggagaaagtcgacacaagaacccctcgctccatgcccgggacgcggagagtgatgggaatcacagctgagtggctgtggcgcaccctcggccggaataagaaacctagactgtgcacacgcgaagagttcaccaagaaggttcggacgaacgccgccatgggggcggtgtttaccgaagagaatcagtgggatagcgctaaagccgccgtcgaagacgaggatttctggaaacttgtggacagagagcgcgaactgcacaaactcggaaagtgtggctcctgcgtttacaacatgatggggaaaagagagaagaaactgggcgaatttggaaaggctaagggctctcgggccatttggtacatgtggcttggggctcgctatctggagttcgaggccctcggatttctgaatgaagatcattggttcagcagagagaactcctactctggcgtggaaggggagggactgcacaaactcggctatatcctgcgggacattagcaagatccccgggggcgcgatgtacgccgatgacacagctggatgggacaccagaatcacagaagatgaccttcataatgaggagaaaattacccagcagatggatcctgaacaccggcaactggccaacgctatctttaagctcacatatcagaataaagtcgtgaaggtccagcgccccaccccgacgggcacagtgatggacattatctccagaaaggatcagcgggggtctggacaagttggcacctacgggctgaacaccttcacaaatatggaggcccagcttattcgccagatggaaggagagggcgtgctgagcaaagcggacctcgaaaaccctcatctgcccgagaagaaaatcacccagtggctggagacaaagggggtcgaaagactcaaacggatggccatctccggcgatgactgcgtggtgaagcccattgatgaccgctttgctaacgccctgcttgctctgaatgatatgggaaaggttagaaaagacatccctcaatggcagccgagcaagggctggcatgattggcaacaggtgcccttctgttctcaccatttccacgagctcattatgaaagacgggcggaagctggtcgtgccttgccgcccccaagacgaacttatcggacgggcgcggatttcccagggcgctgggtggagcctgcgcgagacggcctgtctcggaaaagcgtatgcccagatgtggtctctgatgtactttcacagacgggatctgcgcctcgcttccaacgccatctgcagcgccgttcctgtgcattgggtccccacctctagaacaacctggtccattcacgctcatcaccaatggatgacaaccgaagacatgctgacggtgtggaatcgggtctggatcgaggataacccttggatggaggacaagacccccgtgacaacctgggaaaatgttccgtaccttggcaagagagaggatcagtggtgtgggagcctgatcggcctcacatcccgcgccacctgggcgcagaacattcctacggctatccagcaagtgcggagcctgattggaaatgaagagttccttgactatatgccctctatgaaaagatttcgcaaggaggaagagagcgaaggcgccatctggtga

SEQ ID NO: 20746 - RNA, 9873 nt, synthetic construct
  misc_feature 1..9873: note = derived and/or modified CDS sequence (opt5) from DENV-3__EU529686__SS-prME
  source 1..9873: mol_type = other RNA
accagcctgtgcctcatgatgatcctgcccgccgctcttgccttccacctgacatcccgggacggcgaacctcggatgattgtggggaagaacgaacgcggaaagtctctcctgtttaagacggcgagcggcatcaatatgtgtacccttattgctatggatctgggggagatgtgcgacgatacagtgacctacaagtgtccgcacatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacatcattggagtgctggagcagggcaaacggacgcttacccctcagcccatggagctgaagtactcttggaaaacatgggggaaggccaagatcgtcaccgccgaaacacaaaactccagcttcattatcgatggacctaatacccccgagtgcccgtctgcttccagagcgtggaacgtgtgggaagtggaggactatggctttggcgtcttcacaaccaatatctggctcaaactgcgcgaagtttacacgcagctgtgtgaccaccggcttatgagcgccgctgtgaaggatgagagagccgtgcacgccgacatggggtactggattgagtcccagaaaaacggatcttggaagctcgaaaaagctagcctgatcgaggtcaagacatgcacctggcctaagtcccataccctgtggtctaatggcgtgctcgaaagcgatatgattatccccaaatccctggccgggcctattagccagcacaactatcgccccggataccatacacaaaccgcgggcccttggcaccttgggaagctggagctcgactttaattattgcgagggaacgacagttgtgatcaccgaaaactgtggcacacggggcccctctctgagaaccacaaccgtctccgggaaactgatccacgagtggtgctgtcgcagctgcacgcttccgcctctccggtacatgggagaagatggctgttggtatgggatggagattagacccatctctgaaaaggaggagaatatggtgaaatccctggttagcgctggatctggcgaagtggacaacttcaccatgggggtcctgtgcctcgccattctgtttgaggaagtgatgcggggaaagttcggcaagaaacatatgatcgccggcgttttctttacattcgtgcttctgctcagcgggcagattacctggcgcgatatggctcacacactgatcatgattggatccaatgccagcgacagaatgggcatgggggtcacctacctggcgcttatcgctacgtttaagatccagcccttcctggccctcggatttttcctgcggaaactcacatctagagagaacctgcttctgggcgtggggctcgccatggctaccacactgcaactgcctgaagatattgagcagatggccaatggaatcgctcttggcctgatggccctcaagctgattacccagtttgagacctatcagctctggacagcgctgatctcccttacgtgtagcaacaccattttcacactgaccgtggcctggcgcacagctaccctcatcctggccggcgtctccctgcttccggtttgccaatctagctccatgcggaaaacggactggctgcccatgacagtggctgccatgggggtgcctcccctccctctgtttatcttctctctcaaggataccctgaagagacgcagctggccccttaatgaaggagtcatggccgtgggcctggtttccattctggcttctagcctcctgagaaacgacgtgcctatggcggggccccttgtcgccggaggcctgctcatcgcttgttacgtgattaccgggacatccgccgatctgaccgttgagaaagccgctgacgtgacatgggaagaggaagccgagcagacgggagtcagccataacctcatgatcaccgtggacgatgacggcacaatgcggattaaggatgacgagaccgaaaatatcctgacagtccttctgaaaaccgcgctgctcatcgtgtctggcatttttccgtactccatccctgctacgctgcttgtttggcacacctggcagaagcagacacaacgcagcggggtgctgtgggatgtcccctctcctcccgagacccagaaagccgaactcgaggagggagtgtatagaattaagcagcagggcatcttcgggaaaacacaagttggagtgggcgtccagaaggaaggggtgtttcataccatgtggcacgtgacacggggagccgttctgacgtacaacggcaagcgcctcgagccgaattgggcttccgtcaaaaaggacctgattagctatggcgggggatggagactttctgcccagtggcaaaaaggcgaagaggtccaggtgatcgcggtcgaacctgggaagaaccccaaaaatttccagaccatgcctggaacattccagaccaccacaggcgagattggggctatcgccctggattttaagcccggaacgtccggcagccccatcattaaccgggagggcaaggtggttgggctgtacggaaatggcgtggtcaccaaaaacgggggatatgtgtccggcatcgcccaaacaaatgctgaacctgacgggccgacccccgagctcgaagaggaaatgttcaagaaacgcaacctgacaattatggatcttcaccctggcagcggaaagaccagaaaatacctgcccgccatcgttcgggaggctattaagcgcagactccggacgctgatcctcgcccctacaagagtggtcgcggccgagatggaagaggctctgaagggccttcccatccgctatcagaccaccgccacaaaatctgaacataccgggcgggagattgtggacctgatgtgccacgctacatttaccatgagactgctcagccctgttcgcgtgccgaattacaacctgatcattatggatgaagcccatttcacggaccccgcctccatcgctgcgcggggatacatttctacaagagtcggcatgggggaggccgctgccatctttatgaccgccacacctcccggaaccgctgatgccttccctcagagcaatgcgcccatccaggacgaggaacgcgacattccggagcggtcctggaactctggcaatgaatggatcacggattttgctgggaagaccgtgtggttcgtgcctagcattaaagccggcaacgacatcgccaactgtcttagaaagaatggcaaaaaggtcattcaactgtcccgcaagacatttgataccgagtatcagaaaacaaagctcaacgactgggatttcgttgtgaccacagacatctctgagatgggagctaattttaaagccgatcgggtgattgaccccagacggtgcctgaagcccgtcatcctgaccgatgggcctgaacgcgtgatcctcgcgggacccatgcctgttacggccgctagcgccgctcagagacggggccgcgtggggagaaacccgcagaaagagaatgaccaatacattttcacaggacagccccttaacaatgatgaagaccacgcccattggaccgaggctaagatgctgctggacaacatcaatacccctgaaggcattatccccgccctcttcgagcctgagcgggaaaagtccgcggccattgatggggagtatagactgaaaggcgaaagccgcaagacatttgtcgagcttatgcggagaggagacctgcccgtgtggctcgctcacaaagttgcctctgaaggcatcaagtacaccgatcgcaaatggtgcttcgacgggcagcggaacaatcagatcctggaggagaacatggatgtggaaatttggacaaaggagggagagaagaagaagctgagaccgcgctggctcgacgctcggacgtattccgatcctcttgccctgaaagagtttaaggacttcgccgctggcagaaaaagcatcgcgctggatctcgtcaccgaaattgggcgcgtgcccacacacctggcccatagaacccggaatgctcttgacaacctggtcatgctccacacatctgagcatggaggcaaggcctaccgccacgccgtggaggaactgcctgagaccatggaaacgctgctccttctgggcctgatgatcctcctgaccgggggagctatgctttttctgatttccggcaaagggatcggaaagacaagcatcggcctcatttgtgttatcgcctcctctgggatgctgtggatggcggagattcccctgcaatggatcgccagcgctattgtgctcgagttctttatgatggtgcttctgatccctgaacccgagaagcagagaaccccgcaggataatcaactggcctatgtcgttattggaatcctcacactggctgccatcattgcggccaacgaaatgggccttctggagaccacgaaacgggacctcggcatgtccaaggaacctggggtggtgagccccacatcttacctggatgtcgacctgcaccccgcttccgcctggaccctctacgctgtggccacaaccgttatcacccctatgcttcgccatacaattgagaatagcacggctaacgtgtctctggccgcgatcgccaaccaggctgtcgtgctgatgggactcgacaaaggctggccgattagcaagatggatctgggggtcccccttctggccctcggatgctattcccaggtgaatcctctgaccctgacagctgccgttctccttctgatcacccactacgccatcattggccccgggctgcaggcgaaagctacaagagaggcccaaaagcggaccgctgccggaatcatgaagaaccctacggtggacggcattatgacaatcgatctcgaccccgtcatttatgattctaaattcgaaaagcagctgggccaggtgatgcttctggttctctgtgccgtgcagctgctgctcatgagaaccagctgggctctttgcgaggccctgaccctggcgacagggcctatcaccacactctgggaaggatccccgggcaaattttggaatacgaccatcgccgtctctatggctaacattttccgcgggagctacctggccggagctggccttgccttttccatcatgaaaagcgtggggacaggaaaacggggcaccggctctcaaggggagacactgggagaaaagtggaagaaaaagctcaatcagctgtccagaaaagagttcgacctgtataagaaaagcggcattaccgaggtggatcgcacggaagcgaaggaggggctcaaacggggagaaatcacccatcacgccgtttccagaggctctgctaaacttcagtggtttgtcgagcggaacatggtgattcccgaagggcgcgtgatcgacctgggatgtggcagaggcgggtggagctactattgcgccggactgaagaaagtcacagaggttcggggctacaccaaagggggacctggccatgaggaacccgtgcctatgtccacatacgggtggaatattgtgaaactcatgtctggaaaggatgtcttctatctgcccccggagaaatgtgacacccttctgtgcgatatcggcgaaagctcccctagccccacagtggaggagtctcgcaccatcagagttctcaagatggtggaaccctggctgaagaacaatcagttctgtattaaagtcctgaacccttacatgcccacggtgatcgagcacctcgaacggcttcaacgcaagcacggcgggatgctggttagaaatcctctgtcccggaacagcacacatgagatgtattggatttctaatggaaccggcaacatcgtggcttccgtcaatatggtgagccgcctcctgcttaacagatttaccatgacacaccggagaccgacgattgaaaaagacgtggatctgggggccggaacccgccatgtcaacgctgagcccgagacacctaatatggacgttatcggcgaacggatcaagagaattaaagaggaacacaactctacctggcactacgacgatgagaatccctataagacatgggcctaccatgggagctatgaagtgaaggcgaccggatccgcctctagcatgatcaacggcgtggtcaaactcctgacaaagccttgggacgtggttcccatggtgacccagatggctatgacggataccacaccgttcggccagcaacgcgtctttaaagagaaggtggacacccggacacctagatccatgcccgggacccgccgggttatgggaattacggccgagtggctgtggagaacactcggccgcaataaaaagcctcggctgtgcaccagagaagagttcacaaagaaagtgcgcaccaacgctgccatgggggccgtctttacggaagagaatcagtgggatagcgcgaaggctgccgtggaagacgagaacttctggaaacttgttgatcgggagagagaactgcacaagctcggaaaatgtggctcctgcgtgtacaatatgatggggaagcgcgagaaaaagctgggcgaatttggaaaggccaaaggctctagagctatctggtacatgtggcttggggcccggtatctggagttcgaggctctcggatttctgaacgaagaccattggttcagccgcgaaaattcctactctggcgtcgagggggagggactgcacaagctcggctatattctgagagatatcagcaaaatccccgggggcgccatgtacgcggacgataccgccggatgggacacacggattaccgaagacgatcttcataacgaggagaagatcacacagcagatggaccctgaacacagacaactggctaatgccatttttaaactcacctatcagaacaaggtggtcaaggtgcagcggcccacaccgaccggcacggttatggatatcatttcccgcaaagaccagagagggtctggacaagtgggcacatacgggctgaataccttcaccaacatggaggctcagcttatccggcagatggaaggagagggcgtcctgagcaaggccgatctcgaaaactcccatctgcctgagaaaaagatcacacagtggctggagaccaaaggggtggaacgcctcaagagaatggcgattagcggcgacgattgcgtggttaagcccatcgacgatcggtttgccaatgctctgcttgccctgaacgacatgggaaaagtgcgcaaggatattccccaatggcagccttctaaaggctggcatgactggcagcaggtcccgttctgttcccaccatttccacgagctcatcatgaaggatgggagaaaactggtggttccctgccggcctcaagacgaacttattggacgcgctagaatcagccagggcgccgggtggtctctgcgggagacagcttgtctcggaaaggcctatgcgcagatgtggtccctgatgtactttcaccgcagagacctgcggctcgccagcaatgctatttgctctgccgtgcccgtccattgggtgcctacgtcccgcaccacatggagcatccacgcccatcaccaatggatgaccacagaagatatgctgaccgtctggaacagagtgtggatcgaggacaatccctggatggaggataagacgcctgttaccacatgggaaaacgtgccctaccttggcaaacgggaggaccagtggtgtgggtccctgattggcctcaccagcagagctacatgggcccagaatatcccgaccgcgattcagcaagtccgctctctgatcggaaacgaagagttccttgattatatgcctagcatgaagcggtttagaaaagaggaagagtccgaaggcgctatttggtga

SEQ ID NO: 20747 - RNA, 9873 nt, synthetic construct
  misc_feature 1..9873: note = derived and/or modified CDS sequence (opt5) from DENV-3__EU529687__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccagaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctcggggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacatcattggagtgctggagcagggcaaacggacgcttacccctcagcccatggagctgaagtactcttggaaaacatgggggaaggccaagatcgtcaccgccgaaacacaaaactccagcttcattatcgatggacctaatacccccgagtgcccgtctgcttccagagcgtggaacgtgtgggaagtggaggactatggctttggcgtcttcacaaccaatatctggctcaaactgcgcgaagtttacacgcagctgtgtgaccaccggcttatgagcgccgctgtgaaggatgagagagccgtgcacgccgacatggggtactggattgagtcccagaaaaacggatcttggaagctcgaaaaagctagcctgatcgaggtcaagacatgcacctggcctaagtcccataccctgtggtctaatggcgtgctcgaaagcgatatgattatccccaaatccctggccgggcctattagccagcacaactatcgccccggataccatacacaaaccgcgggcccttggcaccttgggaagctggagctcgactttaattattgcgagggaacgacagttgtgatcaccgaaaactgtggcacacggggcccctctctgagaaccacaaccgtctccgggaaactgatccacgagtggtgctgtcgcagctgcacgcttccgcctctccggtacatgggagaagatggctgttggtatgggatggagattagacccatctctgaaaaggaggagaatatggtgaaatccctggttagcgctggatctggcgaagtggacaacttcaccatgggggtcctgtgcctcgccattctgtttgaggaagtgatgcggggaaagttcggcaagaaacatatgatcgccggcgttttctttacattcgtgcttctgctcagcgggcagattacctggcgcgatatggctcacacactgatcatgattggatccaatgccagcgacagaatgggcatgggggtcacctacctggcgcttatcgctacgtttaagatccagcccttcctggccctcggatttttcctgcggaaactcacatctagagagaacctgcttctgggcgtggggctcgccatggctaccacactgcaactgcctgaagatattgagcagatggccaatggaatcgctcttggcctgatggccctcaagctgattacccagtttgagacctatcagctctggacagcgctgatctcccttacgtgtagcaacaccattttcacactgaccgtggcctggcgcacagctaccctcatcctggccggcgtctccctgcttccggtttgccaatctagctccatgcggaaaacggactggctgcccatgacagtggctgccatgggggtgcctcccctccctctgtttatcttctctctcaaggataccctgaagagacgcagctggccccttaatgaaggagtcatggccgtgggcctggtttccattctggcttctagcctcctgagaaacgacgtgcctatggcggggccccttgtcgccggaggcctgctcatcgcttgttacgtgattaccgggacatccgccgatctgaccgttgagaaagccgctgacgtgacatgggaagaggaagccgagcagacgggagtcagccataacctcatgatcaccgtggacgatgacggcacaatgcggattaaggatgacgagaccgaaaatatcctgacagtccttctgaaaaccgcgctgctcatcgtgtctggcatttttccgtactccatccctgctacgctgcttgtttggcacacctggcagaagcagacacaacgcagcggggtgctgtgggatgtcccctctcctcccgagacccagaaagccgaactcgaggagggagtgtatagaattaagcagcagggcatcttcgggaaaacacaagttggagtgggcgtccagaaggaaggggtgtttcataccatgtggcacgtgacacggggagccgttctgacgtacaacggcaagcgcctcgagccgaattgggcttccgtcaaaaaggacctgattagctatggcgggggatggagactttctgcccagtggcaaaaaggcgaagaggtgcaggtgatcgcggtcgaacctgggaagaaccccaaaaatttccagaccatgcctggaacattccagaccaccacaggcgagattggggctatcgccctggattttaagcccggaacgtccggcagccccatcattaaccgggagggcaaggtggttgggctgtacggaaatggcgtggtcaccaaaaacgggggatatgtgtccggcatcgcccaaacaaatgctgaacctgacgggccgacccccgagctcgaagaggaaatgttcaagaaacgcaacctgacaattatggatcttcaccctggcagcggaaagaccagaaaatacctgcccgccatcgttcgggaggctattaagcgcagactccggacgctgatcctcgcccctacaagagtggtcgcggccgagatggaagaggctctgaagggccttcccatccgctatcagaccaccgccacaaaatctgaacataccgggcgggagattgtggacctgatgtgccacgctacatttaccatgagactgctcagccctgttcgcgtgccgaattacaacctgatcattatggatgaagcccatttcacggaccccgcctccatcgctgcgcggggatacatttctacaagagtcggcatgggggaggccgctgccatctttatgaccgccacacctcccggaaccgctgatgccttccctcagagcaatgcgcccatccaggacgaggaaaaggacattccggagcgctcctggaactctggcaatgaatggatcacggattttgctgggaaaaccgtgtggttcgtgcctagcattaaggccggcaacgacatcgccaactgtcttcggaaaaatggaaagaaggtcattcaactgtccagaaaaacatttgataccgagtatcagaagacaaaactcaacgactgggatttcgttgtgaccacagacatctctgagatgggcgctaattttaaggccgatcgcgtgattgacccccggagatgcctgaaacccgtcatcctgaccgatgggcctgaacgggtgatcctcgcgggacccatgcctgttacggccgctagcgccgctcagcgcagaggccgggtggggcgcaacccgcagaaggagaatgaccaatacattttcacaggacagccccttaacaatgatgaagaccacgcccattggaccgaggctaagatgctgctggacaacatcaatacccctgaaggcattatccccgccctcttcgagcctgagagagaaaaatccgcggccattgatggggagtatcggctgaagggcgaaagcagaaaaacatttgtcgagcttatgcgccggggagacctgcccgtgtggctcgctcacaaggttgcctctgaaggcatcaaatacaccgatagaaagtggtgcttcgacgggcagcgcaacaatcagatcctggaggagaacatggatgtggaaatttggacaaaagagggagaaaagaagaaactgcggccgagatggctcgacgctcgcacgtattccgatcctcttgccctgaaggagtttaaagacttcgccgctggccggaagagcatcgcgctggatctcgtcaccgaaattgggagagtgccctctcacctggcccatcgcacaagaaatgctcttgacaacctggtcatgctccacacctccgagcatggaggcaaagcctaccggcacgccgtggaggaactgcctgagacaatggaaaccctgctccttctgggcctgatgatcctcctgacggggggagctatgctttttctgattagcggcaaggggatcggaaagacctccatcggcctcatttgtgttatcgcctctagcgggatgctgtggatggcggagattcccctgcaatggatcgcctccgctattgtgctcgagttctttatgatggtgcttctgatccctgaacccgagaaacagcgcacaccgcaggataatcaactggcctatgtcgttattggaatcctcaccctggctgccatcattgcggccaacgaaatgggccttctggagacaaccaagagagacctcggcatgagcaaagaacctggggtggtgtctcccacgtcctacctggatgtcgacctgcaccccgctagcgcctggacactctacgctgtggccaccacagttatcacccctatgcttcggcataccattgagaattctacagctaacgtgagcctggccgcgatcgccaaccaggctgtcgtgctgatgggactcgacaagggctggccgatttccaaaatggatctgggggtcccccttctggccctcggatgctattctcaggtgaatcctctgacgctgaccgctgccgttctccttctgatcacacactacgccatcattggccccgggctgcaggcgaaggctacccgcgaggcccaaaagagaacagctgccggaatcatgaaaaaccctaccgtggacggcattatgacgatcgatctcgaccccgtcatttatgatagcaagttcgaaaaacagctgggccaggtgatgcttctggttctctgtgccgtgcagctgctgctcatgcggacatcctgggctctttgcgaggccctgaccctggcgaccgggcctatcacaaccctctgggaaggatctccgggcaagttttggaatacaacgatcgccgtcagcatggctaacattttcagagggtcctacctggccggagctggccttgcctttagcatcatgaaatctgtggggaccggaaagcgcggcacaggctcccaaggggagaccctgggagaaaagtggaaaaagaaactcaatcagctgagccggaaggagttcgacctgtataaaaagtccggcattacagaggtggatagaaccgaagcgaaagaggggctcaagcgcggagaaatcacgcatcacgccgtttctcggggcagcgctaagcttcagtggtttgtcgagagaaacatggtgattcccgaagggcgggtgatcgacctgggatgtggccgcggcgggtggtcctactattgcgccggactgaaaaaggtcaccgaggttagaggctacacaaaagggggacctggccatgaggaacccgtgcctatgtctacctacgggtggaatattgtgaagctcatgagcggaaaagatgtcttctatctgcccccggagaagtgtgacacacttctgtgcgatatcggcgaatccagcccttctcccaccgtggaggagtcccggacaatccgcgttctcaagatggtggaaccctggctgaaaaacaatcagttctgtattaaggtcctgaacccttacatgcccaccgtgatcgagcacctcgaaagacttcaacggaaacacggcgggatgctggttcgcaatcctctgagcagaaactctacgcatgagatgtattggatttccaatggaacaggcaacatcgtggctagcgtcaatatggtgtctcggctcctgcttaaccgctttaccatgacccacagacggccgacaattgaaaaggacgtggatctgggggccggaacgagacatgtcaacgctgagcccgagacccctaatatggacgttatcggcgaacgcatcaaacggattaaggaggaacacaacagcacatggcactacgacgatgagaatccctataagacctgggcctaccatgggtcctatgaagtgaaagcgacaggatctgccagctccatgatcaacggcgtggtcaagctcctgaccaaaccttgggacgtggttcccatggtgacacagatggctatgaccgatacgaccccgttcggccagcaaagagtctttaaggagaaagtggacacacgcacccctcggagcatgcccgggacaagacgcgttatgggaattaccgccgagtggctgtggcggacgctcggcagaaataagaagcctcgcctgtgcacacgggaagagttcaccaaaaaggtgagaacaaacgctgccatgggggccgtctttaccgaagagaatcagtgggattccgcgaaagctgccgtggaagacgaggatttctggaagcttgttgaccgcgagcgggaactgcacaaactcggaaagtgtggctcttgcgtgtacaacatgatggggaaaagagagaagaagctgggcgaatttggaaaagccaagggcagccgcgctatctggtacatgtggcttggggccagatatctggagttcgaggctctcggatttctgaatgaagatcattggttctcccgggagaactcttacagcggcgtcgaaggggagggactgcacaaactcggctatattctgcgcgacatctccaagatccccgggggcgccatgtacgcggatgacacggccggatgggacaccagaattacagaagatgaccttcataatgaggagaaaatcacccagcagatggatcctgaacaccggcaactggctaacgccatttttaagctcacatatcagaataaggtggtcaaagtgcagagacccaccccgacaggcaccgttatggacatcatttctcggaaggatcagcgcgggagcggacaagtgggcacgtacgggctgaacacattcaccaatatggaggctcagcttatcagacagatggaaggagagggcgtcctgtccaaagccgacctcgaaaaccctcacctgcccgagaagaaaatcacccagtggctggagacaaagggggtggaacggctcaagcgcatggcgattagcggcgatgactgcgtggttaaacccatcgatgacagatttgccaacgctctgcttgccctgaatgatatgggaaaggtgcggaaagacattcctcaatggcagccgtctaagggctggcatgattggcagcaggtccccttctgttcccaccatttccacgagctcatcatgaaagacgggcgcaagctggtggttccttgcagaccccaagacgaacttattggacgggctcgcatcagccagggcgccgggtggtctctgagagagaccgcttgtctcggaaaggcctatgcgcagatgtggtccctgatgtactttcaccggcgcgatctgagactcgccagcaacgctatttgctctgccgtgcctgtccattgggtgcccacatcccggacgacctggagcatccacgcccatcaccaatggatgacaaccgaagacatgctgacagtctggaatcgcgtgtggatcgaggataacccttggatggaggacaaaacccccgttacgacctgggaaaatgtgccgtaccttggcaagagagaggatcagtggtgtgggtccctgattggcctcacaagccgggctacctgggcccagaacatccctacagcgattcagcaagtcagatctctgatcggaaatgaagagttccttgactatatgcccagcatgaaacgctttcggaaggaggaagagtccgaaggcgctatttggtga

SEQ ID NO: 20748 - RNA, 9873 nt, synthetic construct
  misc_feature 1..9873: note = derived and/or modified CDS sequence (opt5) from DENV-3__KF955449__SS-prME
  source 1..9873: mol_type = other RNA
accagcctgtgcctcatgatgatcctgcccgccgctcttgccttccacctgacgtcccgggacggagaacctcggatgattgtggggaagaacgaacgcggaaagtctctcctgtttaagacggcgagcggcatcaatatgtgtacccttattgctatggatctgggggagatgtgcgacgatacagtcacctacaaatgtccgcacatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcgtgctgcttatgctggttaccccttctatgacaatgagatgtgtgggagtcggcaaccgggactttgtggaagggctcagcggagctacctgggtggatgtcgttctggagcacggcgggtgcgtgaccacaatggccaagaataaacccacgctggacatcgagctccagaagaccgaagctacacagctggccacccttcgcaaactgtgtattgagggaaagatcacaaacattaccacggattccagatgccctacacagggcgaagcggtgctcccggaggaacaggaccagaattatgtctgtaaacacacctacgtggatcggggctgggggaacggatgcggcctgttcgggaagggaagccttgttacctgcgccaagtttcaatgtctggagcccatcgagggcaaagtggtccagtatgaaaatctcaagtacacagtgattatcaccgttcatacaggggaccagcaccaggtgggaaacgagacgcaaggcgtcaccgctgaaatcacacctcaggcctctaccacagaggctattctgcccgaatatggcaccctggggctcgagtgctcccctcgcacgggactggacttcaatgagatgatccttctgaccatgaaaaacaaggcctggatggtgcatagacagtggtttttcgatctccccctgccgtggacaagcggcgccaccacagaaacccctacgtggaatcggaaagagcttctggtcacatttaagaacgctcacgcgaaaaagcaagaagtggttgtgctcgggtctcaggagggagccatgcacaccgctctgacaggcgccaccgaaattcaaaattccgggggcaccagcatcttcgccggacatctgaagtgtcgcctcaaaatggacaagctggagcttaaaggcatgtcttacgctatgtgcacaaacacgtttgtcctgaagaaagaggtgtccgaaacccagcacgggacaattctcatcaaggttgagtacaagggagaagatgtgccctgtaaaatccctttcagcaccgaggacggccaagggaaggcccataacggaagactgattacagcgaatcccgtcgtgaccaaaaaggaggaacccgtgaacatcgaggctgaacctccgttcggcgagtccaatattgttatcgggattggcgataacgccctgaaaatcaattggtataagaagggatctagcatcggcaaaatgtttgaagccacggctagaggggccagacgcatggctattcttggagacacagcctgggatttcggctccgtcgggggagtgctcaacagcctgggcaagatggtgcaccagatctttgggtctgcgtacaccgccctgttctccggcgtcagctgggtgatgaaaattggaatcggcgttctcctgacctggattgggcttaattctaagaacacaagcatgtccttttcttgcatcgctattggaatcatcaccctgtatctcggcgccgtggtccaggctgacatggggtgtgtgattaattggaaaggaaaggagctgaagtgcggcagcgggatcttcgttacaaacgaggtgcatacgtggaccgaacagtacaaatttcaagccgattcccccaagcggctggcgacagccattgctggcgcctgggagaatggagtctgtggcatcagaagcaccacacgcatggaaaaccttctctggaaacagattgctaatgagctgaactatatcctgtgggaaaataacatcaagctcaccgtggttgtgggggacattatcggagtcctggagcagggcaaacggacgcttacccctcagcccatggagctgaagtactcttggaaaacatgggggaaggccaagattgtgaccgccgaaacacaaaactccagcttcatcattgatggacctaatacccccgagtgcccgtctgcttccagagcgtggaacgtgtgggaagtcgaggactatggctttggcgttttcacaaccaatatctggctcaaactgcgcgaagtgtacacgcagctgtgtgaccaccggcttatgagcgccgctgtgaaggatgagagagccgtccacgccgacatggggtactggatcgagtcccagaaaaacggatcttggaagctcgaaaaagctagcctgattgaggtgaagacatgcacctggcctaagtcccataccctgtggtctaatggcgttctcgaaagcgatatgatcattcccaaatccctggccgggcctatcagccagcacaactatcgccccggataccatacacaaaccgcgggcccttggcaccttgggaagctggagctcgactttaattattgcgagggaacgacagtggtcattaccgaaaactgtggcacacggggcccctctctgagaaccacaaccgtgtccgggaaactgatccacgagtggtgctgtcgcagctgcacgcttccgcctctccggtacatgggagaagatggctgttggtatgggatggagatcagacccatttctgaaaaggaggagaatatggttaaatccctggtgagcgctggatctggcgaagtcgacaacttcaccatgggggtgctgtgcctcgccatcctgtttgaggaagttatgcggggaaagttcggcaagaaacatatgattgccggcgtgttctttacattcgtccttctgctcagcgggcagatcacctggcgcgatatggctcacacactgattatgatcggatccaatgccagcgacagaatgggcatgggggtgacctacctggcgcttattgctacgtttaagatccagcccttcctggccctcggatttttcctgcggaaactcacatctagagagaacctgcttctgggcgtggggctcgccatggctaccacactgcaactgcctgaagatatcgagcagatggccaatggaattgctcttggcctgatggccctcaagctgatcacccagtttgagacctatcagctctggacagcgctgatttcccttacgtgtagcaacaccatcttcacactgaccgtcgcctggcgcacagctaccctcattctggccggcgtttccctgcttccggtgtgccaatctagctccatgcggaaaacggactggctgcccatgacagtggctgccatgggggtccctcccctccctctgtttatcttctctctcaaggataccctgaagagacgcagctggccccttaatgaaggagtgatggccgttggcctggtgtccatcctggcttctagcctcctgagaaacgacgtccctatggcggggccccttgtggccggaggcctgctcattgcttgttacgttatcaccgggacatccgccgatctgaccgtggagaaagccgctgacgtcacatgggaagaggaagccgagcagacgggagtgagccataacctcatgattaccgtcgacgatgacggcacaatgcggatcaaggatgacgagaccgaaaatattctgacagtgcttctgaaaaccgcgctgctcatcgtttctggcatctttccgtactccattcctgctacgctgcttgtgtggcacacctggcagaagcagacacaacgcagcggggtcctgtgggatgtgccctctcctcccgagacccagaaagccgaactcgaggagggagtttatagaatcaagcagcagggcattttcgggaaaacacaagtgggagtcggcgtgcagaaggaaggggtgtttcataccatgtggcacgttacacggggagccgtcctgacgtacaacggcaagcgcctcgagccgaattgggcttccgtgaaaaaggacctgatcagctatggcgggggatggagactttctgcccagtggcaaaaaggcgaagaggtgcaggtcattgcggtggaacctgggaagaaccccaaaaatttccagaccatgcctggaacattccagaccaccacaggcgagatcggggctattgccctggattttaagcccggaacgtccggcagccccatcatcaaccgggagggcaaggttgtggggctgtacggaaatggcgtcgtgaccaaaaacgggggatatgtttccggcattgcccaaacaaatgctgaacctgacgggccgacccccgagctcgaagaggaaatgttcaagaaacgcaacctgacaatcatggatcttcaccctggcagcggaaagaccagaaaatacctgcccgccattgtgcgggaggctatcaagcgcagactccggacgctgattctcgcccctacaagagtcgtggcggccgagatggaagaggctctgaagggccttcccatccgctatcagaccaccgccacaaaatctgaacataccgggcgggagatcgttgacctgatgtgccacgctacatttaccatgagactgctcagccctgtgcgcgtcccgaattacaacctgattatcatggatgaagcccatttcacggaccccgcctccattgctgcgcggggatacatctctacaagagtgggcatgggggaggccgctgccatttttatgaccgccacacctcccggaaccgctgatgccttccctcagagcaatgcgcccatccaggacgaggaacgcgacatcccggagcggtcctggaactctggcaatgaatggattacggattttgctgggaagaccgtgtggttcgtccctagcatcaaagccggcaacgacattgccaactgtcttagaaagaatggcaaaaaggttatccaactgtcccgcaagacatttgataccgagtatcagaaaacaaagctcaacgactgggatttcgtggtgaccacagacatttctgagatgggagctaattttaaagccgatcgggtcatcgaccccagacggtgcctgaagcccgtgattctgaccgatgggcctgaacgcgttatcctcgcgggacccatgcctgtgacggccgctagcgccgctcagagacggggccgcgtcgggagaaacccgcagaaagagaatgaccaatacatcttcacaggacagccccttaacaatgatgaagaccacgcccattggaccgaggctaagatgctgctggacaacattaatacccctgaaggcatcattcccgccctcttcgagcctgagcgggaaaagtccgcggccatcgatggggagtatagactgaaaggcgaaagccgcaagacatttgtggagcttatgcggagaggagacctgcccgtttggctcgctcacaaagtggcctctgaaggcattaagtacaccgatcgcaaatggtgcttcgacgggcagcggaacaatcagatcctggaggagaacatggatgtcgaaatctggacaaaggagggagagaagaagaagctgagaccgcgctggctcgacgctcggacgtattccgatcctcttgccctgaaagagtttaaggacttcgccgctggcagaaaaagcattgcgctggatctcgtgaccgaaatcgggcgcgtcccctctcacctggcccatagaacacggaatgctcttgacaacctggtgatgctccacacctccgagcatggaggcaaggcctaccgccacgccgttgaggaactgcctgagacaatggaaaccctgctccttctgggcctgatgattctcctgacagggggagctatgctttttctgatcagcggcaaagggattggaaagacctccatcggcctcatctgtgtgattgcctctagcgggatgctgtggatggcggagatccccctgcaatggattgcctccgctatcgtgctcgagttctttatgatggtccttctgattcctgaacccgagaagcagagaacaccgcaggataatcaactggcctatgttgtgatcggcattctcaccctggctgccatcatcgcggccaacgaaatgggccttctggagacaaccaaacgggacctcggcatgagcaaggaacctggggtggtctctcccacgtcctacctggatgtggacctgcaccccgctagcgcctggacactctacgctgttgccaccacagtgattacccctatgcttcgccataccatcgaaaattctacagctaacgtcagcctggccgcgattgccaaccaggctgtggtcctgatgggactcgacaaaggctggccgatctccaagatggatctgggggtgccccttctggccctcggatgctattctcaggttaatcctctgacgctgaccgctgccgtgctccttctgattacacactacgccatcatcggccccgggctgcaggcgaaagctaccagagaggcccaaaagcggacagctgccggaattatgaagaaccctaccgtcgacggcatcatgacgattgatctcgaccccgtgatctatgatagcaaattcgagaagcagctgggccaggttatgcttctggtgctctgtgccgtccagctgctgctcatgagaacatcctgggctctttgcgaggccctgaccctggcgaccgggcctattacaaccctctgggaaggatctccgggcaaattttggaatacaacgatcgccgtgagcatggctaacatcttccgcgggtcctacctggccggagctggccttgcctttagcattatgaagtctgtggggaccggaaaacggggcacaggctcccaaggggagaccctgggagaaaagtggaagaaaaagctcaatcagctgagcagaaaagagttcgacctgtataagaaatccggcatcacagaggttgatcgcaccgaagcgaaggaggggctcaaacggggagaaattacgcatcacgccgtctctagaggcagcgctaaacttcagtggtttgtggagcggaacatggtgatccccgaagggcgcgtcattgacctgggatgtggcagaggcgggtggtcctactattgcgccggactgaagaaagttaccgaggtgcggggctacacaaaagggggacctggccatgaggaacccgtgcctatgtctacctacgggtggaatatcgtcaaactcatgagcggaaaggatgtgttctatctgcccccggagaaatgtgacacacttctgtgcgatattggcgaatccagcccttctcccaccgttgaggagtcccgcacaatcagagtgctcaagatggtcgaaccctggctgaagaacaatcagttctgtatcaaagtgctgaacccttacatgcccaccgttattgagcacctcgaacggcttcaacgcaagcacggcgggatgctggtgagaaatcctctgagccggaactctacgcatgagatgtattggatctccaatggaacaggcaacattgtcgctagcgtgaatatggtgtctcgcctcctgcttaacagatttaccatgacccaccggagaccgacaatcgaaaaagacgtcgatctgggggccggaacgcgccatgttaacgctgagcccgagacccctaatatggacgtgattggcgaacggatcaagagaatcaaagaggaacacaacagcacatggcactacgacgatgagaatccctataagacctgggcctaccatgggtcctatgaagtgaaggcgacaggatctgccagctccatgattaacggcgtcgtgaaactcctgaccaagccttgggacgttgtgcccatggtcacacagatggctatgaccgatacgaccccgttcggccagcaacgcgtgtttaaagagaaggttgacacacggacccctagaagcatgcccgggacacgccgggtgatgggaatcaccgccgagtggctgtggagaacgctcggccgcaataaaaagcctcggctgtgcacaagagaagagttcaccaagaaagtccgcacaaacgctgccatgggggccgtgtttaccgaagagaatcagtgggattccgcgaaggctgccgttgaagacgaggatttctggaaacttgtggaccgggagagagaactgcacaagctcggaaaatgtggctcttgcgtctacaacatgatggggaagcgcgagaaaaagctgggcgaatttggaaaggccaaaggcagcagagctatttggtacatgtggcttggggcccggtatctggagttcgaggctctcggatttctgaatgaagatcattggttctcccgcgagaactcttacagcggcgtggaaggggagggactgcacaagctcggctatatcctgagagacatttccaaaatccccgggggcgccatgtacgcggatgacacggccggatgggacacccggatcacagaagatgaccttcataatgaggagaagattacccagcagatggatcctgaacacagacaactggctaacgccatctttaaactcacatatcagaataaggtcgtgaaggttcagcggcccaccccgacaggcaccgtgatggacattatctctcgcaaagatcagagagggagcggacaagtcggcacgtacgggctgaacacattcaccaatatggaggctcagcttattcggcagatggaaggagagggcgtgctgtccaaggccgacctcgaaaaccctcatctgcccgagaaaaagatcacccagtggctggagacaaaaggggtggaacgcctcaagagaatggcgatcagcggcgatgactgcgttgtgaagcccattgatgaccggtttgccaacgctctgcttgccctgaatgatatgggaaaagtccgcaaggacatccctcaatggcagccgtctaaaggctggcatgattggcaacaggtgcccttctgttcccaccatttccacgagctcattatgaaggacgggagaaaactggttgtgccttgccggccccaagacgaacttatcggacgcgctagaattagccagggcgccgggtggtctctgcgggagaccgcttgtctcggaaaggcctatgcgcagatgtggtccctgatgtactttcaccgcagagatctgcggctcgccagcaacgctatctgctctgccgtccctgtgcattgggtccccacatcccgcacgacctggagcattcacgcccatcaccaatggatgacaaccgaagacatgctgacagtgtggaatagagtttggatcgaggataacccttggatggaggacaagacccccgtgacgacctgggaaaatgtcccgtaccttggcaaacgggaggatcagtggtgtgggtccctgatcggcctcacaagcagagctacctgggcccagaacattcctacagcgatccagcaagtgcgctctctgattggaaatgaagagttccttgactatatgcccagcatgaagcggtttagaaaagaggaagagtccgaaggcgctatctggtga

SEQ ID NO: 20749 - RNA, 9873 nt, synthetic construct
  misc_feature 1..9873: note = derived and/or modified CDS sequence (opt5) from DENV-3__FJ373303__SS-prME
  source 1..9873: mol_type = other RNA
accagcctgtgcctcatgatgatcctgcccgccgctcttgccttccacctgacgtcccgggacggagaacctcggatgattgtggggaagaacgaacgcggaaagtctctcctgtttaagacggcgagcggcatcaatatgtgtacccttattgctatggatctgggggagatgtgcgacgatacagtcacctacaaatgtccgcacatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacgtcaagctcaccgtggttgtgggggacattatcggagtcctggagcagggcaaacggacgcttacccctcagcccatggagctgaagtactcttggaaaacatgggggaaggccaagattgtgaccgccgaaacacaaaactccagcttcatcattgatggacctaatacccccgagtgcccgtctgcttccagagcgtggaacgtgtgggaagtcgaggactatggctttggcgttttcacaaccaatatctggctcaaactgcgcgaagtgtacacgcagctgtgtgaccaccggcttatgagcgccgctgtgaaggatgagagagccgtccacgccgacatggggtactggatcgagtcccagaaaaacggatcttggaagctcgaaaaagctagcctgattgaggtgaagacatgcacctggcctaagtcccataccctgtggtctaatggcgttctcgaaagcgatatgatcattcccaaatccctggccgggcctatcagccagcacaactatcgccccggataccatacacaaaccgcgggcccttggcaccttgggaagctggagctcgactttaattattgcgagggaacgacagtggtcattaccgaaaactgtggcacacggggcccctctctgagaaccacaaccgtgtccgggaaactgatccacgagtggtgctgtcgcagctgcacgcttccgcctctccggtacatgggagaagatggctgttggtatgggatggagatcagacccatttctgaaaaggaggagaatatggttaaatccctggtgagcgctggatctggcgaagtcgacaacttcaccatgggggtgctgtgcctcgccatcctgtttgaggaagttatgcggggaaagttcggcaagaaacatatgattgccggcgtgttctttacattcgtccttctgctcagcgggcagatcacctggcgcgatatggctcacacactgattatgatcggatccaatgccagcgacagaatgggcatgggggtgacctacctggcgcttattgctacgtttaagatccagcccttcctggccctcggatttttcctgcggaaactcacatctagagagaacctgcttctgggcgtggggctcgccatggctaccacactgcaactgcctgaagatatcgagcagatggccaatggaattgctcttggcctgatggccctcaagctgatcacccagtttgagacctatcagctctggacagcgctgatttcccttacgtgtagcaacaccatcttcacactgaccgtcgcctggcgcacagctaccctcattctggccggcgtttccctgcttccggtgtgccaatctagctccatgcggaaaacggactggctgcccatgacagtggctgccatgggggtccctcccctccctctgtttatcttctctctcaaggataccctgaagagacgcagctggccccttaatgaaggagtgatggccgttggcctggtgtccatcctggcttctagcctcctgagaaacgacgtccctatggcggggccccttgtggccggaggcctgctcattgcttgttacgttatcaccgggacatccgccgatctgaccgtggagaaagccgctgacgtcacatgggaagaggaagccgagcagacgggagtgagccataacctcatgattaccgtcgacgatgacggcacaatgcggatcaaggatgacgagaccgaaaatattctgacagtgcttctgaaaaccgcgctgctcatcgtttctggcatctttccgtactccattcctgctacgctgcttgtgtggcacacctggcagaagcagacacaacgcagcggggtcctgtgggatgtgccctctcctcccgagacccagaaagccgaactcgaggagggagtttatagaatcaagcagcagggcattttcgggaaaacacaagtgggagtcggcgtgcagaaggaaggggtgtttcataccatgtggcacgttacacggggagccgtcctgacgtacaacggcaagcgcctcgagccgaattgggcttccgtgaaaaaggacctgatcagctatggcgggggatggagactttctgcccagtggcaaaaaggcgaagaggtgcaggtcattgcggtggaacctgggaagaaccccaaaaatttccagaccatgcctggaacattccagaccaccacaggcgagatcggggctattgccctggattttaagcccggaacgtccggcagccccatcatcaaccgggagggcaaggttgtggggctgtacggaaatggcgtcgtgaccaaaaacgggggatatgtttccggcattgcccaaacaaatgctgaacctgacgggccgacccccgagctcgaagaggaaatgttcaagaaacgcaacctgacaatcatggatcttcaccctggcagcggaaagaccagaaaatacctgcccgccattgtgcgggaggctatcaagcgcagactccggacgctgattctcgcccctacaagagtcgtggcggccgagatggaagaggctctgaagggccttcccatccgctatcagaccaccgccacaaaatctgaacataccgggcgggagatcgttgacctgatgtgccacgctacatttaccatgagactgctcagccctgtgcgcgtcccgaattacaacctgattatcatggatgaagcccatttcacggaccccgcctccattgctgcgcggggatacatctctacaagagtgggcatgggggaggccgctgccatttttatgaccgccacacctcccggaaccgctgatgccttccctcagagcaatgcgcccatccaggacgaggaacgcgacatcccggagcggtcctggaactctggcaatgaatggattacggattttgctgggaagaccgtgtggttcgtccctagcatcaaagccggcaacgacattgccaactgtcttagaaagaatggcaaaaaggttatccaactgtcccgcaagacatttgataccgagtatcagaaaacaaagctcaacgactgggatttcgtggtgaccacagacatttctgagatgggagctaattttaaagccgatcgggtcatcgaccccagacggtgcctgaagcccgtgattctgaccgatgggcctgaacgcgttatcctcgcgggacccatgcctgtgacggccgctagcgccgctcagagacggggccgcgtcgggagaaacccgcagaaagagaatgaccaatacatcttcacaggacagccccttaacaatgatgaagaccacgcccattggaccgaggctaagatgctgctggacaacattaatacccctgaaggcatcattcccgccctcttcgagcctgagcgggaaaagtccgcggccatcgatggggagtatagactgaaaggcgaaagccgcaagacatttgtggagcttatgcggagaggagacctgcccgtttggctcgctcacaaagtggcctctgaaggcattaagtacaccgatcgcaaatggtgcttcgacgggcagcggaacaatcagatcctggaggagaacatggatgtcgaaatctggacaaaggagggagagaagaagaagctgagaccgcgctggctcgacgctcggacgtattccgatcctcttgccctgaaagagtttaaggacttcgccgctggcagaaaaagcattgcgctggatctcgtgaccgaaatcgggcgcgtcccctctcacctggcccatagaacacggaatgctcttgacaacctggtgatgctccacacctccgagcatggaggcaaggcctaccgccacgccgttgaggaactgcctgagacaatggaaaccctgctccttctgggcctgatgattctcctgacagggggagctatgctttttctgatcagcggcaaagggattggaaagacctccatcggcctcatctgtgtgattgcctctagcgggatgctgtggatggcggagatccccctgcaatggattgcctccgctatcgtgctcgagttctttatgatggtccttctgattcctgaacccgagaagcagagaacaccgcaggataatcaactggcctatgttgtgatcggcattctcaccctggctgccatcatcgcggccaacgaaatgggccttctggagacaaccaaacgggacctcggcatgagcaaggaacctggggtggtctctcccacgtcctacctggatgtggacctgcaccccgctagcgcctggacactctacgctgttgccaccacagtgattacccctatgcttcgccataccatcgaaaattctacagctaacgtcagcctggccgcgattgccaaccaggctgtggtcctgatgggactcgacaaaggctggccgatctccaagatggatctgggggtgccccttctggccctcggatgctattctcaggttaatcctctgacgctgaccgctgccgtgctccttctgattacacactacgccatcatcggccccgggctgcaggcgaaagctaccagagaggcccaaaagcggacagctgccggaattatgaagaaccctaccgtcgacggcatcatgacgattgatctcgaccccgtgatctatgatagcaaattcgagaagcagctgggccaggttatgcttctggtgctctgtgccgtccagctgctgctcatgagaacatcctgggctctttgcgaggccctgaccctggcgaccgggcctattacaaccctctgggaaggatctccgggcaaattttggaatacaacgatcgccgtgagcatggctaacatcttccgcgggtcctacctggccggagctggccttgcctttagcattatgaagtctgtggggaccggaaaacggggcacaggctcccaaggggagaccctgggagaaaagtggaagaaaaagctcaatcagctgagcagaaaagagttcgacctgtataagaaatccggcatcacagaggttgatcgcaccgaagcgaaggaggggctcaaacggggagaaattacgcatcacgccgtctctagaggcagcgctaaacttcagtggtttgtggagcggaacatggtgatccccgaagggcgcgtcattgacctgggatgtggcagaggcgggtggtcctactattgcgccggactgaagaaagttaccgaggtgcggggctacacaaaagggggacctggccatgaggaacccgtgcctatgtctacctacgggtggaatgtcgtgaaactcatgagcggaaaggatgttttctatctgcccccggagaaatgtgacacacttctgtgcgatatcggcgaatccagcccttctcccaccgtggaggagtcccgcacaattagagtcctcaagatggtggaaccctggctgaagaacaatcagttctgtatcaaagttctgaacccttacatgcccaccgtgatcgagcacctcgaacggcttcaacgcaagcacggcgggatgctggtcagaaatcctctgagccggaactctacgcatgagatgtattggatttccaatggaacaggcaacatcgtggctagcgtgaatatggtctctcgcctcctgcttaacagatttaccatgacccaccggagaccgacaattgaaaaagacgttgatctgggggccggaacgcgccatgtgaacgctgagcccgagacccctaatatggacgtgatcggcgaacggattaagagaatcaaagaggaacacaacagcacatggcactacgacgatgagaatccctataagacctgggcctaccatgggtcctatgaagtcaaggcgacaggatctgccagctccatgatcaacggcgtggttaaactcctgaccaagccttgggacgtggtccccatggtgacacagatggctatgaccgatacgaccccgttcggccagcaacgcgtttttaaagagaaggtggacacacggacccctagaagcatgcccgggacacgccgggtcatgggaattaccgccgagtggctgtggagaacgctcggccgcaataaaaagcctcggctgtgcacaagagaagagttcaccaagaaagtgcgcacaaacgctgccatgggggccgtttttaccgaagagaatcagtgggattccgcgaaggctgccgtggaagacgaggatttctggaaacttgtcgaccgggagagagaactgcacaagctcggaaaatgtggctcttgcgtgtacaacatgatggggaagcgcgagaaaaagctgggcgaatttggaaaggccaaaggcagcagagctatctggtacatgtggcttggggcccggtatctggagttcgaggctctcggatttctgaatgaagatcattggttctcccgcgagaactcttacagcggcgtcgaaggggagggactgcacaagctcggctatattctgagagacatctccaaaattcccgggggcgccatgtacgcggatgacacggccggatgggacacccggatcacagaagatgaccttcataatgaggagaagatcacccagcagatggatcctgaacacagacaactggctaacgccatttttaaactcacatatcagaataaggtggttaaggtgcagcggcccaccccgacaggcaccgtcatggacatcatttctcgcaaagatcagagagggagcggacaagtgggcacgtacgggctgaacacattcaccaatatggaggctcagcttatccggcagatggaaggagagggcgtgctgtccaaggccgacctcgaaaaccctcatctgcccgagaaaaagattacccagtggctggagacaaaaggggttgaacgcctcaagagaatggcgatcagcggcgatgactgcgtggtcaagcccatcgatgaccggtttgccaacgctctgcttgccctgaatgatatgggaaaagtgcgcaaggacattcctcaatggcagccgtctaaaggctggcatgattggcagcaggttcccttctgttcccaccatttccacgagctcatcatgaaggacgggagaaaactggtggtcccttgccggccccaagacgaacttattggacgcgctagaatcagccagggcgccgggtggtctctgcgggagaccgcttgtctcggaaaggcctatgcgcagatgtggtccctgatgtactttcaccgcagagatctgcggctcgccagcaacgctatttgctctgccgtgcctgtccattgggtgcccacatcccgcacgacctggagcatccacgcccatcaccaatggatgacaaccgaagacatgctgacagtttggaatagagtgtggattgaggataacccttggatggaggacaagacccccgtcacgacctgggaaaatgtgccgtaccttggcaaacgggaggatcagtggtgtgggtccctgatcggcctcacaagcagagctacctgggcccagaacatccctacagcgattcagcaagttcgctctctgatcggaaatgaagagttccttgactatatgcccagcatgaagcggtttagaaaagaggaagagtccgaaggcgctatttggtga

SEQ ID NO: 20750 - RNA, 9873 nt, synthetic construct
  misc_feature 1..9873: note = derived and/or modified CDS sequence (opt5) from DENV-3__KF955451__SS-prME
  source 1..9873: mol_type = other RNA
accagcctgtgcctcatgatgatcctgcccgccgctcttgccttccacctgacatcccgggacggcgagcctcggatgattgtggggaagaatgaacgcggaaagtctctcctgtttaagacggcgagcggcatcaatatgtgtacccttattgctatggatctgggggaaatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattggggttggcgataacgccctgaaaatcaattggtataagaagggatctagcatcggcaaaatgtttgaagccacggctagaggggccagacgcatggctattcttggagacacagcctgggatttcggctccgtcgggggagtgctcaacagcctgggcaagatggtgcaccagatctttgggtctgcgtacaccgccctgttctccggcgtcagctgggtgatgaaaattggaatcggcgttctcctgacctggattgggcttaattctaagaacacaagcatgtccttttcttgcatcgctattggaatcatcaccctgtatctcggcgtggtcgtgcaggccgacatggggtgtgttattaattggaaaggaaaggagctgaagtgcggcagcgggatcttcgtgacaaacgaggtccatacgtggaccgaacagtacaaatttcaagctgattcccccaagcggctggccacagcgattgccggcgcttgggagaatggagtgtgtggcatcagaagcaccacacgcatggaaaaccttctctggaaacagattgccaatgagctgaactatatcctgtgggaaaataacatcaagctcaccgttgtggtcggggacattatcggagtgctggagcagggcaaacggacgcttacccctcagcccatggagctgaagtactcttggaaaacatgggggaaggctaagattgtgaccgccgaaacacaaaactccagcttcatcattgatggacctaatacccccgagtgcccgtctgcctccagagcttggaacgtctgggaagttgaggactatggctttggcgtgttcacaaccaatatctggctcaaactgcgcgaagtgtacacgcagctgtgtgaccaccggcttatgagcgcggccgtcaaggatgagagagctgtgcacgccgacatggggtactggatcgagtcccagaaaaacggatcttggaagctcgaaaaagccagcctgattgaggttaagacatgcacctggcctaagtcccataccctgtggtctaatggcgtgctcgaaagcgatatgatcattcccaaatccctggctgggcctatcagccagcacaactatcgccccggataccatacacaaaccgccggcccttggcaccttgggaagctggagctcgactttaattattgcgagggaacgacagtcgtgattaccgaaaactgtggcacacggggcccctctctgagaaccacaaccgtttccgggaaactgatccacgagtggtgctgtcgcagctgcacgcttccgcctctccggtacatgggagaagatggctgttggtatgggatggagatcagacccatttctgaaaaggaggagaatatggtgaaatccctggtcagcgcgggatctggcgaagtggacaacttcaccatgggggttctgtgcctcgctatcctgtttgaggaagtgatgcggggaaagttcggcaagaaacatatgattgccggcgtcttctttacattcgtgcttctgctcagcgggcagatcacctggcgcgatatggcccacacactgattatgatcggatccaatgctagcgacagaatgggcatgggggtgacctacctggcccttattgcgacgtttaagatccagcccttcctggctctcggatttttcctgcggaaactcacatctagagagaacctgcttctgggcgtcgggctcgccatggccaccacactgcaactgcctgaagatgttgagcagatggctaatggaatcgcccttggcctgatggctctcaagctgattacccagtttgagacctatcagctctggacagccctgatctcccttacgtgtagcaacaccattttcacactgaccgtggcgtggcgcacagccaccctcatcctggctggcgtgtccctgcttccggtctgccaatctagctccatgcggaaaacggactggctgcccatgacagtggccgctatgggggttcctcccctccctctgtttattttctctctcaaggataccctgaagagacgcagctggccccttaatgaaggagtgatggccgtcggcctggtgtccatcctggcctctagcctcctgagaaacgacgttcctatggctgggccccttgtggcgggaggcctgctcatcgcctgttacgtcattaccgggacatccgctgatctgaccgtggagaaagccgccgacgtcacatgggaagaggaagctgagcagacgggagtgagccataacctcatgatcaccgttgacgatgacggcacaatgcggattaaggatgacgagaccgaaaatatcctgacagtgcttctgaaaaccgccctgctcattgtctctggcatctttccgtactccatccctgcgacgctgcttgtgtggcacacctggcagaagcagacacaacgcagcggggttctgtgggatgtgccctctcctcccgagacccagaaagctgaactcgaggagggagtctatagaattaagcagcagggcatcttcgggaaaacacaagtgggagtgggcgttcagaaggaaggggtctttcataccatgtggcacgtgacacggggagccgtgctgacgtacaacggcaagcgcctcgagccgaattgggcctccgtcaaaaaggacctgattagctatggcgggggatggagacttaacgctcagtggcaaaaaggcgaagaggtgcaggttatcgccgtggaacctgggaagaatcccaaaaacttccagaccatgcctggaacattccagaccaccacaggcgagattggggcgatcgctctggattttaagcccggaacgtctggctcccccattatcaatcgggagggcaaggtcgtggggctgtacggaaacggcgttgtgaccaaaaatgggggatatgtcagcggcatcgcccaaacaaacgccgaacctgacgggccgacccccgagctcgaagaggaaatgttcaagaaacgcaatctgacaattatggatcttcaccctggctccggaaagaccagaaaatacctgcccgctatcgtgcgggaggccattaagcgcagactccggacgctgatcctcgctcctacaagagttgtggccgcggagatggaagaggccctgaagggccttcccattcgctatcagaccaccgctacaaaaagcgaacataccgggcgggagatcgtcgacctgatgtgccacgccacatttaccatgagactgctctctcctgtgcgcgtgccgaactacaatctgatcattatggatgaagctcatttcacggaccccgccagcatcgccgctcggggatacatttccacaagagtcggcatgggggaggcggccgctatctttatgaccgccacacctcccggaaccgccgatgctttccctcagtctaacgcccccattcaggacgaggaacgcgacatcccggagcggagctggaactccggcaacgaatggatcacggattttgcggggaagaccgtttggttcgtgccttctattaaagctggcaacgacatcgccaattgtcttagaaagaacggcaaaaaggtgattcaactgagccgcaagacatttgataccgagtatcagaaaacaaagctcaatgactgggatttcgtcgtgaccacagacatctccgagatgggagccaactttaaagctgatcgggttattgaccccagacggtgcctgaagcccgtgatcctgaccgatgggcctgaacgcgtcattctcgccggacccatgcctgtgacggcggcctctgctgcccagagacggggccgcgttgggagaaatccgcagaaagagaacgaccaatacatcttcacaggacagccccttaataacgatgaagaccacgctcattggaccgaggccaagatgctgctggacaatatcaacacccctgaaggcattatccccgctctcttcgagcctgagcgggaaaagagcgccgcgattgatggggagtatagactgaaaggcgaatcccgcaagacatttgtggagcttatgcggagaggagacctgcccgtctggctcgcccacaaagtggctagcgaaggcatcaagtacaccgatcgcaaatggtgcttcgacgggcagcggaataaccagattctggaggagaatatggatgtcgaaatctggacaaaggagggagagaagaaaaagctgagaccgcgctggctcgacgcccggacgtattctgatcctcttgctctgaaagagtttaaggacttcgccgccggcagaaaatccatcgctctggatctcgtgaccgaaattgggcgcgttcccacacacctggcgcatagaacccggagcgcccttgacaacctggtgatgctccacacatctgagcatggaggcaaggcttaccgccacgccgtggaggaactgcctgagaccatggaaacgctgctccttctgggcctgatgatcctcctgaccgggggagccatgctttttctgatttccggcaaagggatcggaaagacaagcattggcctcatctgtgtcatcgcttcctctgggatgctgtggatggccgagattcccctgcaatggatcgcgagcgccattgttctcgagttctttatgatggtgcttctgatccctgaacccgagaagcagagaaccccgcaggataatcaactggcttatgtggtcattggaatcctcacactggccgctattatcgccgcgaacgaaatgggccttctggagaccacgaaacgggacctcggcatgtccaaggaacctggggtggttagccccacatcttacctggatgtggacctgcaccccgcctccgcttggaccctctacgccgtcgctacaaccgtgatcacccctatgcttcgccatacaattgagaatagcacggccaacgtctctctggctgccatcgcgaaccaggccgtggttctgatgggactcgacaaaggctggccgattagcaagatggatctgggggtgccccttctggctctcggatgctattcccaggtcaatcctctgaccctgacagccgctgtgctccttctgatcacccactacgccattatcggccccgggctgcaggccaaagcgacaagagaggctcaaaagcggaccgccgctggaatcatgaagaaccctacggttgacggcattatgacaatcgatctcgaccccgtgatttatgattctaaattcgaaaagcagctgggccaggtcatgcttctggtgctctgtgccgtgcagctgctgctcatgagaaccagctgggccctttgcgaggctctgaccctggccacagggcctatcaccacactctgggaaggatccccgggcaaattttggaatacgaccattgcggtttctatggccaacatcttccgcgggagctacctggctggagccggccttgctttttccatcatgaaaagcgtcgggacaggaaaacggggcaccggctctcaaggggagacactgggagaaaagtggaagagaaaactcaatcagctgtcccgcaaggagttcgacctgtataaaaagagcggcattaccgaggtggatcggacggaagccaaagaggggctcaagagaggagaaatcacccatcacgcggtgtcccggggctctgccaaacttcagtggtttgtcgagcgcaacatggttattcccgaagggagagtgatcgacctgggatgtggccggggcgggtggagctactattgcgctggactgaagaaggtgacagaggtccgcggctacaccaaagggggacctggccatgaggaacccgtgcctatgtccacatacgggtggaatattgttaagctcatgtctggaaaagatgtgttctatctgcccccggagaagtgtgacacccttctgtgcgatatcggcgaaagctcccctagccccacagtcgaggagtctagaaccattcgggtgctcaaaatggttgaaccctggctgaagaacaatcagttctgtatcaaggtgctgaacccttacatgcccacggtcatcgagcacctcgaacgccttcaaagaaaacacggcgggatgctggtgcggaatcctctgtcccgcaacagcacacatgagatgtattggatttctaatggaaccggcaacatcgtggcctccgtcaatatggttagcagactcctgcttaaccggtttaccatgacacacagacgcccgacgattgaaaaggacgtggatctgggggctggaacccggcatgtgaacgccgagcccgagacacctaatatggacgtcatcggcgaaagaattaaacgcatcaaggaggaacacaactctacctggcactacgacgatgagaatccctataaaacatgggcttaccatgggagctatgaagtgaaggccaccggatccgcgtctagcatgatcaacggcgttgtgaagctcctgacaaaaccttgggacgtcgtgcccatggttacccagatggccatgacggataccacaccgttcggccagcaacgggtgtttaaggagaaagtcgacaccagaacacctcgccccatgcctgggacccggagagtgatgggaattacggctgagtggctgtggcgcacactcggccggaataagaaacccagactgtgcacccgcgaagagttcacaaagaaggttcggaccaacgccgctatgggggccgtgtttacggaagagaatcagtgggattccgccaaagcggctgtcgaagacgaggatttctggaaacttgtggacagagagcgcgaactgcacaaactcggaaagtgtggcagctgcgtctacaacatgatggggaaaagagagaagaaactgggcgaatttggaaaggccaagggctcccgggccatctggtacatgtggcttggggctcgctatctggagttcgaggccctcggatttctgaatgaagatcattggttctctagagagaacagctactccggcgtggaaggggagggactgcacaaactcggctatattctgcgggacatctctaagattcctgggggcgctatgtacgccgatgacaccgcgggatgggacacaagaatcaccgaagatgaccttcataatgaggagaaaatcacacagcagatggatcccgaacaccggcaactggccaacgctatttttaagctcacctatcagaataaagttgtgaaggtccagcgcccgacacctaccggcacggtgatggacatcattagcagaaaggatcagcgggggtccggacaagtgggcacatacgggctgaacaccttcaccaatatggaggcccagcttatccgccagatggaaggagagggcgttctgtctaaagctgacctcgaaaacccccacctgagcgagaagaaaattacacagtggctggagaccaagggggtggaaagactcaaacggatggccatctccggcgatgactgcgtcgtgaagcccatcgatgaccgctttgcgaacgccctgcttgctctgaatgatatgggaaaggttagaaaagacattcctcaatggcagccgagcaagggctggcatgattggcaacaggtgcccttctgttctcaccatttccacgagctcatcatgaaagacgggcggaagctggtcgtgccttgccgcccccaagacgaacttattggacgggcccggatctcccagggcgctgggtggagcctgcgcgagacagcctgtctcggaaaggcttatgcccagatgtggtctctgatgtactttcacagacgggatctgcgcctcgcgtccaacgccatttgcagcgctgtccctgtgcattgggttcccacgtctagaaccacatggtccatccacgcccatcaccaatggatgaccacagaagacatgctgaccgtgtggaatcgggtctggattgaggataacccttggatggaggacaagacgcccgtgaccacatgggaaaatgttccgtaccttggcaagagagaggatcagtggtgtgggagcctgatcggcctcacctcccgcgccacatgggctcagaacatccctaccgccattcagcaagtgcggagcctgatcggaaatgaagagttccttgactatatgccctctatgaaaagatttcgcaaggaggaagagagcgaaggcgcgatttggtga

SEQ ID NO: 20751 - RNA, 9873 nt, synthetic construct
  misc_feature 1..9873: note = derived and/or modified CDS sequence (opt5) from DENV-3__KF955453__SS-prME
  source 1..9873: mol_type = other RNA
acaagcctctgcctcatgatgatcctgcccgccacacttgctttccacctgacgtcccgggacggcgaacctcggatgattgtggggaagaatgaacgcggaaaatctctcctgtttaagaccgccagcggcatcaatatgtgtacacttattgcgatggatctgggggagatgtgcgacgataccgtgacatacaaatgtccgcatatcaccgaagttgagcccgaagacattgattgctggtgtaacctcacatccacctgggtgacgtatggaacctgcaatcaggctggcgagcaccggcgggacaagcgctctgtggccctggcccctcatgtcgggatgggactggatacaagaacccagacatggatgagcgctgagggcgcctggagacaggtggaaaaagttgagacctgggctctccgccaccccggcttcacgatcctggccctttttctggcgcattacatcgggacatccctcacccagaaggtggtcattttcatcctgcttatgctggtgacaccttctatgaccatgagatgtgttggagtgggcaaccgggactttgtcgaagggctcagcggagccacctgggtggatgtggtcctggagcacggcgggtgcgttacaacgatggctaagaataaacccaccctggacattgagctccagaagacagaagccacccagctggctacacttcgcaaactgtgtatcgagggaaagattaccaacatcacgacagattccagatgccctacccagggcgaagccgtgctcccggaggaacaggaccagaattatgtgtgtaaacacacctacgtcgatcggggctgggggaacggatgcggcctgttcgggaagggaagccttgtgacatgcgcgaagtttcaatgtctggagcccattgagggcaaagttgtgcagtatgaaaatctcaagtacaccgtcatcatcacagtgcatacgggggaccagcaccaggttggaaacgagacccaaggcgtgacagccgaaattacccctcaggcttctacaaccgaggccacgctgcccgaatatggcaccctggggctcgagtgctcccctcgcacaggactggacttcaatgagatgatccttctgaccatgaaaaacaaggcttggatggtccatagacagtggtttttcgatctccccctgccgtggacaagcggcgccaccacggaaacacctacctggaatcggaaagagcttctggtgacatttaagaacgcccacgctaaaaagcaagaagtcgtggttctcgggtctcaggagggagcgatgcacaccgccctgaccggcgctacagaaattcaaaattccgggggcacgagcatcttcgccggacatctgaagtgtcgcctcaaaatggacaagctggagcttaaaggcatgtcttacgccatgtgcaccaacacatttgtgctgaagaaagaggtctccgaaacccagcacgggacaattctcatcaaggtggagtacaagggagaagatgttccctgtaaaatccctttcagcaccgaggacggccaagggaaggctcataacggaagactgattacggccaatcccgtggtcaccaagaaggaggaacccgtgaacatcgaggcggaacctccgttcggcgagtccaatattgtgatcgggattggcgataacgctctgaaaatcaattggtataagaagggatctagcatcggcaaaatgtttgaagccaccgccagaggggctagacgcatggccattcttggagacaccgcttgggatttcggctccgttgggggagtcctcaacagcctgggcaagatggtgcaccagatctttgggtctgcctacacagcgctgttctccggcgtgagctgggtcatgaaaattggaatcggcgtgctcctgacctggattgggcttaattctaagaacacaagcatgtccttttcttgcatcgccattggaatcatcacgctgtatctcggcgctgttgtgcaggccgacatggggtgtgtcattaattggaaaggaaaggagctgaagtgcggcagcgggatcttcgtgaccaacgaggttcatacatggaccgaacagtacaaatttcaagctgattcccccaagcggctggccacagcgattgccggcgcttgggagaatggagtgtgtggcatcagaagcaccacgcgcatggaaaaccttctctggaaacagattgccaatgagctgaactatatcctgtgggaaaataacatcaagctcaccgtcgtggttggggacattatcggagtgctggagcagggcaaacggacacttacccctcagcccatggagctgaagtactcttggaaaacatgggggaaggctaagattgtcaccgccgaaacacaaaactccagcttcatcattgatggacctaatacccccgagtgcccgtctgcctccagagcttggaacgtgtgggaagtggaggactatggctttggcgtcttcacgacaaatatctggctcaaactgcgcgaagtttacacccagctgtgtgaccaccggcttatgagcgcggccgtgaaggatgagagagctgtgcacgccgacatggggtactggatcgagtcccagaaaaacggatcttggaagctcgaaaaagccagcctgattgaggtcaagacctgcacatggcctaagtcccataccctgtggtctaatggcgtgctcgaaagcgatatgatcattcccaaatccctggctgggcctatcagccagcacaactatcgccccggataccatacgcaaacagccggcccttggcaccttgggaagctggagctcgactttaattattgcgagggaaccacagttgtgattaccgaaaactgtggcacacggggcccctctctgagaaccacgaccgtctccgggaaactgatccacgagtggtgctgtcgcagctgcacacttccgcctctccggtacatgggagaagatggctgttggtatgggatggagatcagacccatttctgaaaaggaggagaatatggtgaaatccctggttagcgcgggatctggcgaagtggacaacttcaccatgggggtcctgtgcctcgctatcctgtttgaggaagtgatgcggggaaagttcggcaagaaacatatgattgccggcgttttctttacattcgtgcttctgctcagcgggcagatcacctggcgcgatatggcccacacgctgattatgatcggatccaatgctagcgacagaatgggcatgggggtcacatacctggcccttattgcgacctttaagatccagcccttcctggctctcggatttttcctgcggaaactcacatctagagagaacctgcttctgggcgtggggctcgccatggccaccaccctgcaactgcctgaagatatcgagcagatggctaatggaattgcccttggcctgatggctctcaagctgatcacacagtttgagacgtatcagctctggaccgccctgatttcccttacatgtagcaacaccatcttcacactgaccgtggcgtggcgcacggccacactcattctggctggcgtctccctgcttccggtttgccaatctagctccatgcggaaaaccgactggctgcccatgaccgtggccgctatgggggtgcctcccctccctctgtttatcttcaatctcaaggatacactgaagagacgctcttggccccttaacgaaggagtcatggccgtgggcctggttagcatcctggcctcctctctcctgagaaacgacgtgcctatggctgggccccttgtcgcgggaggcctgctcattgcctgttacgtgatcaccgggacaagcgctgatctgacggttgagaaagccgccgacgtgacctgggaagaggaagctgagcagacaggagtctcccataatctcatgattaccgtggacgatgacggcacaatgcggatcaaggatgacgagaccgaaaacattctgacggtccttctgaaaaccgccctgctcatcgtgagcggcatctttccgtactctattcctgcgacactgcttgtttggcacacctggcagaagcagacacaacgctccggggtgctgtgggatgtccccagccctcccgagacccagaaagctgaactcgaggagggagtgtatagaatcaagcagcagggcattttcgggaaaacacaagttggagtgggcgtccagaaggaaggggtgtttcatacgatgtggcacgtgacccggggagccgttctgacatacaatggcaagcgcctcgagccgaactgggcctctgtcaaaaaggacctgatctcctatggcgggggatggagacttagcgctcagtggcaaaaaggcgaagaggtccaggtgattgccgtcgaacctgggaagaatcccaaaaacttccagaccatgcctggaaccttccagacaacgaccggcgagatcggggcgattgctctggattttaagcccggaacatctggctcccccatcatcaatcgggagggcaagattgtggggctgtacggaaacggcgttgtgaccaaaaatgggggatatgtcagcggcatcgcccaaacaaacgccgaacctgacgggccgacccccgagctcgaagaggaaatgttcaagaaacgcaatctgacgattatggatcttcaccctggctccggaaagacaagaaaatacctgcccgctatcgtgcgggaggccattaagcgcagactccggaccctgatcctcgctcctaccagagttgtggccgcggagatggaagaggccctgaagggccttcccatccgctatcagacaaccgctacaaaaagcgaacataccgggcgggagattgtcgacctgatgtgccacgccacgtttacaatgagactgctctctcctgtgcgcgttccgaactacaatctgatcattatggatgaagctcatttcaccgaccccgccagcatcgccgctcggggatacatttccacaagagtgggcatgggggaggcggccgctatctttatgaccgccacgcctcccggaaccgccgatgctttccctcagtctaacgcccccatccaggacgaggaacgcgacattccggagcggagctggaactccggcaacgaatggatcacagattttgcggggaagaccgtctggttcgtgccttctattaaagctggcaacgacatcgccaattgtcttagaaagaacggcaaaaaggtgattcaactgagccgcaagacatttgataccgagtatcagaaaacaaagctcaatgactgggatttcgtcgttaccacggacatctccgagatgggagccaactttaaagctgatcgggtgattgaccccagacggtgcctgaagcccgtgatcctgacagatgggcctgaacgcgtcatcctcgccggacccatgcctgtgaccgcggcctctgctgcccagagacggggccgcgttgggagaaatccgcagaaagagaacgaccaatacattttcaccggacagccccttaataacgatgaagaccacgctcattggacagaggccaagatgctgctggacaatatcaacacccctgaaggcattatccccgctctcttcgagcctgagcgggaaaagagcgccgcgattgatggggagtatagactgaaaggcgaatcccgcaagacatttgtggagcttatgcggagaggagacctgcccgtctggctcgcccacaaagtggctagcgaaggcatcaagtacacggatcgcaaatggtgcttcgacgggcagcggaataaccagatcctggaggagaatatggatgttgaaatttggaccaaggagggagagaagaagaagctgagaccgcgctggctcgacgcccggacatattctgatcctcttgctctgaaagagtttaaggacttcgccgccggcagaaaatccatcgctctggatctcgtgaccgaaattgggcgcgtccccacacacctggcgcatagaacccggaacgcccttgacaatctggtgatgctccacacgagcgagcatggaggcaaggcttaccgccacgccgtcgaggaactgcctgagaccatggaaacactgctccttctgggcctgatgatctctctcaccgggggagccatgctgtttcttatttccggcaaagggatcggaaagacaagcatcggcctgatttgtgtgatcgcttcctctgggatgctctggatggccgagattcccctgcaatggatcgcgagcgccattgttctggagttctttatgatggtgctccttatccctgaacccgagaagcagagaaccccgcaggataaccaactggcttatgtggtcattggaatcctgacgctcgccgctatcattgccgcgaatgaaatgggcctgcttgagacaaccaaacgggacctgggcatgtccaaggaacctggggttgtgagccccacatcttacctcgatgtggacctgcaccccgcctccgcttggaccctgtacgccgtcgctaccacagtgatcacgcctatgctccgccataccattgagaacagcacagccaacgtttctcttgctgccatcgcgaatcaggccgtggtcctgatgggactggacaaaggctggccgattagcaagatggatctcggggtgcccctgcttgctctgggatgctattcccaggtcaaccctctcaccctgacagccgctgtgctgctccttatcacccactacgccatcattggccccgggctgcaggccaaagcgacgagagaggctcaaaagcggacagccgctggaatcatgaagaatcctaccgttgacggcattatgaccatcgatctggaccccgtgatttatgattctaaattcgaaaagcagctcggccaggtcatgctgcttgtgctgtgtgccgttcagctcctgctgatgagaacaagctgggccctctgcgaggctcttaccctggccacagggcctatcacgaccctgtgggaaggatccccgggcaaattttggaacacaaccatcgcggtgtctatggccaatattttccgcgggagctacctcgctggagccggcctggctttttccatcatgaaaagcgtcgggacaggaaaacggggcaccggctctcaaggggagacgcttggagaaaagtggaagaaaaagctgaaccagctctccagaaaagagttcgacctgtataagaaaagcggcattaccgaggtggatcgcacagaagccaaggaggggctgaaacggggagaaatcacccatcacgcggtgtccagaggctctgccaagctccagtggtttgttgagcggaatatggtcattcccgaagggcgcgtgatcgaccttggatgtggcagaggcgggtggagctactattgcgctggactgaagaaagtgacagaggtccggggctacaccaaagggggacctggccatgaggaacccgttcctatgtccacatacgggtggaacattgtgaaactgatgtctggaaaggatgtgttctatctgcccccggagaaatgtgacaccctgctttgcgatatcggcgaaagctcccctagccccacggtcgaggagtctcgcacaatcagagtgctgaagatggttgaaccctggctcaagaataaccagttctgtattaaagtgctgaatccttacatgcccaccgtcatcgagcacctggaacggctccaacgcaagcacggcgggatgcttgtgagaaaccctctgtcccggaatagcacccatgagatgtattggatttctaacggaacaggcaatatcgttgcctccgtgaacatggtcagccgcctgctcctgaacagatttacgatgacccaccggagaccgacaattgaaaaagacgtggatcttggggctggaacccgccatgtgaatgccgagcccgagacacctaacatggacgtcatcggcgaacggatcaagagaattaaagaggaacacaattctacctggcactacgacgatgagaacccctataagacatgggcttaccatgggagctatgaagttaaggccaccggatccgcgtctagcatgatcaatggcgtggtgaaactgctcacgaagccttgggacgtcgtgcccatggttacccagatggccatgacagataccacaccgttcggccagcaacgcgtgtttaaagagaaggtcgacacccggacgcctagatccatgcccgggacacgccgggtgatgggaattaccgctgagtggctgtggagaacactgggccgcaacaaaaagcctcggctctgcaccagagaagagttcacgaagaaagttcgcaccaatgccgctatgggggccgtgtttacagaagagaaccagtgggatagcgccaaggcggctgtcgaagacgaggatttctggaaactggtggaccgggagagagaacttcacaagctgggaaaatgtggctcctgcgtttacaatatgatggggaagcgcgagaaaaagctcggcgaatttggaaaggccaaaggctctagagccatctggtacatgtggctgggggctcggtatcttgagttcgaggccctgggatttctcaacgaagatcattggttcagccgcgaaaattcctactctggcgtggagggggagggactgcacaagctgggctatattctcagagacatcagcaaaatccccgggggcgctatgtacgccgatgacaccgcgggatgggacacacggattaccgaagatgacctgcataacgaggagaagatcacacagcagatggatcctgaacacagacaacttgccaatgctatttttaaactgacctatcagaacaaggtcgtgaaggtccagcggcccacgccgacaggcaccgtgatggacatcatttcccgcaaagatcagagagggtctggacaagttggcacctacgggctcaatacattcaccaacatggaggcccagctgatccggcagatggaaggagagggcgtgcttagcaaggctgacctggaaaaccctcacctccccgagaaaaagatcacacagtggctggagacgaaaggggtcgaacgcctgaagagaatggccatttccggcgatgactgcgtggtgaagcccatcgatgaccggtttgcgaatgccctcctggctcttaacgatatgggaaaagttcgcaaggacattcctcaatggcagccgagcaaaggctggcatgattggcaacaggtgcccttctgttctcaccatttccacgagctgatcatgaaggacgggagaaaactcgtcgtgccttgccggccccaagacgaactgattggacgcgccagaatctcccagggcgctgggtggagccttcgggagaccgcctgtctgggaaaggcttatgcccagatgtggtctctcatgtactttcaccgcagagatctgcggctggcgtccaatgccatttgcagcgctgttcctgtgcattgggtccccacatctcgcaccacatggtccatccacgcccatcaccaatggatgaccacggaagacatgctcaccgtgtggaacagagtctggatcgaggataatccttggatggaggacaagacacccgtgaccacatgggaaaacgttccgtacctgggcaaacgggaggatcagtggtgtgggagccttattggcctgacctccagagccacgtgggctcagaatatccctacagccattcagcaagtgcgcagcctcatcggaaacgaagagttcctggactatatgccctctatgaagcggtttagaaaagaggaagagagcgaaggcgcgatttggtga

SEQ ID NO: 20752 - RNA, 9873 nt, synthetic construct
  misc_feature 1..9873: note = derived and/or modified CDS sequence (opt5) from DENV-3__FJ373304__SS-prME
  source 1..9873: mol_type = other RNA
acaagcctgtgcctcatgatgatcctgcccgccgctcttgccttccacctgacatcccgggacggcgagcctcggatgattgtggggaagaacgaacgcggaaagtctctcctgtttaagacggcgagcggcatcaatatgtgtacccttattgctatggatctgggggaaatgtgcgacgatacagtcacctacaaatgtccgcacatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaaggtggtgcaccagatttttgggtctgcgtacaccgccctgttctccggcgtcagctgggtgatgaaaatcggaattggcgttctcctgacctggatcgggcttaattctaagaacacaagcatgtccttttcttgcattgctatcggaatcattaccctgtatctcggcgccgtggtccaggctgacatggggtgtgtgatcaattggaaaggaaaggagctgaagtgcggcagcgggattttcgttacaaacgaggtgcatacgtggaccgaacagtacaaatttcaagccgattcccccaagcggctggcgacagccatcgctggcgcctgggagaatggagtctgtggcattagaagcaccacacgcatggaaaaccttctctggaaacagatcgctaatgagctgaactatatcctgtgggaaaataacattaagctcaccgtggttgtgggggacacgatcggagtcctggagcagggcaaacggacccttacacctcagcccatggagctgaagtactcttggaaaacctgggggaaggccaagattgtgacagccgaaacccaaaactccagcttcatcattgatggacctaatacacccgagtgcccgtctgcttccagagcgtggaacgtgtgggaagtcgaggactatggctttggcgttttcaccacgaatatctggctcaaactgcgcgaagtgtacacacagctgtgtgaccaccggcttatgagcgccgctgtgaaggatgagagagccgtccacgccgacatggggtactggatcgagtcccagaaaaacggatcttggaagctcgaaaaagctagcctgattgaggtgaagacctgcacctggcctaagtcccatacactgtggtctaatggcgttctcgaaagcgatatgatcattcccaaatccctggccgggcctatcagccagcacaactatcgccccggataccatacccaaacggcgggcccttggcaccttgggaagctggagctcgactttaattattgcgagggaacaaccgtggtcattacagaaaactgtggcacccggggcccctctctgagaacaaccacggtgtccgggaaactgatccacgagtggtgctgtcgcagctgcacccttccgcctctccggtacatgggagaagatggctgttggtatgggatggagatcagacccatttctgaaaaggaggagaatatggttaaatccctggtgagcgctggatctggcgaagtcgacaacttcacaatgggggtgctgtgcctcgccatcctgtttgaggaagttatgcggggaaagttcggcaagaaacatatgattgccggcgtgttctttaccttcgtccttctgctcagcgggcagatcacatggcgcgatatggctcacaccctgattatgatcggatccaatgccagcgacagaatgggcatgggggtgacgtacctggcgcttattgctacatttaagatccagcccttcctggccctcggatttttcctgcggaaactcacctctagagagaacctgcttctgggcgtggggctcgccatggctacaaccctgcaactgcctgaagatatcgagcagatggccaatggaattgctcttggcctgatggccctcaagctgatcacccagtttgagacatatcagctctggacggcgctgatttcccttacctgtagcaacacaatcttcaccctgacagtcgcctggcgcaccgctacgctcattctggccggcgtttccctgcttccggtgtgccaatctagctccatgcggaaaacagactggctgcccatgaccgtggctgccatgggggtccctcccctccctctgtttatcttctctctcaaggataccctgaagagacgcagctggccccttaatgaaggagtgatggccgttggcctggtgtccatcctggcttctagcctcctgagaaacgacgtccctatggcggggccccttgtggccggaggcctgctcattgcttgttacgttatcacagggacctccgccgatctgacagtggagaaagccgctgacgtcacgtgggaagaggaagccgagcagaccggagtgagccataacctcatgattacagtcgacgatgacggcaccatgcggatcaaggatgacgagacagaaaatattctgaccgtgcttctgaaaacggcgctgctcatcgtttctggcatctttccgtactccattcctgctaccctgcttgtgtggcacacatggcagaagcagacccaacgcagcggggtcctgtgggatgtgccctctcctcccgagacacagaaagccgaactcgaggagggagtttatagaatcaagcagcagggcattttcgggaaaacccaagtgggagtcggcgtgcagaaggaaggggtgtttcatacaatgtggcacgttacgcggggagccgtcctgacctacaacggcaagcgcctcgagccgaattgggcttccgtgaaaaaggacctgatcagctatggcgggggatggagactttctgcccagtggcaaaaaggcgaagaggtgcaggtcattgcggtggaacctgggaagaaccccaaaaatttccagacaatgcctggaaccttccagaccacaacgggcgagatcggggctattgccctggattttaagcccggaacctccggcagccccatcatcaaccgggagggcaaggttgtggggctgtacggaaatggcgtcgtgaccaagaacgggggatatgtttccggcattgcccaaaccaatgctgaacctgacgggccgacacccgagctcgaagaggaaatgttcaagaaacgcaacctgaccatcatggatcttcaccctggcagcggaaagacgagaaaatacctgcccgccattgtgcgggaggctatcaagcgcagactccggacactgattctcgcccctaccagagtcgtggcggccgagatggaagaggctctgaagggccttcccatccgctatcagaccacagccaccaaatctgaacatacagggcgggagatcgttgacctgatgtgccacgctacctttacgatgagactgctcagccctgtgcgcgtcccgaattacaacctgattatcatggatgaagcccatttcacagaccccgcctccattgctgcgcggggatacatctctaccagagtgggcatgggggaggccgctgccatttttatgacagccacccctcccggaacggctgatgccttccctcagagcaatgcgcccatccaggacgaggaacgcgacatcccggagcggtcctggaactctggcaatgaatggattaccgattttgctgggaagacagtgtggttcgtccctagcatcaaagccggcaacgacattgccaactgtcttagaaagaatggcaaaaaggttatccaactgtcccgcaagacctttgatacagagtatcagaaaaccaagctcaacgactgggatttcgtggtgacaaccgacatttctgagatgggagctaattttaaagccgatcgggtcatcgaccccagacggtgcctgaagcccgtgattctgacggatgggcctgaacgcgttatcctcgcgggacccatgcctgtgacagccgctagcgccgctcagagacggggccgcgtcgggagaaacccgcagaaagagaatgaccaatacatcttcaccggacagccccttaacaatgatgaagaccacgcccattggaccgaggctaagatgctgctggacaacattaatacacctgaaggcatcattcccgccctcttcgagcctgagcgggaaaagtccgcggccatcgatggggagtatagactgaaaggcgaaagccgcaagacctttgtggagcttatgcggagaggagacctgcccgtttggctcgctcacaaagtggcctctgaaggcattaagtacacagatcgcaaatggtgcttcgacgggcagcggaacaatcagatcctggaggagaacatggatgtcgaaatctggacgaaggagggagagaagaagaagctgagaccgcgctggctcgacgctcggacctattccgatcctcttgccctgaaagagtttaaggacttcgccgctggcagaaaaagcattgcgctggatctcgtgacagaaatcgggcgcgtccccacccacctggcccatagaacacggaatgctcttgacaacctggtgatgctccacacctctgagcatggaggcaaggcctaccgccacgccgttgaggaactgcctgagacgatggaaaccctgctccttctgggcctgatgattctcctgacagggggagctatgctttttctgatctccggcaaagggattggaaagaccagcatcggcctcatctgtgtgattgcctcctctgggatgctgtggatggcggagatccccctgcaatggattgccagcgctatcattctcgagttctttatgatggtgcttctgatccctgaacccgagaagcagagaacaccgcaggataatcaactggcctatgtcgttattggaatcctcaccctggctgccatcattgcggccaacgaaatgggccttctggagacgacaaaacgggacctcggcatgtccaaggaacctggggtggtgagccccacctcttacctggatgtcgacctgcaccccgcttccgcctggacactctacgctgtggccaccaccgttatcacacctatgcttcgccatacgattgagaatagcaccgctaacgtgtctctggccgcgatcgccaaccaggctgtcgtgctgatgggactcgacaaaggctggccgattagcaagatggatctgggggtcccccttctggccctcggatgctattcccaggtgaatcctctgacactgaccgctgccgttctccttctgatcacacactacgccatcattggccccgggctgcaggcgaaagctaccagagaggcccaaaagcggacggctgccggaatcatgaagaaccctacagtggacggcattatgaccatcgatctcgaccccgtcatttatgattctaaattcgaaaagcagctgggccaggtgatgcttctggttctctgtgccgtgcagctgctgctcatgagaaccagctgggctctttgcgaggccctgacactggcgaccgggcctatcacaacgctctgggaaggatccccgggcaaattttggaataccacaatcgccgtctctatggctaacattttccgcgggagctacctggccggagctggccttgccttttccatcatgaaaagcgtggggaccggaaaacggggcacaggctctcaaggggagaccctgggagaaaagtggaagaaaaagctcaatcagctgtccagaaaagagttcgacctgtataagaaaagcggcattacggaggtggatcgcaccgaagcgaaggaggggctcaaacggggagaaatcacacatcacgccgtttccagaggctctgctaaacttcagtggtttgtcgagcggaacatggtgattcccgaagggcgcgtgatcgacctgggatgtggcagaggcgggtggagctactattgcgccggactgaagaaagtcaccgaggttcggggctacacaaaagggggacctggccatgaggaacccgtgcctatgtccacctacgggtggaatattgtgaaactcatgtctggaaaggatgtcttctatctgcccccggagaaatgtgacacacttctgtgcgatatcggcgaaagctcccctagccccaccgtggaggagtctcgcacgatcagagttctcaagatggtggaaccctggctgaagaacaatcagttctgtattaaagtcctgaacccttacatgcccacagtgatcgagcacctcgaacggcttcaacgcaagcacggcgggatgctggttagaaatcctctgtcccggaacagcacccatgagatgtattggatttctaatggaaccggcaacatcgtggcttccgtcaatatggtgagccgcctcctgcttaacagatttacaatgacgcaccggagaccgaccattgaaaaagacgtggatctgggggccggaacacgccatgtcaacgctgagcccgagacccctaatatggacgttatcggcgaacggatcaagagaattaaagaggaacacaactctacatggcactacgacgatgagaatccctataagacctgggcctaccatgggagctatgaagtgaaggcgacaggatccgcctctagcatgatcaacggcgtggtcaaactcctgaccaagccttgggacgtggttcccatggtgacgcagatggctatgaccgatacaaccccgttcggccagcaacgcgtctttaaagagaaggtggacacacggacccctagatccatgcccgggacgcgccgggttatgggaattacagccgagtggctgtggagaaccctcggccgcaataaaaagcctcggctgtgcacaagagaagagttcaccaagaaagtgcgcacgaacgctgccatgggggccgtctttaccgaagagaatcagtgggatagcgcgaaggctgccgtggaagacgaggatttctggaaacttgttgaccgggagagagaactgcacaagctcggaaaatgtggctcctgcgtgtacaacatgatggggaagcgcgagaaaaagctgggcgaatttggaaaggccaaaggctctagagctatctggtacatgtggcttggggcccggtatctggagttcgaggctctcggatttctgaatgaagatcattggttcagccgcgagaactcctactctggcgtcgaaggggagggactgcacaagctcggctatattctgagagacatcagcaaaatccccgggggcgccatgtacgcggatgacacagccggatgggacacccggattacagaagatgaccttcataatgaggagaagatcacccagcagatggatcctgaacacagacaactggctaacgccatttttaaactcacatatcagaataaggtggtcaaggtgcagcggcccaccccgacgggcacagttatggacatcatttcccgcaaagatcagagagggtctggacaagtgggcacctacgggctgaacaccttcacaaatatggaggctcagcttatccggcagatggaaggagagggcgtcctgagcaaggccgacctcgaaaaccctcatctgcccgagaaaaagatcacccagtggctggagacaaaaggggtggaacgcctcaagagaatggcgatttccggcgatgactgcgtggttaagcccatcgatgaccggtttgccaacgctctgcttgccctgaatgatatgggaaaagtgcgcaaggacattcctcaatggcagccgagcaaaggctggcatgattggcagcaggtccccttctgttctcaccatttccacgagctcatcatgaaggacgggagaaaactggtggttccttgccggccccaagacgaacttattggacgcgctagaatctcccagggcgccgggtggagcctgcgggagacggcttgtctcggaaaggcctatgcgcagatgtggtctctgatgtactttcaccgcagagatctgcggctcgcctccaacgctatttgcagcgccgtgcctgtccattgggtgcccacctctcgcacaacctggtccatccacgcccatcaccaatggatgacaaccgaagacatgctgacggtctggaatagagtgtggatcgaggataacccttggatggaggacaagacccccgttacaacctgggaaaatgtgccgtaccttggcaaacgggaggatcagtggtgtgggagcctgattggcctcacatccagagctacctgggcccagaacatccctacggcgattcagcaagtccgcagcctgatcggaaatgaagagttccttgactatatgccctctatgaagcggtttagaaaagaggaagagagcgaaggcgctatttggtga

SEQ ID NO: 20753 - RNA, 9873 nt, synthetic construct
  misc_feature 1..9873: note = derived and/or modified CDS sequence (opt5) from DENV-3__EU854291__SS-prME
  source 1..9873: mol_type = other RNA
accagcctgtgcctcatgatgatcctgcccgccgctcttgccttccacctgacatcccgggacggagaacctcggatgattgtggggaagaacgaacgcggaaaatctctcctgtttaagacggcgagcggcatcaatatgtgtacccttattgctatggatctgggggagatgtgcgacgatacaatcacctacaaatgtccgcacattacagaagtggagcccgaagacatcgattgctggtgtaacctcacctccacatgggttacctatggaacgtgcaatcaggccggcgagcacagacgggacaagcgctctgtggccctggctcctcatgtggggatgggactggataccagaacacagacctggatgagcgccgagggcgcttggcggcaggtcgaaaaagtggagacatgggccctccgccaccccggcttcaccatcctggcgctttttctggcccattacattgggacgtccctcacacagaaggttgtgatcttcattctgcttatgctggtcaccccttctatgacaatgagatgtgtgggagttggcaaccgggactttgtggaagggctcagcggagctacctgggtcgatgtggtgctggagcacggcgggtgcgtcaccacaatggccaagaataaacccacgctggacatcgagctccagaagaccgaagctacacaactggccacccttcgcaaactgtgtattgagggaaagatcacaaacattaccacggattccagatgccctacacagggcgaagcggttctcccggaggaacaggaccagaattatgtgtgtaaacacacctacgtggatcggggctgggggaacggatgcggcctgttcgggaagggaagccttgtgacatgcgccaagtttcaatgtctggagcccatcgagggcaaagtggttcagtatgaaaatctcaagtacacagtgatcattaccgtccatacaggggaccagcaccaggtgggaaacgagacgcaaggcgttaccgctgaaatcacacctcaggcctctaccacagaggctattctgcccgaatatggcaccctggggctcgagtgctcccctcgcacgggactggacttcaatgagatgatccttctgaccatgaaaaacaaggcctggatggtgcatagacagtggtttttcgatctccccctgccgtggacaagcggcgccaccacagaaacccctacgtggaatcggaaagagcttctggtcacatttaagaacgctcacgcgaaaaagcaagaagtggtcgtgctcgggtctcaggagggagccatgcacaccgctctgacaggcgccaccgaaattcaaaattccgggggcaccagcatcttcgccggacatctgaagtgtcgcctcaaaatggacaagctggagcttaaaggcatgtcttacgctatgtgcacaaacacgtttgttctgaagaaagaggtgtccgaaacccagcacgggacaatcctcattaaggtcgagtacaagggagaagatgtgccctgtaaaatccctttcagcaccgaggacggccaagggaaggcccataacggaagactgattacagcgaatcccgttgtgaccaaaaaggaggaacccgtcaacatcgaggctgaacctccgttcggcgagtccaatattgtgatcgggatcggcgataacgccctgaaaattaattggtataagaagggatctagcatcggcaaaatgtttgaagccacggctagaggggccagacgcatggctattcttggagacacagcctgggatttcggctccgtcgggggagttctcaacagcctgggcaagatggtccaccagatctttgggtctgcgtacaccgccctgttctccggcgtgagctgggtgatgaaaattggaatcggcgtcctcctgacctggattgggcttaattctaagaacacaagcatgtccttttcttgcatcgctatcggaattatcaccctgtatctcggcgccgtggttcaggctgacatggggtgtgtgattaattggaaaggaaaggagctgaagtgcggcagcgggatcttcgtcacaaacgaggtgcatacgtggaccgaacagtacaaatttcaagccgattcccccaagcggctggcgacagccattgctggcgcctgggagaatggagtttgtggcatcagaagcaccacacgcatggaaaaccttctctggaaacagatcgctaatgagctgaactatattctgtgggaaaataacatcaagctcaccgtggtcgtgggggacacgattggagttctggagcagggcaaacggacccttacacctcagcccatggagctgaagtactcttggaaaacctgggggaaggccaagatcgtgacagccgaaacccaaaactccagcttcattatcgatggacctaatacacccgagtgcccgtctgcttccagagcgtggaacgtctgggaagtggaggactatggctttggcgtgttcaccacgaatatctggctcaaactgcgcgaagtctacacacagctgtgtgaccaccggcttatgagcgccgctgttaaggatgagagagccgtgcacgccgacatggggtactggattgagtcccagaaaaacggatcttggaagctcgaaaaagctagcctgatcgaggtgaagacctgcacctggcctaagtcccatacactgtggtctaatggcgtcctcgaaagcgatatgattatccccaaatccctggccgggcctattagccagcacaactatcgccccggataccatacccaaacggcgggcccttggcaccttgggaagctggagctcgactttaattattgcgagggaacaaccgtggttatcacagaaaactgtggcacccggggcccctctctgagaacaaccacggtgtccgggaaactgatccacgagtggtgctgtcgcagctgcacccttccgcctctccggtacatgggagaagatggctgttggtatgggatggagattagacccgtctctgaaaaggaggagaatatggtgaaatccctggttagcgctggatctggcgaagtggacaacttcacaatgggggtcctgtgcctcgccatcctgtttgaggaagtgatgcggggaaagttcggcaagaaacatatgattgccggcgttttctttaccttcgtgcttctgctcagcgggcagatcacatggcgcgatatggctcacaccctgattatgatcggatccaatgccagcgacagaatgggcatgggggtcacgtacctggcgcttattgctacatttaagatccagcccttcctggccctcggatttttcctgcggaaactcacctctagagagaacctgcttctgggcgtggggctcgccatggctacaaccctgcaactgcctgaagatatcgagcagatggccaatggaattgctcttggcctgatggccctcaagctgatcacccagtttgagacatatcagctctggacggcgctgatttcccttacctgtagcaacacaatcttcaccctgacagtggcctggcgcaccgctacgctcattctggccggcgtctccctgcttccggtttgccaatctagctccatgcggaaaacagactggctgcccatgaccgtggctgccatgggggtgcctcccctccctctgtttatcttctctctcaaggataccctgaagagacgcagctggccccttaatgaaggagtcatggccgtgggcctggtttccatcctggcttctagcctcctgagaaacgacgtgcctatggcggggccccttgtcgccggaggcctgctcattgcttgttacgtgatcacagggacctccgccgatctgacagttgagaaagccgctgacgtgacgtgggaagaggaagccgagcagaccggagtcagccataacctcatgattacagtggacgatgacggcaccatgcggatcaaggatgacgagacagaaaatattctgaccgtccttctgaaaacggcgctgctcatcgtgtctggcatctttccgtactccattcctgctaccctgcttgtttggcacacatggcagaagcagacccaacgcagcggggtgctgtgggatgtcccctctcctcccgagacacagaaagccgaactcgaggagggagtgtatagaatcaagcagcagggcattttcgggaaaacccaagttggagtgggcgtccagaaggaaggggtgtttcatacaatgtggcacgtgacgcggggagccgttctgacctacaacggcaagcgcctcgagccgaattgggcttccgtcaaaaaggacctgatcagctatggcgggggatggagactttctgcccagtggcaaaaaggcgaagaggtccaggtgattgcggtcgaacctgggaagaaccccaaaaatttccagacaatgcctggaaccttccagaccacaacgggcgagatcggggctattgccctggattttaagcccggaacctccggcagccccatcatcaaccgggagggcaaggtggttgggctgtacggaaatggcgtggtcaccaagaacgggggatatgtgtccggcattgcccaaaccaatgctgaacctgacgggccgacacccgagctcgaagaggaaatgttcaagaaacgcaacctgaccatcatggatcttcaccctggcagcggaaagacgagaaaatacctgcccgccattgttcgggaggctatcaagcgcagactccggacactgattctcgcccctaccagagtggtcgcggccgagatggaagaggctctgaagggccttcccatccgctatcagaccacagccaccaaatctgaacatacagggcgggagatcgtggacctgatgtgccacgctacctttacgatgagactgctcagccctgttcgcgtgccgaattacaacctgattatcatggatgaagcccatttcacagaccccgcctccattgctgcgcggggatacatctctaccagagtcggcatgggggaggccgctgccatttttatgacagccacccctcccggaacggctgatgccttccctcagagcaatgcgcccatccaggacgaggaacgcgacatcccggagcggtcctggaactctggcaatgaatggattaccgattttgctgggaagacagtgtggttcgtgcctagcatcaaagccggcaacgacattgccaactgtcttagaaagaatggcaaaaaggtcatccaactgtcccgcaagacctttgatacagagtatcagaaaaccaagctcaacgactgggatttcgttgtgacaaccgacatttctgagatgggagctaattttaaagccgatcgggtgatcgaccccagacggtgcctgaagcccgtcattctgacggatgggagcgaacgcgtgatcctcgcgggacctatgcccgttacagccgcttccgccgctcagagacggggccgcgtggggagaaaccctcagaaagagaatgaccaatacatcttcaccggacagccgcttaacaatgatgaagaccacgcccattggaccgaggctaagatgctgctggacaacattaatacacccgaaggcatcattcctgccctcttcgagcccgagcgggaaaagagcgcggccatcgatggggagtatagactgaaaggcgaatctcgcaagacctttgtcgagcttatgcggagaggagacctgcctgtgtggctcgctcacaaagttgcctccgaaggcattaagtacacagatcgcaaatggtgcttcgacgggcagcggaacaatcagatcctggaggagaacatggatgtggaaatctggacgaaggagggagagaagaagaagctgagaccccgctggctcgacgctcggacctatagcgatccgcttgccctgaaagagtttaaggacttcgccgctggcagaaaatctattgcgctggatctcgtcacagaaatcgggcgcgtgcctacccacctggcccatagaacacggaatgctcttgacaacctggtcatgctccacacctccgagcatggaggcaaggcctaccgccacgccgtggaggaactgcccgagacgatggaaaccctgctccttctgggcctgatgattctcctgacagggggagctatgctttttctgatcagcggcaaagggattggaaagacctccatcggcctcatctgtgttattgcctctagcgggatgctgtggatggcggagatccctctgcaatggattgcctccgctatcgtgctcgagttctttatgatggtgcttctgattcccgaacctgagaagcagagaacaccccaggataatcaactggcctatgtcgttatcggcattctcaccctggctgccacgatcgcggccaacgaaatgggccttctggagacaaccaaacgggacctcggcatgagcaaggaaccgggggtggtgtctcctacatcctacctggatgtcgacctgcaccccgctagcgcctggaccctctacgctgtggccaccacagttatcacgcccatgcttcgccataccattgaaaattctacagctaacgtgagcctggccgcgatcgccaaccaggctgtcgtgctgatgggactcgacaaaggctggcctatttccaagatggatctgggggtcccgcttctggccctcggatgctattctcaggtgaatcccctgaccctgacagctgccgttctccttctgatcacccactacgccattatcggccctgggctgcaggcgaaagctacgagagaggcccaaaagcggacagctgccggaatcatgaagaaccccaccgtggacggcattatgaccatcgatctcgaccctgtcatttatgatagcaaattcgagaagcagctgggccaggtgatgcttctggttctctgtgccgtgcagctgctgctcatgagaacatcctgggctctttgcgaggccctgaccctggcgacagggcccatcacgaccctctgggaaggatctcctggcaaattttggaatacaaccattgccgtcagcatggctaacatcttccgcgggtcctacctggccggagctggccttgcctttagcatcatgaagtctgtggggacaggaaaacggggcaccggctcccaaggggagacgctgggagaaaagtggaagaaaaagctcaatcagctgagcagaaaagagttcgacctgtataagaaatccggcattaccgaggtggatcgcacagaagcgaaggaggggctcaaacggggagaaatcacccatcacgccgtttctagaggcagcgctaaacttcagtggtttgtcgagcggaacatggtgattccggaagggcgcgtgatcgacctgggatgtggcagaggcgggtggtcctactattgcgccggactgaagaaagtcacagaggttcggggctacaccaaagggggacccggccatgaggaacctgtgcccatgtctacatacgggtggaatattgtgaaactcatgagcggaaaggatgtcttctatctgcctcccgagaaatgtgacacccttctgtgcgatatcggcgaatccagcccgtctcctacggtggaggagtcccgcacaattagagttctcaagatggtggaaccctggctgaagaacaatcagttctgtatcaaagtcctgaacccctacatgcctaccgtgatcgagcacctcgaacggcttcaacgcaagcacggcgggatgctggttagaaatcccctgagccggaactctacccatgagatgtattggatttccaatggaacaggcaacatcgtggctagcgtcaatatggtgtctcgcctcctgcttaacagatttacgatgacccaccggagacctacaattgaaaaagacgtggatctgggggccggaacccgccatgtcaacgctgagccggagacacccaatatggacgttatcggcgaacggattaagagaatcaaagaggaacacaacagcacctggcactacgacgatgagaatccttataagacatgggcctaccatgggtcctatgaagtgaaggcgaccggatctgccagctccatgatcaacggcgtggtcaaactcctgacgaagccctgggacgtggttcctatggtgacccagatggctatgacagataccacacccttcggccagcaacgcgtctttaaagagaaggtggacacccggacgccgagacctatgcccgggacacgccgggttatgggaattaccgccgagtggctgtggagaacactcggccgcaataaaaagcctcggctgtgcaccagagaagagttcacgaagaaagtgcgcaccaacgctgccatgggggccgtctttacagaagagaatcagtgggatagcgcgaaggctgccgtggaagacgaggatttctggaaacttgttgaccgggagagagaactgcacaagctcggaaaatgtggctcctgcgtgtacaacatgatggggaagcgcgagaaaaagctgggcgaatttggaaaggccaaaggctctagagctatctggtacatgtggcttggggcccggtatctggagttcgaggctctcggatttctgaatgaagatcattggttcagccgcgagaactcctactctggcgtcgaaggggagggactgcacaagctcggctatattctgagagacatcagcaaaattcccgggggcgccatgtacgcggatgacaccgccggatgggacacacggatcaccgaagatgaccttcataatgaggagaagatcacacagcagatggatcctgaacacagacaactggctaacgccatttttaaactcacctatcagaataaggtggtcaaggtgcagcggcccacgccgacaggcaccgttatggacatcatttcccgcaaagatcagagagggtctggacaagtgggcacctacgggctgaacacattcaccaatatggaggctcagcttatccggcagatggaaggagagggcgtcctgagcaaggccgacctcgaaaaccctcatctgcccgagaaaaagattacacagtggctggagacgaaaggggtggaacgcctcaagagaatggcgatctccggcgatgactgcgtggttaagcccatcgatgaccggtttgccaacgctctgcttgccctgaatgatatgggaaaagtgcgcaaggacattcctcaatggcagccgagcaaaggctggcatgattggcagcaggtccccttctgttctcaccatttccacgagctcatcatgaaggacgggagaaaactggtggttccttgccggccccaagacgaacttattggacgcgctagaatctcccagggcgccgggtggagcctgcgggagaccgcttgtctcggaaaggcctatgcgcagatgtggtctctgatgtactttcaccgcagagatctgcggctcgcctccaacgctatttgcagcgccgtgcctgtccattgggtgcccacatctcgcaccacatggtccatccacgcccatcaccaatggatgaccacggaagacatgctgaccgtctggaatagagtgtggattgaggataacccttggatggaggacaagacacccgttaccacatgggaaaatgtgccgtaccttggcaaacgggaggatcagtggtgtgggagcctgatcggcctcacctccagagctacgtgggcccagaacatccctacagcgattcagcaagtccgcagcctgatcggaaatgaagagttccttgactatatgccctctatgaagcggtttagaaaagaggaagagagcgaaggcgctatttggtga

SEQ ID NO: 20754 - RNA, 9873 nt, synthetic construct
  misc_feature 1..9873: note = derived and/or modified CDS sequence (opt5) from DENV-3__KF955454__SS-prME
  source 1..9873: mol_type = other RNA
accagcctgtgcctcatgatgatcctgcccgccgctcttgccttccacctgacatcccgggacggcgaacctcggatgattgtggggaagaacgaacgcggaaaatctctcctgtttaagacggcgagcggcatcaatatgtgtacccttattgctatggatctgggggagatgtgcgacgatacagtgacctacaaatgtccccacatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacatcattggagtgctggagcagggcaaacggacgcttacccctcagcccatggagctgaagtactcttggaaaacatgggggaaggccaagatcgtcaccgccgaaacacaaaactccagcttcattatcgatggacctaatacccccgagtgcccgtctgcttccagagcgtggaacgtgtgggaagtggaggactatggctttggcgtcttcacaaccaatatctggctcaaactgcgcgaagtttacacgcagctgtgtgaccaccggcttatgagcgccgctgtgaaggatgagagagccgtgcacgccgacatggggtactggattgagtcccagaaaaacggatcttggaagctcgaaaaagctagcctgatcgaggtcaagacatgcacctggcctaagtcccataccctgtggtctaatggcgtgctcgaaggggatatgattatccccaaaagcctggccggacctatttcccagcacaactatcgccccggctaccatacacaaaccgcggggccttggcaccttggaaagctggagctcgactttaattattgcgagggcacgacagttgtgatcaccgaaaactgtggcacacgggggcccagcctgagaaccacaaccgtctctggaaaactgatccacgagtggtgctgtcgctcctgcacgcttccgcctctccggtacatgggcgaagatgggtgttggtatggaatggagattagacccatcagcgaaaaggaggagaatatggtgaaatctctggtttccgctggcagcggggaagtggacaacttcaccatgggagtcctgtgcctcgccattctgtttgaggaagtgatgcggggcaagttcggcaagaaacatatgatcgccggggttttctttacattcgtgcttctgctctctggacagattacctggcgcgatatggctcacacactgatcatgattggcagcaatgcctccgacagaatggggatgggagtcacctacctggcgcttatcgctacgtttaagatccagcccttcctggccctcggctttttcctgcggaaactcacaagcagagagaacctgcttctgggggtgggactcgccatggctaccacactgcaactgcctgaagatattgagcagatggccaatggcatcgctcttggcctgatggccctcaagctgattacccagtttgagacctatcagctctggacagcgctgatctctcttacgtgttccaacaccattttcacactgaccgtggcctggcgcacagctaccctcatcctggccggggtcagcctgcttccggtttgccaatcctctagcatgcggaaaacggactggctgcccatgacagtggctgccatgggagtgcctcccctccctctgtttatcttctccctcaaggataccctgaagagacgctcttggccccttaatgaaggcgtcatggccgtggggctggttagcattctggcttcctctctcctgagaaacgacgtgcctatggcgggaccccttgtcgccggcgggctgctcatcgcttgttacgtgattaccggaacaagcgccgatctgaccgttgagaaagccgctgacgtgacatgggaagaggaagccgagcagacgggcgtctcccataacctcatgatcaccgtggacgatgacggcacaatgcggattaaggatgacgagaccgaaaatatcctgacagtccttctgaaaaccgcgctgctcatcgtgagcgggatttttccgtactctatccctgctacgctgcttgtttggcacacctggcagaagcagacacaacgctccggagtgctgtgggatgtccccagccctcccgagacccagaaagccgaactcgaggagggcgtgtatagaattaagcagcaggggatcttcggaaaaacacaagttggcgtgggggtccagaaggaaggagtgtttcataccatgtggcacgtgacacggggcgccgttctgacgtacaacggcaagcgcctcgagccgaattgggcttctgtcaaaaaggacctgatttcctatgggggaggctggagacttagcgcccagtggcaaaaaggggaagaggtccaggtgatcgcggtcgaacctggaaagaaccccaaaaatttccagaccatgcctggcacattccagaccaccacaggggagattggagctatcgccctggattttaagcccggcacgtctggctcccccatcattaaccgggaggggaaggtggttggactgtacggcaatggggtggtcaccaaaaacggaggctatgtgagcgggatcgcccaaacaaatgctgaacctgacggcccgacccccgagctcgaagaggaaatgttcaagaaacgcaacctgacaattatggatcttcaccctggatccggcaagaccagaaaatacctgcccgccatcgttcgggaggctattaagcgcagactccggacgctgatcctcgcccctacaagagtggtcgcggccgagatggaagaggctctgaaggggcttcccatccgctatcagaccaccgccacaaaaagcgaacataccggacgggagattgtggacctgatgtgccacgctacatttaccatgagactgctctctcctgttcgcgtgccgaattacaacctgatcattatggatgaagcccatttcacggaccccgccagcatcgctgcgcggggctacatttccacaagagtcgggatgggagaggccgctgccatctttatgaccgccacacctcccggcaccgctgatgccttccctcagtctaatgcgcccatccaggacgaggaacgcgacattccggagcggagctggaactccgggaatgaatggatcacggattttgctggcaagaccgtgtggttcgtgccttctattaaagccggaaacgacatcgccaactgtcttagaaagaatggcaaaaaggtcattcaactgagccgcaagacatttgataccgagtatcagaaaacaaagctcaacgactgggatttcgttgtgaccacagacatctccgagatgggggctaattttaaagccgatcgggtgattgaccccagacggtgcctgaagcccgtcatcctgaccgatggacctgaacgcgtgatcctcgcgggccccatgcctgttacggccgcttctgccgctcagagacgggggcgcgtgggaagaaacccgcagaaagagaatgaccaatacattttcacaggccagccccttaacaatgatgaagaccacgcccattggaccgaggctaagatgctgctggacaacatcaatacccctgaagggattatccccgccctcttcgagcctgagcgggaaaagagcgcggccattgatggcgagtatagactgaaaggagaatcccgcaagacatttcttgagctgatgcggagaggcgacctccccgtctggctggcttacaaagtggccagcgaagggatcaagtataccgatcgcaaatggtgcttcgacggacagcggaacaatcagatcctggaggagaacatggatgttgaaatttggacaaaggagggcgagaagaagaagctcagaccgcgctggcttgacgctcggacgtactctgatcctctggccctgaaagagtttaaggacttcgccgctgggagaaaatccatcgcgctcgatctggtgaccgaaattggacgcgtccccacacaccttgcccacagaacccggaatgctctggacaacctcgtgatgctgcatacaagcgagcacggcggcaaggcctatcgccatgccgtcgaggaactgcctgagaccatggaaacgctccttctgctggggctcatgatcctgcttaccggaggcgctatgctgtttctcatttctgggaaaggaatcggcaagacatccatcgggctgatttgtgtgatcgccagctccggaatgctgtggatggcggagattcccctccaatggatcgcctctgctattgttcttgagttctttatgatggtgctgctgatccctgaacccgagaagcagagaaccccgcaggataatcaactcgcctacgtggtcattggcatcctgacacttgctgccatcattgcggccaacgaaatgggcctgctcgagaccacgaaacgggacctggggatgagcaaggaacctggagttgtgtcccccacaagctacctggatgtggacctccaccccgcttctgcctggaccctttatgctgtcgccacaaccgtgatcacccctatgctgcgccacacaattgaaaattccacggctaacgttagcctggccgcgatcgccaaccaggctgtggtcctcatgggcctggacaaagggtggccgatttctaagatggatcttggagtgcccctgctcgccctgggctgctacagccaggtcaatcctctgaccctcacagctgccgtgcttctgctgatcacccattatgccatcattgggcccggactccaggcgaaagctacaagagaggcccaaaagcggaccgctgccggcatcatgaagaaccctacggttgacggcattatgacaatcgatctggaccccgtgatttacgattccaaattcgagaagcagcttgggcaggtcatgctgctcgtgctgtgtgccgttcagctgctccttatgagaacctcttgggctctgtgcgaggccctgaccctcgcgacaggacctatcaccacactgtgggaaggcagcccggggaaattttggaatacgaccatcgccgtgtccatggctaacattttccgcggatcttatcttgccggcgctgggctggcctttagcatcatgaagtccgtcggaacaggcaaacggggcaccgggagccaaggagagacactcggcgaaaagtggaagaaaaagctgaatcagctgtctagaaaagagttcgacctctacaagaaatccgggattaccgaggtggatcgcgcggaagccaaggagggacttaaacggggcgaaatcacgcaccatgctgtgagcagagggtccgccaagctgcagtggtttgttgagcggaacatggtcattcccgaaggacgcgtgatcgacctgggctgtggcagagggggatggtcttattactgcgctggcctcaagaaagtgaccgaggtccgggggtacacaaagggaggccctgggcacgaggaacccgttcctatgagcacctatggatggaatattgtgaaactgatgtccggcaaggatgtgttctaccttcccccggagaaatgtgacacactgctctgcgatatcggcgaatctagcccttcccccaccgtcgaggagagccgcacaatcagagtgctgaagatggttgaaccctggctgaagaacaatcagttctgtattaaagtgctcaacccttatatgcccaccgtcatcgagcatcttgaacggctgcaacgcaagcacgggggaatgctggtgagaaatcctctctctcggaactccacgcacgagatgtactggattagcaatggcacagggaacatcgttgcctctgtgaatatggtctcccgcctgcttctgaacagatttaccatgacccatcggagaccgacaattgaaaaagacgtggatctcggagctggcacgcgccacgtgaacgccgagcccgagacccctaatatggacgtcatcggggaacggatcaagagaattaaagaggaacataacagcacatggcactatgacgatgagaatccctacaagacctgggcgtatcacggatcttacgaagttaaggccacaggcagcgcttcctctatgatcaacggcgtggtgaaactgctgaccaagccttgggacgtcgtgcccatggttacacagatggccatgaccgatacgaccccgttcgggcagcaacgcgtgtttaaagagaaggtcgacacacggacccctagaagcatgcccggaacacgccgggtgatgggcattaccgctgagtggctctggagaacgctggggcgcaataaaaagcctcggctttgcacaagagaagagttcaccaagaaagttcgcacaaacgccgccatgggagcggtgtttaccgaagagaatcagtgggattccgctaaggccgccgtcgaagacgaggatttctggaaactggtggaccgggagagagaactccataagctgggcaaatgtgggagctgcgtttacaacatgatgggcaagcgcgagaagaaacttggagaatttggcaaagctaaagggtccagagccatctggtatatgtggctgggagctcggtacctcgagttcgaggccctgggctttctgaatgaagatcactggttctctcgcgagaacagctattccggggtggaaggagagggcctccataagctggggtacattcttagagacatctctaaaatccccggcggagcgatgtatgccgatgacacggctggctgggacacccggattacagaagatgacctgcacaatgaggagaagatcacccagcagatggatcctgaacatagacaactcgccaacgctatttttaaactgacataccagaataaggtcgtgaaggtccagcggcccaccccgacagggaccgtgatggacatcattagccgcaaagatcagagaggatccggccaagttgggacgtatggacttaacacattcaccaatatggaggcccagctgatccggcagatggaaggcgagggggtgctctctaaggcggacctggaaaaccctcatccgcccgagaaaaagatcacccagtggctggagacaaaaggcgtcgaacgcctcaagagaatggccattagcggagatgactgcgtggtgaagcctatcgatgaccggtttgctaacgccctgcttgctctgaatgatatgggcaaagttcgcaaggacattccgcaatggcagccctccaaagggtggcacgattggcaacaggtgcctttctgtagccatcacttccatgagctcatcatgaaggacggaagaaaactggtcgtgccctgccggcctcaagacgaacttattggccgcgccagaatctctcagggggctggatggtccctgcgggagaccgcctgtctcggcaaggcgtacgcccagatgtggagcctgatgtactttcaccgcagagatctgcggctcgcttctaacgccatttgctccgccgttcccgtgcactgggtccctacaagccgcacgacctggtctatccatgctcaccatcaatggatgacaaccgaagacatgctgacagtgtggaatagagtctggatcgaggataacccctggatggaggacaagaccccggtgacgacctgggaaaatgttccttatcttgggaaacgggaggatcagtggtgtggctccctgattggactcacaagcagagccacctgggcgcagaacatccccacagctattcagcaagtgcgctccctgatcggcaatgaagagttccttgactacatgcctagcatgaagcggtttagaaaagaggaagagtctgaaggggccatttggtga

SEQ ID NO: 20755 - RNA, 9873 nt, synthetic construct
  misc_feature 1..9873: note = derived and/or modified CDS sequence (opt5) from DENV-3__EU854292__SS-prME
  source 1..9873: mol_type = other RNA
accagcctgtgcctcatgatgatcctgcccgccgctcttgccttccacctgacatcccgggacggagaacctcggatgattgtggggaagaacgaacgcggaaaatctctcctgtttaagacggcgagcggcatcaatatgtgtacccttattgctatggatctgggggaaatgtgcgacgatacagtgacctacaaatgtccgcatatcacagaagttgaacccgaagacattgattgctggtgtaacctcacctccacatgggtgacctatggaacgtgcaatcaggccggcgaacacagacgggacaagcgctctgtggccctggctcctcatgtcgggatgggactggataccagaacacagacctggatgagcgccgaaggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggaattggcaaccgggactttgtggaagggctcagcggagctacctgggtcgatgtggtgctggagcacggcgggtgcgtcaccacaatggccaagaataaacccacgctggacatcgagctccagaagaccgaagctacacagctggccacccttcgcaaactgtgtattgagggaaagatcacaaacattaccacggattccagatgccctacacagggcgaagcggccctcccggaggaacaggaccagaattatgtttgtaaacacacctacgtggatcggggctgggggaacggatgcggcctgttcgggaagggaagccttgtgacctgcgctaagtttcaatgtctggagcccatcgagggcaaagtcgtgcagcatgaaaatctcaagtatacagttatcattaccgtgcacacaggggaccagcatcaggtcggaaacgagacgcaaggcgtgaccgccgaaatcacacctcaggcttctaccacagaggccattctgcccgaatacggcaccctggggctcgagtgctcccctcgcacgggactggacttcaatgagatgatccttctgaccatgaaaaacaaggcctggatggttcacagacagtggtttttcgatctccccctgccgtggacaagcggcgctaccacagaaacccctacgtggaatcggaaagagcttctggtgacatttaagaacgcgcacgccaaaaagcaagaagtcgtggtcctcgggtctcaggagggagctatgcataccgccctgacaggcgccaccgaaattcaaaattccgggggcaccagcatcttcgctggacacctgaagtgtcgcctcaaaatggacaagctggagcttaaaggcatgtcttatgccatgtgcacaaacacgtttgtgctgaagaaagaggtttccgaaacccagcatgggacaatcctcattaaggtggagtacaagggagaagatgcgccctgtaaaatccctttcagcaccgaggacggccaagggaaggctcacaacggaagactgattacagccaatcccgtcgtgaccaaaaaggaggaacccgttaacatcgaggccgaacctccgttcggcgagtccaatattgtgatcgggatcggcgataacgctctgaaaattaattggtacaagaagggatctagcatcggcaaaatgtttgaagccacggctagaggggccagacgcatggcgattcttggagacacagcctgggatttcggctccgtcgggggagtgctcaacagcctgggcaagatggtgcatcagatctttgggtctgcttataccgccctgttctccggcgttagctgggtcatgaaaattggaatcggcgtgctcctgacctggattgggcttaattctaagaacacaagcatgtccttttcttgcatcgctatcggaattatcaccctgtacctcggcgccgtggtccaggcggacatggggtgtgtgattaattggaaaggaaaggagctgaagtgcggcagcgggatcttcgttacaaacgaggtgcacacgtggaccgaacagtataaatttcaagccgattcccccaagcggctggctacagccattgctggcgcctgggagaatggagtctgtggcatcagaagcaccacacgcatggaaaaccttctctggaaacagatcgccaatgagctgaactacattctgtgggaaaataacatcaagctcaccgtggttgtgggggacattatcggagtcctggagcagggcaaacggacgcttacccctcagcccatggagctgaagtattcttggaaaacatgggggaaggctaagattgtgaccgcggaaacacaaaactccagcttcatcatcgatggacctaatacccccgagtgcccgtctgccgctagagcctggaacgtttgggaagtggaggactacggctttggcgtcttcacaaccaatatttggctcaaactgcgcgaagtgtatacgcagctgtgtgaccaccggcttatgtccgccgctgtgaaggatgagagagccgtccatgcggacatggggtactggatcgagagccagaaaaacggatcctggaagctcgaaaaggcttctctgattgaggttaagacatgcacctggcctaagagccacaccctgtggtccaatggcgtgctcgaatctgatatgatcattcccaaaagcctggccgggcctatctcccagcataaccaccgccccggataccacacacaaaccgccggcccttggcatcttgggaagctggagctcgactttaattattgcgagggaacgacagtggtcatcaccgaaaactgtggcacacggggccccagcctgagaaccacaaccgtgtctgggaaactgattcacgagtggtgctgtcgctcctgcacgcttccgcctctccggtacatgggagaagatggctgttggtatgggatggagatcagacccattagcgaaaaggaggagaatatggttaaatctctggtgtccgctggaagcggcaaggtcgacaacttcaccatgggggtgctgtgcctcgccatcctgtttgaagaggttatgcggggaaagttcggcaaaaagcatatgattgcgggcgtgttctttacattcgtccttctgctctctgggcagatcacctggcgcgatatggctcacacactgattatgatcggaagcaatgcctccgacagaatgggcatgggggtgacctacctggcccttatcgctacgtttaaaattcagcccttcctggccctcggatttttcctgcggaagctcacaagcagagaaaacctgcttctgggcgttgggctcgctatggccaccacactgcaactgcctgaggatatcgaacagatggcgaatggaattgcccttggcctgatggctctcaaactgatcacccagtttgagacctatcagctctggacagccctgatttctcttacgtgttccaacaccatcttcacactgaccgtggcttggcgcacagccaccctcatcctggccggcgtcagcctgcttccggtgtgccaatcctctagcatgcggaagacggactggctgcccatggctgtggcggccatgggggtccctcccctccctctgtttattttctgtctcaaggatacactgaaaagacgctcctggccccttaatgagggagttatggctgtgggcctggtgtctatcctggccagctccctcctgagaaacgacgtccctatggccgggccccttgtggctggaggcctgctcattgcctgctacgttatcaccgggacctctgcggatctgacagtggaaaaggctgccgacattacctgggaggaagaggccgaacagacaggagtcagccataacctcatgatcacggtggacgatgacggcaccatgcggatcaaagatgacgagacagagaatattctgaccgttcttctgaagacagctctgctcatcgtgtccggcatttttccgtatagcatccctgccaccctgcttgtctggcacacgtggcagaaacagacccaacgctctggggtgctgtgggatgtcccctcccctcccgaaacacagaaggcggagctcgaagagggagtgtacagaattaaacagcagggcatcttcgggaagacccaagttggagtgggcgtccagaaggagggggtgtttcacacaatgtggcatgttacccggggagctgtgctgacatacaacggcaaacgcctcgaaccgaattgggccagcgtcaagaaagacctgatttcttatggcgggggatggagactttccgcccagtggcaaaagggcgaggaagtccaggtgatcgctgttgagcctgggaaaaaccccaagaatttccagacgatgcctggaaccttccagacaaccaccggcgaaatcggggccattgctctggattttaagcccggaacaagcggctctcccatcattaaccgggagggcaaagtcgtggggctgtacggaaatggcgtggtcacgaagaacgggggatatgtgtccggcatcgcccaaaccaatgcggagcctgacgggccgacacccgaactcgaggaagagatgttcaaaaagcgcaacctgaccattatggatcttcaccctggcagcggaaaaacaagaaagtacctgcccgccatcgttcgggaagctatcaagcgcagactccggaccctgattctcgcccctacgagagtggtcgctgccgagatggaggaagccctgaaaggccttcccatccgctatcagacaaccgctaccaagtccgagcatacagggcgggaaattgtggacctgatgtgtcacgcgacctttacaatgagactgctcagccctgttcgcgtgccgaattacaacctgatcattatggatgaggcccatttcaccgaccccgcttctatcgccgcccggggatatatcagcacgagagtcggcatgggggaagctgccgcgatttttatgacagctacccctcccggaacagccgatgccttccctcagtccaatgctcccatccaggacgaggagcgcgacattccggaacggtcttggaacagcggcaatgagtggatcaccgattttgccgggaaaacggtgtggttcgttccttccattaaggcgggcaacgacatcgccaactgccttcgcaaaaatggaaagaaggtgattcaactgtctagaaaaacctttgatacagaataccagaagaccaaactcaacgactgggatttcgtcgtgacaaccgacatcagcgagatgggcgctaattttaaggccgatcgggtgatcgaccccagacggtgcctgaaacccgtcattctgacagatgggcctgagcgcgttatcctcgctggacccatgcctgtgaccgccgcttccgccgcgcagagacggggccgcgtggggagaaacccgcacaaggaaaatgaccagtacattttcacgggacaaccccttaacaatgatgaggaccacgcccattggacagaagctaagatgctgctggacaacatcaatacccctgagggcattatccccgccctcttcgaacctgagcgggagaaatctgctgccatcgatggggaatatagactgaagggcgagagccgcaaaacctttgtcgaacttatgcggagaggagacctgcccgtgtggctcgcccacaaggttgcttccgagggcattaaatacacagatcgcaagtggtgtttcgacgggcagcggaacaatcagatcctggaagagaacatggatgtggagatttggaccaaagaaggagagaagaagaaactgagaccgcgctggctcgacgcgcggacatatagcgatcctcttgccctgaaggaatttaaagacttcgctgccggcagaaagtctatcgccctggatctcgtcacggagattgggcgcgtgccctcccatctggctcacagaacccggaatgcccttgacaacctggttatgctccacacaagcgaacatggaggccgcgcgtacagacacgccgtggaggagctgcctgaaaccatggagacactgctccttctgggcctgatgatcctcctgaccgggggagctatgctttttctgatctctggcaaagggattggaaagacgtccatcggcctcatttgcgtcatcgccagctccgggatgctgtggatggctgaaattcccctgcagtggatcgcctctgcgattgtgctcgagttctttatgatggtccttctgatccctgagcccgaaaagcaacggaccccgcaggataatcagctggcctatgtggttatcggcattctcacactggctgccatcattgctgccaacgagatgggccttctggaaaccacaaaacgcgacctcggcatgagcaaggagcctggggtggtgtcccccaccagctacctggatgtcgacctgcatcccgcttctgcctggacgctctatgcggttgccacaaccgtgatcacacctatgcttagacacaccattgaaaattccaccgctaacgtgagcctggccgctatcgccaaccaagccgtcgtgctgatgggactcgacaaaggctggccgatctctaagatggatctgggggttccccttctggcgctcggatgttacagccaggtgaatcctctgacactgacggctgccgtcctccttctgattacccattacgctatcattggccccgggctgcaggccaaagccacacgggaggctcagaagagaaccgccgcgggaatcatgaagaaccctacagtggacggcattatgaccatcgatctcgaccccgtcatctatgattccaaattcgagaagcaactgggccaggtgatgcttctggttctctgcgccgtgcagctgctgctcatgcgcacgtcttgggctctttgtgaagccctgacactggctaccgggcctattaccacactctgggagggaagcccgggcaaattttggaataccacaatcgccgtctccatggcgaacattttccgggggtcttacctggccggagctggccttgcctttagcatcatgaagtccgtggggacgggaaaaagaggcaccggcagccagggggaaacactgggagagaagtggaagaaaaagctcaatcaactgtctcgcaaagagttcgacctgtataagaaatccggcattaccgaggttgatcggacagaggctaaggaagggctcaaaagaggagagatcacccaccacgccgtgagccggggctccgctaaacttcagtggtttgtcgaacgcaacatggtgattcccgaggggagagtgatcgacctgggatgcggccggggcgggtggtcttactattgtgccggactgaagaaagttacggaagtccgcggctacaccaaagggggacctggccatgaggagcccgtgcctatgagcacatatgggtggaatatcgtgaaactcatgtccggaaaggatgtcttctacctgcccccggaaaaatgcgacacccttctgtgtgatattggcgagtctagcccttcccccacagttgaagagagcagaaccatccgggtgctcaagatggtggagccctggctgaagaacaatcagttctgcattaaagtcctgaacccttacatgcccacagtgatcgaacacctcgagcgccttcagagaaagcatggcgggatgctggttcggaatcctctgtctcgcaactccacccacgaaatgtattggattagcaatggaacgggcaacatcgtggcgtctgtcaatatggtgtccagactcctgcttaaccggtttacaatgacccacagacgcccgaccatcgagaaagacgttgatctgggggccggaacacggcatgtgaacgctgaacccgagacgcctaatatggacgtcattggcgagagaatcaagcgcattaaagaagaacacaacagcacctggcattacgacgatgaaaatccctataagacatgggcctaccacgggtcttatgaggtgaaggctaccggaagcgcctcctctatgatcaacggcgtggtcaaactcctgacaaagccttgggacgttgtgcccatggtgacccaaatggccatgacagataccacgccgttcggccagcagcgggtctttaaagaaaaggtggacaccagaacacctcgcagcatgcccgggacccggagagttatgggaattacagcggagtggctgtggcgcaccctcggccggaataaaaagcctagactgtgtacgcgcgaggagttcacaaagaaagtgcggaccaacgctgccatgggggccgtctttacagaggaaaatcaatgggattccgctaaggccgctgtggaggacgaagatttctggaaacttgttgacagagagcgcgagctgcataagctcggaaaatgcggcagctgcgtgtacaacatgatggggaagagagagaagaagctgggcgagtttggaaaggccaaaggctcccgggcgatctggtatatgtggcttggggcccgctacctggagttcgaggctctcggatttctgaatgaggatcactggttctctagagaaaacagctactccggcgtcgagggggaaggactgcacaagctcggctatatcctgcgggacatttctaaaatccccgggggcgccatgtacgctgatgacaccgccggatgggacacgagaattaccgaggatgaccttcataatgaagagaagatcacacagcagatggatcctgagcaccggcagctggcgaacgccatttttaaactcacctatcaaaataaggtggttaaggtgcagcgccccacaccgaccggcacagtcatggacatcatcagcagaaaagatcagcgggggtccggacaggtgggcacctacgggctgaacacgttcacaaatatggaagctcaacttattcgccagatggagggagaaggcgtcctgtctaaggccgacctcgagaaccctcatctgcccgagaaaaagatcacccagtggctggagaccaaaggggtggagagactcaagcggatggctattagcggcgatgactgtgttgtgaagcccatcgatgaccgctttgccaacgctctgcttgccctgaatgatatgggaaaagtcagaaaggacattcctcagtggcaaccgtccaaaggctggcacgattggcaacaggtgcccttctgcagccaccatttccacgaactcatcatgaaggacgggcggaaactggtggttccttgtcgcccccaggacgagcttattggacgggcgcggatctctcaaggcgccgggtggtccctgaaggaaacagcttgcctcggaaaggcctatgcccagatgtggagcctgatgtactttcatcgcagagatctgcggctcgcttctaacgccatctgttccgcggtgcctgtccactgggtgcccaccagccgcacaacgtggtctattcatgctcaccaccagtggatgaccacagaggacatgctgaccgtttggaatagagtgtggatcgaagataacccttggatggaggacaaaacacccgtcaccacgtgggagaatgtgccgtatcttggcaagcgggaagatcaatggtgcgggtccctgattggcctcaccagcagagccacatgggcccagaacatccctaccgctattcagcaggtccgctccctgatcggaaatgaggagttccttgactacatgcccagcatgaaacggtttagaaaggaggaggaatctgagggcgccatctggtga

SEQ ID NO: 20756 - RNA, 9873 nt, synthetic construct
  misc_feature 1..9873: note = derived and/or modified CDS sequence (opt5) from DENV-3__FJ639746__SS-prME
  source 1..9873: mol_type = other RNA
accagcctgtgcctcatgatgatcctgcccgccgctcttgccttccacctgacgtcccgggacggcgaacctcggatgattgtggggaagaacgaacgcggaaagtctctcctgtttaagacggcgagcggcatcaatatgtgtacccttattgctatggatctgggggagatgtgcgacgatacagtgacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacatcattggagtgctggagcagggcaaacggacgcttacccctcagcccatggagctgaagtactcttggaaaacatgggggaaggccaagatcgtcaccgccgaaacacaaaactccagcttcattatcgatggacctaatacccccgagtgcccgtctgcttccagagcgtggaacgtgtgggaagtggaggactatggctttggcgtcttcacaaccaatatctggctcaaactgcgcgaagtttacacgcagctgtgtgaccaccggcttatgagcgccgctgtgaaggatgagagagccgtgcacgccgacatggggtactggattgagtcccagaaaaacggatcttggaagctcgaaaaagctagcctgatcgaggtcaagacatgcacctggcctaagtcccataccctgtggtctaatggcgtgctcgaaagcgatatgattatccccaaatccctggccgggcctattagccagcacaactatcgccccggataccatacacaaaccgcgggcccttggcaccttgggaagctggagctcgactttaattattgcgagggaacgacagttgtgatcaccgaaaactgtggcacacggggcccctctctgagaaccacaaccgtctccgggaaactgatccacgagtggtgctgtcgcagctgcacgcttccgcctctccggtacatgggagaagatggctgttggtatgggatggagattagacccatctctgaaaaggaggagaatatggtgaaatccctggttagcgctggatctggcgaagtggacaacttcaccatgggggtcctgtgcctcgccattctgtttgaggaagtgatgcggggaaagttcggcaagaaacatatgatcgccggcgttttctttacattcgtgcttctgctcagcgggcagattacctggcgcgatatggctcacacactgatcatgattggatccaatgccagcgacagaatgggcatgggggtcacctacctggcgcttatcgctacgtttaagatccagcccttcctggccctcggatttttcctgcggaaactcacatctagagagaacctgcttctgggcgtggggctcgccatggctaccacactgcaactgcctgaagatattgagcagatggccaatggaatcgctcttggcctgatggccctcaagctgattacccagtttgagacctatcagctctggacagcgctgatctcccttacgtgtagcaacaccattttcacactgaccgtggcctggcgcacagctaccctcatcctggccggcgtctccctgcttccggtttgccaatctagctccatgcggaaaacggactggctgcccatgacagtggctgccatgggggtgcctcccctccctctgtttatcttctctctcaaggataccctgaagagacgcagctggccccttaatgaaggagtcatggccgtgggcctggtttccattctggcttctagcctcctgagaaacgacgtgcctatggcggggccccttgtcgccggaggcctgctcatcgcttgttacgtgattaccgggacatccgccgatctgaccgttgagaaagccgctgacgtgacatgggaagaggaagccgagcagacgggagtcagccataacctcatgatcaccgtggacgatgacggcacaatgcggattaaggatgacgagaccgaaaatatcctgacagtccttctgaaaaccgcgctgctcatcgtgtctggcatttttccgtactccatccctgctacgctgcttgtttggcacacctggcagaagcagacacaacgcagcggggtgctgtgggatgtcccctctcctcccgagacccagaaagccgaactcgaggagggagtgtatagaattaagcagcagggcatcttcgggaaaacacaagttggagtgggcgtccagaaggaaggggtgtttcataccatgtggcacgtgacacggggagccgttctgacgtacaacggcaagcgcctcgagccgaattgggcttccgtcaaaaaggacctgattagctatggcgggggatggagactttctgcccagtggcaaaaaggcgaagaggtccaggtgatcgcggtcgaacctgggaagaaccccaaaaatttccagaccatgcctggaacattccagaccaccacaggcgagattggggctatcgccctggattttaagcccggaacgtccggcagccccatcattaaccgggagggcaaggtggttgggctgtacggaaatggcgtggtcaccaaaaacgggggatatgtgtccggcatcgcccaaacaaatgctgaacctgacgggccgacccccgagctcgaagaggaaatgttcaagaaacgcaacctgacaattatggatcttcaccctggcagcggaaagaccagaaaatacctgcccgccatcgttcgggaggctattaagcgcagactccggacgctgatcctcgcccctacaagagtggtcgcggccgagatggaagaggctctgaagggccttcccatccgctatcagaccaccgccacaaaatctgaacataccgggcgggagattgtggacctgatgtgccacgctacatttaccatgagactgctcagccctgttcgcgtgccgaattacaacctgatcattatggatgaagcccatttcacggaccccgcctccatcgctgcgcggggatacatttctacaagagtcggcatgggggaggccgctgccatctttatgaccgccacacctcccggaaccgctgatgccttccctcagagcaatgcgcccatccaggacgaggaacgcgacattccggagcggtcctggaactctggcaatgaatggatcacggattttgctgggaagaccgtgtggttcgtgcctagcattaaagccggcaacgacatcgccaactgtcttagaaagaatggcaaaaaggtcattcaactgtcccgcaagacatttgataccgagtatcagaaaacaaagctcaacgactgggatttcgttgtgaccacagacatctctgagatgggagctaattttaaagccgatcgggtgattgaccccagacggtgcctgaagcccgtcatcctgaccgatgggcctgaacgcgtgatcctcgcgggacccatgcctgttacggccgctagcgccgctcagagacggggccgcgtggggagaaacccgcagaaagagaatgaccaatacattttcacaggacagccccttaacaatgatgaagaccacgcccattggaccgaggctaagatgctgctggacaacatcaatacccctgaaggcattatccccgccctcttcgagcctgagcgggaaaagtccgcggccattgatggggagtatagactgaaaggcgaaagccgcaagacatttgtcgagcttatgcggagaggagacctgcccgtgtggctcgctcacaaagttgcctctgaaggcatcaagtacaccgatcgcaaatggtgcttcgacgggcagcggaacaatcagatcctggaggagaacatggatgtggaaatttggacaaaggagggagagaagaagaagctgagaccgcgctggctcgacgctcggacgtattccgatcctcttgccctgaaagagtttaaggacttcgccgctggcagaaaaagcatcgcgctggatctcgtcaccgaaattgggcgcgtgccctctcacctggcccatagaacacggaatgctcttgacaacctggtcatgctccacacctccgagcatggaggcaaggcctaccgccacgccgtggaggaactgcctgagacaatggaaaccctgctccttctgggcctgatgatcctcctgacagggggagctatgctttttctgattagcggcaaagggatcggaaagacctccatcggcctcatttgtgttatcgcctctagcgggatgctgtggatggcggagattcccctgcaatggatcgcctccgctattgtgctcgagttctttatgatggtgcttctgatccctgaacccgagaagcagagaacaccgcaggataatcaactggcctatgtcgttattggaatcctcaccctggctgccatcattgcggccaacgaaatgggccttctggagacaaccaaacgggacctcggcatgagcaaggaacctggggtggtgtctcccacgtcctacctggatgtcgacctgcaccccgctagcgcctggacactctacgctgtggccaccacagttatcacccctatgcttcgccataccattgaaaattctacagctaacgtgagcctggccgcgatcgccaaccaggctgtcgtgctgatgggactcgacaaaggctggccgatttccaagatggatctgggggtcccccttctggccctcggatgctattctcaggtgaatcctctgacgctgaccgctgccgttctccttctgatcacacactacgccatcattggccccgggctgcaggcgaaagctaccagagaggcccaaaagcggacagctgccggaatcatgaagaaccctaccgtggacggcattatgacgatcgatctcgaccccgtcatttatgatagcaaattcgagaagcagctgggccaggtgatgcttctggttctctgtgccgtgcagctgctgctcatgagaacatcctgggctctttgcgaggccctgaccctggcgaccgggcctatcacaaccctctgggaaggatctccgggcaaattttggaatacaacgatcgccgtcagcatggctaacattttccgcgggtcctacctggccggagctggccttgcctttagcatcatgaagtctgtggggaccggaaaacggggcacaggctcccaaggggagaccctgggagaaaagtggaagaaaaagctcaatcagctgagcagaaaagagttcgacctgtataagaaatccggcattacagaggtggatcgcaccgaagcgaaggaggggctcaaacggggagaaatcacgcatcacgccgtttctagaggcagcgctaaacttcagtggtttgtcgagcggaacatggtgattcccgaagggcgcgtgatcgacctgggatgtggcagaggcgggtggtcctactattgcgccggactgaagaaagtcaccgaggttcggggctacacaaaagggggacctggccatgaggaacccgtgcctatgtctacctacgggtggaatattgtgaaactcatgagcggaaaggatgtcttctatctgcccccggagaaatgtgacacacttctgtgcgatatcggcgaatccagcccttctcccaccgtggaggagtcccgcacaatcagagttctcaagatggtggaaccctggctgaagaacaatcagttctgtattaaagtcctgaacccttacatgcccaccgtggttgagcacctcgaacggcttcaacgcaagcacggcgggatgctggtgagaaatcctctgagccggaactctacgcatgagatgtattggatctccaatggaacaggcaacattgtcgctagcgtgaatatggtgtctcgcctcctgcttaacagatttaccatgacccaccggagaccgacaatcgaaaaagacgtcgatctgggggccggaacgcgccatgttaacgctgagcccgagacccctaatatggacgtgattggcgaacggatcaagagaatcaaagaggaacacaacagcacatggcactacgacgatgagaatccctataagacctgggcctaccatgggtcctatgaagtgaaggcgacaggatctgccagctccatgattaacggcgtcgtgaaactcctgaccaagccttgggacgttgtgcccatggtcacacagatggctatgaccgatacgaccccgttcggccagcaacgcgtgtttaaagagaaggttgacacacggacccctagaagcatgcccgggacacgccgggtgatgggaatcaccgccgagtggctgtggagaacgctcggccgcaataaaaagcctcggctgtgcacaagagaagagttcaccaagaaagtccgcacaaacgctgccatgggggccgtgtttaccgaagagaatcagtgggattccgcgaaggctgccgttgaagacgaggatttctggaaacttgtggaccgggagagagaactgcacaagctcggaaaatgtggctcttgcgtctacaacatgatggggaagcgcgagaaaaagctgggcgaatttggaaaggccaaaggcagcagagctatttggtacatgtggcttggggcccggtatctggagttcgaggctctcggatttctgaatgaagatcattggttctcccgcgagaactcttacagcggcgtggaaggggagggactgcacaagctcggctatatcctgagagacatttccaaaatccccgggggcgccatgtacgcggatgacacggccggatgggacacccggatcacagaagatgaccttcataatgaggagaagattacccagcagatggatcctgaacacagacaactggctaacgccatctttaaactcacatatcagaataaggtcgtgaaggttcagcggcccaccccgacaggcaccgtgatggacattatctctcgcaaagatcagagagggagcggacaagtcggcacgtacgggctgaacacattcaccaatatggaggctcagcttattcggcagatggaaggagagggcgtgctgtccaaggccgacctcgaaaaccctcgcctgcccgagaaaaagatcacccagtggctggagacaaaaggggtggaaagactcaagcggatggcgatcagcggcgatgactgcgttgtgaagcccattgatgaccgctttgccaacgctctgcttgccctgaatgatatgggaaaagtcagaaaggacatccctcaatggcagccgtctaaaggctggcacgattggcaacaggtgcccttctgttcccatcacttccatgagctcattatgaaggacgggcggaaactggttgtgccttgccgcccccaagacgaacttatcggacgggctcggattagccagggcgccgggtggtctctgcgcgagaccgcttgtctcggaaaggcctatgcgcagatgtggtccctgatgtactttcacagacgggatctgcgcctcgccagcaacgctatctgctctgccgtccctgtgcactgggtccccacatccagaacgacctggagcattcatgcccaccatcaatggatgacaaccgaagacatgctgacagtgtggaatcgggtttggatcgaggataacccttggatggaggacaagacccccatcacgacctgggaaaatgtgccgtaccttggcaaaagagaggatcagtggtgtgggtccctgattggcctcacaagccgcgctacctgggcccagaacatccctacagcgattcagcaagtccggtctctgatcggaaatgaagagttccttgactatatgcccagcatgaagagatttcgcaaagaggaagagtccgaaggcgctatttggtga

SEQ ID NO: 20757 - RNA, 9873 nt, synthetic construct
  misc_feature 1..9873: note = derived and/or modified CDS sequence (opt5) from DENV-3__FJ639750__SS-prME
  source 1..9873: mol_type = other RNA
accagcctgtgcctcatgatgatcctgcccgccgctcttgccttccacctgacgtcccgggacggcgaacctcggatgattgtggggaagaacgaacgcggaaagtctctcctgtttaagacggcgagcggcatcaatatgtgtacccttattgctatggatctgggggagatgtgcgacgatacagtgacctacaaatgtccgcacatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacatcattggagtgctggagcagggcaaacggacgcttacccctcagcccatggagctgaagtactcttggaaaacatgggggaaggccaagatcgtcaccgccgaaacacaaaactccagcttcattatcgatggacctaatacccccgagtgcccgtctgcttccagagcgtggaacgtgtgggaagtggaggactatggctttggcgtcttcacaaccaatatctggctcaaactgcgcgaagtttacacgcagctgtgtgaccaccggcttatgagcgccgctgtgaaggatgagagagccgtgcacgccgacatggggtactggattgagtcccagaaaaacggatcttggaagctcgaaaaagctagcctgatcgaggtcaagacatgcacctggcctaagtcccataccctgtggtctaatggcgtgctcgaaagcgatatgattatccccaaatccctggccgggcctattagccagcacaactatcgccccggataccatacacaaaccgcgggcccttggcaccttgggaagctggagctcgactttaattattgcgagggaacgacagttgtgatcaccgaaaactgtggcacacggggcccctctctgagaaccacaaccgtctccgggaaactgatccacgagtggtgctgtcgcagctgcacgcttccgcctctccggtacatgggagaagatggctgttggtatgggatggagattagacccatctctgaaaaggaggagaatatggtgaaatccctggttagcgctggatctggcgaagtggacaacttcaccatgggggtcctgtgcctcgccattctgtttgaggaagtgatgcggggaaagttcggcaagaaacatatgatcgccggcgttttctttacattcgtgcttctgctcagcgggcagattacctggcgcgatatggctcacacactgatcatgattggatccaatgccagcgacagaatgggcatgggggtcacctacctggcgcttatcgctacgtttaagatccagcccttcctggccctcggatttttcctgcggaaactcacatctagagagaacctgcttctgggcgtggggctcgccatggctaccacactgcaactgcctgaagatattgagcagatggccaatggaatcgctcttggcctgatggccctcaagctgattacccagtttgagacctatcagctctggacagcgctgatctcccttacgtgtagcaacaccattttcacactgaccgtggcctggcgcacagctaccctcatcctggccggcgtctccctgcttccggtttgccaatctagctccatgcggaaaacggactggctgcccatgacagtggctgccatgggggtgcctcccctccctctgtttatcttctctctcaaggataccctgaagagacgcagctggccccttaatgaaggagtcatggccgtgggcctggtttccattctggcttctagcctcctgagaaacgacgtgcctatggcggggccccttgtcgccggaggcctgctcatcgcttgttacgtgattaccgggacatccgccgatctgaccgttgagaaagccgctgacgtgacatgggaagaggaagccgagcagacgggagtcagccataacctcatgatcaccgtggacgatgacggcacaatgcggattaaggatgacgagaccgaaaatatcctgacagtccttctgaaaaccgcgctgctcatcgtgtctggcatttttccgtactccatccctgctacgctgcttgtttggcacacctggcagaagcagacacaacgcagcggggtgctgtgggatgtcccctctcctcccgagacccagaaagccgaactcgaggagggagtgtatagaattaagcagcagggcatcttcgggaaaacacaagttggagtgggcgtccagaaggaaggggtgtttcataccatgtggcacgtgacacggggagccgttctgacgtacaacggcaagcgcctcgagccgaattgggcttccgtcaaaaaggacctgattagctatggcgggggatggagactttctgcccagtggcaaaaaggcgaagaggtccaggtgatcgcggtcgaacctgggaagaaccccaaaaatttccagaccatgcctggaacattccagaccaccacaggcgagattggggctatcgccctggattttaagcccggaacgtccggcagccccatcattaaccgggagggcaaggtggttgggctgtacggaaatggcgtggtcaccaaaaacgggggatatgtgtccggcatcgcccaaacaaatgctgaacctgacgggccgacccccgagctcgaagaggaaatgttcaagaaacgcaacctgacaattatggatcttcaccctggcagcggaaagaccagaaaatacctgcccgccatcgttcgggaggctattaagcgcagactccggacgctgatcctcgcccctacaagagtggtcgcggccgagatggaagaggctctgaagggccttcccatccgctatcagaccaccgccacaaaatctgaacataccgggcgggagattgtggacctgatgtgccacgctacatttaccatgagactgctcagccctgttcgcgtgccgaattacaacctgatcattatggatgaagcccatttcacggaccccgcctccatcgctgcgcggggatacatttctacaagagtcggcatgggggaggccgctgccatctttatgaccgccacacctcccggaaccgctgatgccttccctcagagcaatgcgcccatccaggacgaggaacgcgacattccggagcggtcctggaactctggcaatgaatggatcacggattttgctgggaagaccgtgtggttcgtgcctagcattaaagccggcaacgacatcgccaactgtcttagaaagaatggcaaaaaggtcattcaactgtcccgcaagacatttgataccgagtatcagaaaacaaagctcaacgactgggatttcgttgtgaccacagacatctctgagatgggagctaattttaaagccgatcgggtgattgaccccagacggtgcctgaagcccgtcatcctgaccgatgggcctgaacgcgtgatcctcgcgggacccatgcctgttacggccgctagcgccgctcagagacggggccgcgtggggagaaacccgcagaaagagaatgaccaatacattttcacaggacagccccttaacaatgatgaagaccacgcccattggaccgaggctaagatgctgctggacaacatcaatacccctgaaggcattatccccgccctcttcgagcctgagcgggaaaagtccgcggccattgatggggagtatagactgaaaggcgaaagccgcaagacatttgtcgagcttatgcggagaggagacctgcccgtgtggctcgctcacaaagttgcctctgaaggcatcaagtacaccgatcgcaaatggtgcttcgacgggcagcggaacaatcagatcctggaggagaacatggatgtggaaatttggacaaaggagggagagaagaagaagctgagaccgcgctggctcgacgctcggacgtattccgatcctcttgccctgaaagagtttaaggacttcgccgctggcagaaaaagcatcgcgctggatctcgtcaccgaaattgggcgcgtgccctctcacctggcccatagaacacggaatgctcttgacaacctggtcatgctccacacctccgagcatggaggcaaggcctaccgccacgccgtggaggaactgcctgagacaatggaaaccctgctccttctgggcctgatgatcctcctgacagggggagctatgctttttctgattagcggcaaagggatcggaaagacctccatcggcctcatttgtgttatcgcctctagcgggatgctgtggatggcggagattcccctgcaatggatcgcctccgctattgtgctcgagttctttatgatggtgcttctgatccctgaacccgagaagcagagaacaccgcaggataatcaactggcctatgtcgttattggaatcctcaccctggctgccatcattgcggccaacgaaatgggccttctggagacaaccaaacgggacctcggcatgagcaaggaacctggggtggtgtctcccacgtcctacctggatgtcgacctgcaccccgctagcgcctggacactctacgctgtggccaccacagttatcacccctatgcttcgccataccattgaaaattctacagctaacgtgagcctggccgcgatcgccaaccaggctgtcgtgctgatgggactcgacaaaggctggccgatttccaagatggatctgggggtcccccttctggccctcggatgctattctcaggtgaatcctctgacgctgaccgctgccgttctccttctgatcacacactacgccatcattggccccgggctgcaggcgaaagctaccagagaggcccaaaagcggacagctgccggaatcatgaagaaccctaccgtggacggcattatgacgatcgatctcgaccccgtcatttatgatagcaaattcgagaagcagctgggccaggtgatgcttctggttctctgtgccgtgcagctgctgctcatgagaacatcctgggctctttgcgaggccctgaccctggcgaccgggcctatcacaaccctctgggaaggatctccgggcaaattttggaatacaacgatcgccgtcagcatggctaacattttccgcgggtcctacctggccggagctggccttgcctttagcatcatgaagtctgtggggaccggaaaacggggcacaggctcccaaggggagaccctgggagaaaagtggaagaaaaagctcaatcagctgagcagaaaagagttcgacctgtataagaaatccggcattacagaggtggatcgcaccgaagcgaaggaggggctcaaacggggagaaatcacgcatcacgccgtttctagaggcagcgctaaacttcagtggtttgtcgagcggaacatggtgattcccgaagggcgcgtgatcgacctgggatgtggcagaggcgggtggtcctactattgcgccggactgaagaaagtcaccgaggttcggggctacacaaaagggggacctggccatgaggaacccgtgcctatgtctacctacgggtggaatattgtgaaactcatgagcggaaaggatgtcttctatctgcccccggagaaatgtgacacacttctgtgcgatatcggcgaatccagcccttctcccaccgtggaggagtcccgcacaatcagagttctcaagatggtggaaccctggctgaagaacaatcagttctgtattaaagtcctgaacccttacatgcccaccgtgatcgagcacctcgaacggcttcaacgcaagcacggcgggatgctggttagaaatcctctgagccggaactctacgcatgagatgtattggatttccaatggaacaggcaacatcgtggctagcgtcaatatggtgtctcgcctcctgcttaacagatttaccatgacccaccggagaccgacaattgaaaaagacgtggatctgggggccggaacgcgccatgtcaacgctgagcccgagacccctaatatggacgttatcggcgaacggatcaagagaattaaagaggaacacaacagcacatggcactacgacgatgagaatccctataagacctgggcctaccatgggtcctatgaagtgaaggcgacaggatctgccagctccatgatcaacggcgtggtcaaactcctgaccaagccttgggacgtggttcccatggtgacacagatggctatgaccgatacgaccccgttcggccagcaacgcgtctttaaagagaaggtggacacacggacccctagaagcatgcccgggacacgccgggttatgggaattaccgccgagtggctgtggagaacgctcggccgcaataaaaagcctcggctgtgcacaagagaagagttcaccaagaaagtgcgcacaaacgctgccatgggggccgtctttaccgaagagaatcagtgggattccgcgaaggctgccgtggaagacgaggatttctggaaacttgttgaccgggagagagaactgcacaagctcggaaaatgtggctcttgcgtgtacaacatgatggggaagcgcgagaaaaagctgggcgaatttggaaaggccaaaggcagcagagctatctggtacatgtggcttggggcccggtatctggagttcgaggctctcggatttctgaatgaagatcattggttctcccgcgagaactcttacagcggcgtcgaaggggagggactgcacaagctcggctatattctgagagacatctccaaaatccccgggggcgccatgtacgcggatgacacggccggatgggacacccggattacagaagatgaccttcataatgaggagaagatcacccagcagatggatcctgaacacagacaactggctaacgccatttttaaactcacatatcagaataaggtggtcaaggtgcagcggcccaccccgacaggcaccgttatggacatcatttctcgcaaagatcagagagggagcggacaagtgggcacgtacgggctgaacacattcaccaatatggaggctcagcttatccggcagatggaaggagagggcgtcctgtccaaggccgacctcgaaaaccctcatctgcccgagaaaaagatcacccagtggctggagacaaaaggggtggaacgcctcaagagaatggcgattagcggcgatgactgcgtggttaagcccatcgatgaccggtttgccaacgctctgcttgccctgaatgatatgggaaaagtgcgcaaggacattcctcaatggcagccgtctaaaggctggcatgattggcagcaggtccccttctgttcccaccatttccacgagctcatcatgaaggacgggagaaaactggtggttccttgccggccccaagacgaacttattggacgcgctagaatcagccagggcgccgggtggtctctgcgggagaccgcttgtctcggaaaggcctatgcgcagatgtggtccctgatgtactttcaccgcagagatctgcggctcgccagcaacgctatttgctctgccgtgcctgtccattgggtgcccacatcccgcacgacctggagcatccacgcccatcaccaatggatgacaaccgaagacatgctgacagtctggaatagagtgtggatcgaggataacccttggatggaggacaagacccccgttacgacctgggaaaatgtgccgtaccttggcaaacgggaggatcagtggtgtgggtccctgattggcctcacaagcagagctacctgggcccagaacatccctacagcgattcagcaagtccgctctctgatcggaaatgaagagttccttgactatatgcccagcatgaagcggtttagaaaagaggaagagtccgaaggcgctatttggtga

SEQ ID NO: 20758 - RNA, 9873 nt, synthetic construct
  misc_feature 1..9873: note = derived and/or modified CDS sequence (opt5) from DENV-3__FJ639754__SS-prME
  source 1..9873: mol_type = other RNA
accagcctgtgcctcatgatgatcctgcccgccgctcttgccttccacctgacgtcccgggacggcgagcctcggatgattgtggggaagaacgaacgcggaaagtctctcctgtttaagacggcgagcggcatcaatatgtgtacccttattgctatggatctgggggagatgtgcgacgatacagtgacctacaagtgtccgcacatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacatcattggagtgctggagcagggcaaacggacgcttacccctcagcccatggagctgaagtactcttggaaaacatgggggaaggccaagatcgtcaccgccgaaacacaaaactccagcttcattatcgatggacctaatacccccgagtgcccgtctgcttccagagcgtggaacgtgtgggaagtggaggactatggctttggcgtcttcacaaccaatatctggctcaaactgcgcgaagtttacacgcagctgtgtgaccaccggcttatgagcgccgctgtgaaggatgagagagccgtgcacgccgacatggggtactggattgagtcccagaaaaacggatcttggaagctcgaaaaagctagcctgatcgaggtcaagacatgcacctggcctaagtcccataccctgtggtctaatggcgtgctcgaaagcgatatgattatccccaaatccctggccgggcctattagccagcacaactatcgccccggataccatacacaaaccgcgggcccttggcaccttgggaagctggagctcgactttaattattgcgagggaacgacagttgtgatcaccgaaaactgtggcacacggggcccctctctgagaaccacaaccgtctccgggaaactgatccacgagtggtgctgtcgcagctgcacgcttccgcctctccggtacatgggagaagatggctgttggtatgggatggagattagacccatctctgaaaaggaggagaatatggtgaaatccctggttagcgctggatctggcgaagtggacaacttcaccatgggggtcctgtgcctcgccattctgtttgaggaagtgatgcggggaaagttcggcaagaaacatatgatcgccggcgttttctttacattcgtgcttctgctcagcgggcagattacctggcgcgatatggctcacacactgatcatgattggatccaatgccagcgacagaatgggcatgggggtcacctacctggcgcttatcgctacgtttaagatccagcccttcctggccctcggatttttcctgcggaaactcacatctagagagaacctgcttctgggcgtggggctcgccatggctaccacactgcaactgcctgaagatattgagcagatggccaatggaatcgctcttggcctgatggccctcaagctgattacccagtttgagacctatcagctctggacagcgctgatctcccttacgtgtagcaacaccattttcacactgaccgtggcctggcgcacagctaccctcatcctggccggcgtctccctgcttccggtttgccaatctagctccatgcggaaaacggactggctgcccatgacagtggctgccatgggggtgcctcccctccctctgtttatcttctctctcaaggataccctgaagagacgcagctggccccttaatgaaggagtcatggccgtgggcctggtttccattctggcttctagcctcctgagaaacgacgtgcctatggcggggccccttgtcgccggaggcctgctcatcgcttgttacgtgattaccgggacatccgccgatctgaccgttgagaaagccgctgacgtgacatgggaagaggaagccgagcagacgggagtcagccataacctcatgatcaccgtggacgatgacggcacaatgcggattaaggatgacgagaccgaaaatatcctgacagtccttctgaaaaccgcgctgctcatcgtgtctggcatttttccgtactccatccctgctacgctgcttgtttggcacacctggcagaagcagacacaacgcagcggggtgctgtgggatgtcccctctcctcccgagacccagaaagccgaactcgaggagggagtgtatagaattaagcagcagggcatcttcgggaaaacacaagttggagtgggcgtccagaaggaaggggtgtttcataccatgtggcacgtgacacggggagccgttctgacgtacaacggcaagcgcctcgagccgaattgggcttccgtcaaaaaggacctgattagctatggcgggggatggagactttctgcccagtggcaaaaaggcgaagaggtccaggtgatcgcggtcgaacctgggaagaaccccaaaaatttccagaccatgcctggaacattccagaccaccacaggcgagattggggctatcgccctggattttaagcccggaacgtccggcagccccatcattaaccgggagggcaaggtggttgggctgtacggaaatggcgtggtcaccaaaaacgggggatatgtgtccggcatcgcccaaacaaatgctgaacctgacgggccgacccccgagctcgaagaggaaatgttcaagaaacgcaacctgacaattatggatcttcaccctggcagcggaaagaccagaaaatacctgcccgccatcgttcgggaggctattaagcgcagactccggacgctgatcctcgcccctacaagagtggtcgcggccgagatggaagaggctctgaagggccttcccatccgctatcagaccaccgccacaaaatctgaacataccgggcgggagattgtggacctgatgtgccacgctacatttaccatgagactgctcagccctgttcgcgtgccgaattacaacctgatcattatggatgaagcccatttcacggaccccgcctccatcgctgcgcggggatacatttctacaagagtcggcatgggggaggccgctgccatctttatgaccgccacacctcccggaaccgctgatgccttccctcagagcaatgcgcccatccaggacgaggaacgcgacattccggagcggtcctggaactctggcaatgaatggatcacggattttgctgggaagaccgtgtggttcgtgcctagcattaaagccggcaacgacatcgccaactgtcttagaaagaatggcaaaaaggtcattcaactgtcccgcaagacatttgataccgagtatcagaaaacaaagctcaacgactgggatttcgttgtgaccacagacatctctgagatgggagctaattttaaagccgatcgggtgattgaccccagacggtgcctgaagcccgtcatcctgaccgatgggcctgaacgcgtgatcctcgcgggacccatgcctgttacggccgctagcgccgctcagagacggggccgcgtggggagaaacccgcagaaagagaatgaccaatacattttcacaggacagccccttaacaatgatgaagaccacgcccattggaccgaggctaagatgctgctggacaacatcaatacccctgaaggcattatccccgccctcttcgagcctgagcgggaaaagtccgcggccattgatggggagtatagactgaaaggcgaaagccgcaagacatttgtcgagcttatgcggagaggagacctgcccgtgtggctcgctcacaaagttgcctctgaaggcatcaagtacaccgatcgcaaatggtgcttcgacgggcagcggaacaatcagatcctggaggagaacatggatgtggaaatttggacaaaggagggagagaagaagaagctgagaccgcgctggctcgacgctcggacgtattccgatcctcttgccctgaaagagtttaaggacttcgccgctggcagaaaaagcatcgcgctggatctcgtcaccgaaattgggcgcgtgccctctcacctggcccatagaacacggaatgctcttgacaacctggtcatgctccacacctccgagcatggaggcaaggcctaccgccacgccgtggaggaactgcctgagacaatggaaaccctgctccttctgggcctgatgatcctcctgacagggggagctatgctttttctgattagcggcaaagggatcggaaagacctccatcggcctcatttgtgttatcgcctctagcgggatgctgtggatggcggagattcccctgcaatggatcgcctccgctattgtgctcgagttctttatgatggtgcttctgatccctgaacccgagaagcagagaacaccgcaggataatcaactggcctatgtcgttattggaatcctcaccctggctgccatcattgcggccaacgaaatgggccttctggagacaaccaaacgggacctcggcatgagcaaggaacctggggtggtgtctcccacgtcctacctggatgtcgacctgcaccccgctagcgcctggacactctacgctgtggccaccacagttatcacccctatgcttcgccataccattgaaaattctacagctaacgtgagcctggccgcgatcgccaaccaggctgtcgtgctgatgggactcgacaaaggctggccgatttccaagatggatctgggggtcccccttctggccctcggatgctattctcaggtgaatcctctgacgctgaccgctgccgttctccttctgatcacacactacgccatcattggccccgggctgcaggcgaaagctaccagagaggcccaaaagcggacagctgccggaatcatgaagaaccctaccgtggacggcattatgacgatcgatctcgaccccgtcatttatgatagcaaattcgagaagcagctgggccaggtgatgcttctggttctctgtgccgtgcagctgctgctcatgagaacatcctgggctctttgcgaggccctgaccctggcgaccgggcctatcacaaccctctgggaaggatctccgggcaaattttggaatacaacgatcgccgtcagcatggctaacattttccgcgggaattacctggccggagctggccttgccttttccatcatgaaaagcgtggggaccggaaaacggggcacaggctctcaaggggagaccctgggagaaaagtggaagaaaaagctcaaccagctgtccagaaaagagttcgacctgtataagaaaagcggcattacagaggtggatcgcaccgaagcgaaggaggggctcaaacggggagaaatcacgcatcacgccgtttccagaggctctgctaaacttcagtggtttgtcgagcggaatatggtgattcccgaagggcgcgtgatcgacctgggatgtggcagaggcgggtggagctactattgcgccggactgaagaaagtcaccgaggttcggggctacacaaaagggggacctggccatgaggaacccgtgcctatgtccacctacgggtggaacattgtgaaactcatgtctggaaaggatgtcttctatctgcccccggagaaatgtgacacacttctgtgcgatatcggcgaaagctcccctagccccaccgtggaggagtctcgcacaatcagagttctcaagatggtggaaccctggctgaagaataaccagttctgtattaaagtcctgaatccttacatgcccaccgtgatcgagcacctcgaacggcttcaacgcaagcacggcgggatgctggttagaaaccctctgtcccggaatagcacgcatgagatgtattggatttctaacggaacaggcaatatcgtggcttccgtcaacatggtgagccgcctcctgcttaacagatttaccatgacccaccggagaccgacaattgaaaaagacgtggatctgggggccggaacgcgccatgtcaatgctgagcccgagacccctaacatggacgttatcggcgaacggatcaagagaattaaagaggaacacaattctacatggcactacgacgatgagaacccctataagacctgggcctaccatgggagctatgaagtgaaggcgacaggatccgcctctagcatgatcaatggcgtggtcaaactcctgaccaagccttgggacgtggttcccatggtgacacagatggctatgaccgatacgaccccgttcggccagcaacgcgtctttaaagagaaggtggacacacggacccctagatccatgcccgggacacgccgggttatgggaattaccgccgagtggctgtggagaacgctcggccgcaacaaaaagcctcggctgtgcacaagagaagagttcaccaagaaagtgcgcacaaatgctgccatgggggccgtctttaccgaagagaaccagtgggatagcgcgaaggctgccgtggaagacgaggatttctggaaacttgttgaccgggagagagaactgcacaagctcggaaaatgtggctcctgcgtgtacaatatgatggggaagcgcgagaaaaagctgggcgaatttggaaaggccaaaggctctagagctatctggtacatgtggcttggggcccggtatctggagttcgaggctctcggatttctgaacgaagatcattggttcagccgcgaaaattcctactctggcgtcgaaggggagggactgcacaagctcggctatattctgagagacatcagcaaaatccccgggggcgccatgtacgcggatgacacggccggatgggacacccggattacagaagatgaccttcataacgaggagaagatcacccagcagatggatcctgaacacagacaactggctaatgccatttttaaactcacatatcagaacaaggtggtcaaggtgcagcggcccaccccgacaggcaccgttatggacatcatttcccgcaaagatcagagagggtctggacaagtgggcacgtacgggctgaatacattcaccaacatggaggctcagcttatccggcagatggaaggagagggcgtcctgagcaaggccgacctcgaaaaccctcatctgcccgagaaaaagatcacccagtggctggagacaaaaggggtggaacgcctcaagagaatggcgatttccggcgatgactgcgtggttaagcccatcgatgaccggtttgccaatgctctgcttgccctgaacgatatgggaaaagtgcgcaaggacattcctcaatggcagccgagcaaaggctggcatgattggcagcaggtccccttctgttctcaccatttccacgagctcatcatgaaggacgggagaaaactggtggttccttgccggccccaagacgaacttattggacgcgctagaatctcccagggcgccgggtggagcctgcgggagaccgcttgtctcggaaaggcctatgcgcagatgtggtctctgatgtactttcaccgcagagatctgcggctcgcctccaatgctatttgcagcgccgtgcctgtccattgggtgcccacatctcgcacgacctggtccatccacgcccatcaccaatggatgacaaccgaagacatgctgacagtctggaacagagtgtggatcgaggataatccttggatggaggacaagacccccgttacgacctgggaaaacgtgccgtaccttggcaaacgggaggatcagtggtgtgggagcctgattggcctcacatccagagctacctgggcccagaatatccctacagcgattcagcaagtccgcagcctgatcggaaacgaagagttccttgactatatgccctctatgaagcggtttagaaaagaggaagagagcgaaggcgctatttggtga

SEQ ID NO: 20759 - RNA, 9873 nt, synthetic construct
  misc_feature 1..9873: note = derived and/or modified CDS sequence (opt5) from DENV-3__FJ639757__SS-prME
  source 1..9873: mol_type = other RNA
accagcctgtgcctcatgatgatcctgcccgccgctcttgccttccacctgacatcccgggacggcgaacctcggatgattgtggggaagaacgaacgcggaaaatctctcctgtttaagacggcgagcggcatcaatatgtgtacccttattgctatggatctgggggagatgtgcgacgatacagtgacctacaaatgtccgcacatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggatacccggacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgattctgccctgaaaatcaactggtataagaagggaagctccattggcaaaatgtttgaagccacggctagaggggccagacgcatggctatccttggagacacagcctgggatttcggcagcgttgggggagtcctcaattctctgggcaagatggtgcaccagatttttgggtccgcgtacaccgccctgttcagcggcgtgtcttgggtcatgaaaatcggaattggcgtgctcctgacctggatcgggcttaacagcaagaatacatccatgtcttttagctgcattgctatcggaatcattaccctgtatctcggcgccgttgtgcaggctgacatggggtgtgtcatcaactggaaaggaaaggagctgaagtgcggctccgggattttcgtgacaaatgaggttcatacgtggaccgaacagtacaaatttcaagccgatagccccaagcggctggcgacagccatcgctggcgcctgggagaacggagtgtgtggcattagatctaccacacgcatggaaaatcttctctggaaacagatcgctaacgagctgaattatatcctgtgggaaaacaatattaagctcaccgtcgtggttggggacatcattggagtgctggagcagggcaaacggacgcttacccctcagcccatggagctgaagtactcctggaaaacatgggggaaggccaagatcgtcaccgccgaaacacaaaacagctctttcattatcgatggacctaacacccccgagtgcccgtccgctagcagagcgtggaatgtgtgggaagtggaggactatggctttggcgtcttcacaaccaacatctggctcaaactgcgcgaagtttacacgcagctgtgtgaccaccggcttatgtccgccgctgtgaaggatgagagagccgtgcacgccgacatggggtactggattgagtctcagaaaaatggaagctggaagctcgaaaaggcttccctgatcgaggtcaagacatgcacctggcctaagtctcataccctgtggagcaacggcgtgctcgaatccgatatgattatccccaaaagcctggccgggcctatttctcagcacaattatcgccccggataccatacacaaaccgcgggcccttggcaccttgggaagctggagctcgactttaactattgcgagggaacgacagttgtgatcaccgaaaattgtggcacacggggcccctccctgagaaccacaaccgtcagcgggaaactgatccacgagtggtgctgtcgctcttgcacgcttccgcctctccggtacatgggagaagatggctgttggtatgggatggagattagacccatctccgaaaaggaggagaacatggtgaaaagcctggtttctgctggaagcggcgaagtggacaatttcaccatgggggtcctgtgcctcgccattctgtttgaggaagtgatgcggggaaagttcggcaagaaacatatgatcgccggcgttttctttacattcgtgcttctgctctccgggcagattacctggcgcgatatggctcacacactgatcatgattggaagcaacgcctctgacagaatgggcatgggggtcacctacctggcgcttatcgctacgtttaagatccagcccttcctggccctcggatttttcctgcggaaactcacatccagagagaatctgcttctgggcgtggggctcgccatggctaccacactgcaactgcctgaagatattgagcagatggccaacggaatcgctcttggcctgatggccctcaagctgattacccagtttgagacctatcagctctggacagcgctgatcagccttacgtgttccaataccattttcacactgaccgtggcctggcgcacagctaccctcatcctggccggcgtctctctgcttccggtttgccaaagctcctctatgcggaaaacggactggctgcccatgacagtggctgccatgggggtgcctcccctccctctgtttatcttcagcctcaaggataccctgaagagacgctcctggccccttaacgaaggagtcatggccgtgggcctggtttctattctggctagctccctcctgagaaatgacgtgcctatggcggggccccttgtcgccggaggcctgctcatcgcttgttacgtgattaccgggacaagcgccgatctgaccgttgagaaagccgctgacgtgacatgggaagaggaagccgagcagacgggagtctctcataacctcatgatcaccgtggacgatgacggcacaatgcggattaaggatgacgagaccgaaaacatcctgacagtccttctgaaaaccgcgctgctcatcgtgtccggcatttttccgtacagcatccctgctacgctgcttgtttggcacacctggcagaagcagacacaacgctctggggtgctgtgggatgtcccctcccctcccgagacccagaaagccgaactcgaggagggagtgtatagaattaagcagcagggcatcttcgggaaaacacaagttggagtgggcgtccagaaggaaggggtgtttcataccatgtggcacgtgacacggggagccgttctgacgtacaatggcaagcgcctcgagccgaactgggctagcgtcaaaaaggacctgatttcttatggcgggggatggagactttccgcccagtggcaaaaaggcgaagaggtccaggtgatcgcggtcgaacctgggaagaatcccaaaaacttccagaccatgcctggaacattccagaccaccacaggcgagattggggctatcgccctggattttaagcccggaacgagcggctcccccatcattaatcgggagggcaaggtggttgggctgtacggaaacggcgtggtcaccaaaaatgggggatatgtgagcggcatcgcccaaacaaacgctgaacctgacgggccgacccccgagctcgaagaggaaatgttcaagaaacgcaatctgacaattatggatcttcaccctggctctggaaagaccagaaaatacctgcccgccatcgttcgggaggctattaagcgcagactccggacgctgatcctcgcccctacaagagtggtcgcggccgagatggaagaggctctgaagggccttcccatccgctatcagaccaccgccacaaaaagcgaacataccgggcgggagattgtggacctgatgtgccacgctacatttaccatgagactgctctcccctgttcgcgtgccgaactacaatctgatcattatggatgaagcccatttcacggaccccgcctctatcgctgcgcggggatacattagcacaagagtcggcatgggggaggccgctgccatctttatgaccgccacacctcccggaaccgctgatgccttccctcagtccaacgcgcccatccaggacgaggaacgcgacattccggagcggtcttggaatagcggcaacgaatggatcacggattttgctgggaagaccgtgtggttcgtgccttccattaaagccggcaatgacatcgccaactgtcttagaaagaacggcaaaaaggtcattcaactgtctcgcaagacatttgataccgagtatcagaaaacaaagctcaatgactgggatttcgttgtgaccacagacatcagcgagatgggagctaactttaaagccgatcgggtgattgaccccagacggtgcctgaagcccgtcatcctgaccgatgggcctgaacgcgtgatcctcgcgggacccatgcctgttacggccgcttccgccgctcagagacggggccgcgtggggagaaatccgcagaaagagaacgaccaatacattttcacaggacagccccttaataacgatgaagaccacgcccattggaccgaggctaagatgctgctggacaatatcaacacccctgaaggcattatccccgccctcttcgagcctgagcgggaaaagagcgcggccattgatggggagtatagactgaaaggcgaatctcgcaagacatttgtcgagcttatgcggagaggagacctgcccgtgtggctcgctcacaaagttgcctccgaaggcatcaagtacaccgatcgcaaatggtgcttcgacgggcagcggaataaccagatcctggaggagaatatggatgtggaaatttggacaaaggagggagagaagaagaagctgagaccgcgctggctcgacgctcggacgtatagcgatcctcttgccctgaaagagtttaaggacttcgccgctggcagaaaatctatcgcgctggatctcgtcaccgaaattgggcgcgtgcccacacacctggcccatagaacccggaacgctcttgacaatctggtcatgctccacacatccgagcatggaggcaaggcctaccgccacgccgtggaggaactgcctgagaccatggaaacgctgctccttctgggcctgatgatcctcctgaccgggggagctatgctttttctgattagcggcaaagggatcggaaagacatccatcggcctcatttgtgttatcgcctctagcgggatgctgtggatggcggagattcccctgcaatggatcgcctccgctattgtgctcgagttctttatgatggtgcttctgatccctgaacccgagaagcagagaaccccgcaggataaccaactggcctatgtcgttattggaatcctcacactggctgccatcattgcggccaatgaaatgggccttctggagaccacgaaacgggacctcggcatgagcaaggaacctggggtggtgtctcccacatcctacctggatgtcgacctgcaccccgctagcgcctggaccctctacgctgtggccacaaccgttatcacccctatgcttcgccatacaattgagaactctacggctaatgtgagcctggccgcgatcgccaaccaggctgtcgtgctgatgggactcgacaaaggctggccgatttccaagatggatctgggggtcccccttctggccctcggatgctattctcaggtgaaccctctgaccctgacagctgccgttctccttctgatcacccactacgccatcattggccccgggctgcaggcgaaagctacaagagaggcccaaaagcggaccgctgccggaatcatgaagaatcctacggtggacggcattatgacaatcgatctcgaccccgtcatttatgatagcaaattcgaaaagcagctgggccaggtgatgcttctggttctctgtgccgtgcagctgctgctcatgagaacctcctgggctctttgcgaggccctgaccctggcgacagggcctatcaccacactctgggaaggatctccgggcaaattttggaacacgaccatcgccgtcagcatggctaatattttccgcgggtcctacctggccggagctggccttgcctttagcatcatgaagtctgtggggacaggaaaacggggcaccggctcccaaggggagacactgggagaaaagtggaagaaaaagctcaaccagctgagcagaaaagagttcgacctgtataagaaatccggcattaccgaggtggatcgcacggaagcgaaggaggggctcaaacggggagaaatcacccatcacgccgtttctagaggcagcgctaaacttcagtggtttgtcgagcggaatatggtgattcccgaagggcgcgtgatcgacctgggatgtggcagaggcgggtggtcctactattgcgccggactgaagaaagtcacagaggttcggggctacaccaaagggggacctggccatgaggaacccgtgcctatgtctacatacgggtggaacattgtgaaactcatgagcggaaaggatgtcttctatctgcccccggagaaatgtgacacccttctgtgcgatatcggcgaatccagcccttctcccacagtggaggagtcccgcaccatcagagttctcaagatggtggaaccctggctgaagaataaccagttctgtattaaagtcctgaatccttacatgcccacggtgatcgagcacctcgaacggcttcaacgcaagcacggcgggatgctggttagaaaccctctgagcagaaattctacacatgagatgtattggatttccaacggaaccggcaatatcgtggctagcgtcaacatggtgtctcgcctcctgcttaatagatttaccatgacacaccggagaccgacgattgaaaaagacgtggatctgggggccggaacccgccatgtcaacgctgagcccgagacacctaacatggacgttatcggcgaacggatcaagagaattaaagaggaacacaatagcacctggcactacgacgatgagaacccctataagacatgggcctaccatgggtcctatgaagtgaaggcgaccggatctgccagctccatgatcaatggcgtggtcaaactcctgacaaagccttgggacgtggttcccatggtgacccagatggctatgacggataccacaccgttcggccagcaacgcgtctttaaagagaaggtggacacccggacacctagaagcatgcccgggacccgccgggttatgggaattacggccgagtggctgtggagaacactcggccgcaacaaaaagcctcggctgtgcaccagagaagagttcacaaagaaagtgcgcaccaatgctgccatgggggccgtctttacggaagagaaccagtgggattccgcgaaggctgccgtggaagacgaggatttctggaaacttgttgaccgggagagagaactgcacaagctcggaaaatgtggctcttgcgtgtacaatatgatggggaagcgcgagaaaaagctgggcgaatttggaaaggccaaaggcagcagagctatctggtacatgtggcttggggcccggtatctggagttcgaggctctcggatttctgaacgaagatcattggttctcccgcgaaaattcttacagcggcgtcgagggggagggactgcacaagctcggctatattctgagagacatctccaaaatccccgggggcgccatgtacgcggatgacaccgccggatgggacacacggattaccgaagatgaccttcataacgaggagaagatcacacagcagatggatcctgaacacagacaactggctaatgccatttttaaactcacctatcagaacaaggtggtcaaggtgcagcggcccacaccgaccggcacggttatggacatcatttctcgcaaagatcagagagggagcggacaagtgggcacatacgggctgaataccttcaccaacatggaggctcagcttatccggcagatggaaggagagggcgtcctgtccaaggccgacctcgaaaatcctcatctgcccgagaaaaagatcacacagtggctggagaccaaaggggtggaacgcctcaagagaatggcgattagcggcgatgactgcgtggttaagcccatcgatgaccggtttgccaacgctctgcttgccctgaacgatatgggaaaagtgcgcaaggacattcctcaatggcagccgtctaaaggctggcatgattggcagcaggtccccttctgttcccaccatttccacgagctcatcatgaaggacgggagaaaactggtggttccttgccggccccaagacgaacttattggacgcgctagaatcagccagggcgccgggtggtctctgcgggagacagcttgtctcggaaaggcctatgcgcagatgtggtccctgatgtactttcaccgcagagatctgcggctcgccagcaatgctatttgctctgccgtgcctgtccattgggtgcccacgtcccgcaccacatggagcatccacgcccatcaccaatggatgaccacagaagacatgctgaccgtctggaacagagtgtggatcgaggataatccttggatggaggacaagacgcccgttaccacatgggaaaacgtgccgtaccttggcaaacgggaggatcagtggtgtgggtccctgattggcctcaccagcagagctacatgggcccagaatatccctaccgcgattcagcaagtccgctctctgatcggaaacgaagagttccttgactatatgcccagcatgaagcggtttagaaaagaggaagagtccgaaggcgctatttggtga

SEQ ID NO: 20760 - RNA, 9873 nt, synthetic construct
  misc_feature 1..9873: note = derived and/or modified CDS sequence (opt5) from DENV-3__FJ639758__SS-prME
  source 1..9873: mol_type = other RNA
accagcctgtgcctcatgatgatcctgcccgccgctcttgccttccacctgacgtcccgggacggagaacctcggatgattgtggggaagaacgaacgcggaaagtctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacgtgatcggagtcctggagcagggcaaacggacgcttacccctcagcccatggagctgaagtactcttggaaaacatgggggaaggccaagattgtgaccgccgaaacacaaaactccagcttcatcattgatggacctaatacccccgagtgcccgtctgcttccagagcgtggaacgtgtgggaagtcgaggactatggctttggcgttttcacaaccaatatctggctcaaactgcgcgaagtgtacacgcagctgtgtgaccaccggcttatgagcgccgctgtgaaggatgagagagccgtccacgccgacatggggtactggatcgagtcccagaaaaacggatcttggaagctcgaaaaagctagcctgattgaggtgaagacatgcacctggcctaagtcccataccctgtggtctaatggcgttctcgaaagcgatatgatcattcccaaatccctggccgggcctatcagccagcacaactatcgccccggataccatacacaaaccgcgggcccttggcaccttgggaagctggagctcgactttaattattgcgagggaacgacagtggtcattaccgaaaactgtggcacacggggcccctctctgagaaccacaaccgtgtccgggaaactgatccacgagtggtgctgtcgcagctgcacgcttccgcctctccggtacatgggagaagatggctgttggtatgggatggagatcagacccatttctgaaaaggaggagaatatggttaaatccctggtgagcgctggatctggcgaagtcgacaacttcaccatgggggtgctgtgcctcgccatcctgtttgaggaagttatgcggggaaagttcggcaagaaacatatgattgccggcgtgttctttacattcgtccttctgctcagcgggcagatcacctggcgcgatatggctcacacactgattatgatcggatccaatgccagcgacagaatgggcatgggggtgacctacctggcgcttattgctacgtttaagatccagcccttcctggccctcggatttttcctgcggaaactcacatctagagagaacctgcttctgggcgtggggctcgccatggctaccacactgcaactgcctgaagatatcgagcagatggccaatggaattgctcttggcctgatggccctcaagctgatcacccagtttgagacctatcagctctggacagcgctgatttcccttacgtgtagcaacaccatcttcacactgaccgtcgcctggcgcacagctaccctcattctggccggcgtttccctgcttccggtgtgccaatctagctccatgcggaaaacggactggctgcccatgacagtggctgccatgggggtccctcccctccctctgtttatcttctctctcaaggataccctgaagagacgcagctggccccttaatgaaggagtgatggccgttggcctggtgtccatcctggcttctagcctcctgagaaacgacgtccctatggcggggccccttgtggccggaggcctgctcattgcttgttacgttatcaccgggacatccgccgatctgaccgtggagaaagccgctgacgtcacatgggaagaggaagccgagcagacgggagtgagccataacctcatgattaccgtcgacgatgacggcacaatgcggatcaaggatgacgagaccgaaaatattctgacagtgcttctgaaaaccgcgctgctcatcgtttctggcatctttccgtactccattcctgctacgctgcttgtgtggcacacctggcagaagcagacacaacgcagcggggtcctgtgggatgtgccctctcctcccgagacccagaaagccgaactcgaggagggagtttatagaatcaagcagcagggcattttcgggaaaacacaagtgggagtcggcgtgcagaaggaaggggtgtttcataccatgtggcacgttacacggggagccgtcctgacgtacaacggcaagcgcctcgagccgaattgggcttccgtgaaaaaggacctgatcagctatggcgggggatggagactttctgcccagtggcaaaaaggcgaagaggtgcaggtcattgcggtggaacctgggaagaaccccaaaaatttccagaccatgcctggaacattccagaccaccacaggcgagatcggggctattgccctggattttaagcccggaacgtccggcagccccatcatcaaccgggagggcaaggttgtggggctgtacggaaatggcgtcgtgaccaaaaacgggggatatgtttccggcattgcccaaacaaatgctgaacctgacgggccgacccccgagctcgaagaggaaatgttcaagaaacgcaacctgacaatcatggatcttcaccctggcagcggaaagaccagaaaatacctgcccgccattgtgcgggaggctatcaagcgcagactccggacgctgattctcgcccctacaagagtcgtggcggccgagatggaagaggctctgaagggccttcccatccgctatcagaccaccgccacaaaatctgaacataccgggcgggagatcgttgacctgatgtgccacgctacatttaccatgagactgctcagccctgtgcgcgtcccgaattacaacctgattatcatggatgaagcccatttcacggaccccgcctccattgctgcgcggggatacatctctacaagagtgggcatgggggaggccgctgccatttttatgaccgccacacctcccggaaccgctgatgccttccctcagagcaatgcgcccatccaggacgaggaacgcgacatcccggagcggtcctggaactctggcaatgaatggattacggattttgctgggaagaccgtgtggttcgtccctagcatcaaagccggcaacgacattgccaactgtcttagaaagaatggcaaaaaggttatccaactgtcccgcaagacatttgataccgagtatcagaaaacaaagctcaacgactgggatttcgtggtgaccacagacatttctgagatgggagctaattttaaagccgatcgggtcatcgaccccagacggtgcctgaagcccgtgattctgaccgatgggcctgaacgcgttatcctcgcgggacccatgcctgtgacggccgctagcgccgctcagagacggggccgcgtcgggagaaacccgcagaaagagaatgaccaatacatcttcacaggacagccccttaacaatgatgaagaccacgcccattggaccgaggctaagatgctgctggacaacattaatacccctgaaggcatcattcccgccctcttcgagcctgagcgggaaaagtccgcggccatcgatggggagtatagactgaaaggcgaaagccgcaagacatttgtggagcttatgcggagaggagacctgcccgtttggctcgctcacaaagtggcctctgaaggcattaagtacaccgatcgcaaatggtgcttcgacgggcagcggaacaatcagatcctggaggagaacatggatgtcgaaatctggacaaaggagggagagaagaagaagctgagaccgcgctggctcgacgctcggacgtattccgatcctcttgccctgaaagagtttaaggacttcgccgctggcagaaaaagcattgcgctggatctcgtgaccgaaatcgggcgcgtcccctctcacctggcccatagaacacggaatgctcttgacaacctggtgatgctccacacctccgagcatggaggcaaggcctaccgccacgccgttgaggaactgcctgagacaatggaaaccctgctccttctgggcctgatgattctcctgacagggggagctatgctttttctgatcagcggcaaagggattggaaagacctccatcggcctcatctgtgtgattgcctctagcgggatgctgtggatggcggagatccccctgcaatggattgcctccgctatcgtgctcgagttctttatgatggtccttctgattcctgaacccgagaagcagagaacaccgcaggataatcaactggcctatgttgtgatcggcattctcaccctggctgccatcatcgcggccaacgaaatgggccttctggagacaaccaaacgggacctcggcatgagcaaggaacctggggtggtctctcccacgtcctacctggatgtggacctgcaccccgctagcgcctggacactctacgctgttgccaccacagtgattacccctatgcttcgccataccatcgaaaattctacagctaacgtcagcctggccgcgattgccaaccaggctgtggtcctgatgggactcgacaaaggctggccgatctccaagatggatctgggggtgccccttctggccctcggatgctattctcaggttaatcctctgacgctgaccgctgccgtgctccttctgattacacactacgccatcatcggccccgggctgcaggcgaaagctaccagagaggcccaaaagcggacagctgccggaattatgaagaaccctaccgtcgacggcatcatgacgattgatctcgaccccgtgatctatgatagcaaattcgagaagcagctgggccaggttatgcttctggtgctctgtgccgtccagctgctgctcatgagaacatcctgggctctttgcgaggccctgaccctggcgaccgggcctattacaaccctctgggaaggatctccgggcaaattttggaatacaacgatcgccgtgagcatggctaacatcttccgcgggtcctacctggccggagctggccttgcctttagcattatgaagtctgtggggaccggaaaacggggcacaggctcccaaggggagaccctgggagaaaagtggaagaaaaagctcaatcagctgagcagaaaagagttcgacctgtataagaaatccggcatcacagaggttgatcgcaccgaagcgaaggaggggctcaaacggggagaaattacgcatcacgccgtctctagaggcagcgctaaacttcagtggtttgtggagcggaacatggtgatccccgaagggcgcgtcattgacctgggatgtggcagaggcgggtggtcctactattgcgccggactgaagaaagttaccgaggtgcggggctacacaaaagggggacctggccatgaggaacccgtgcctatgtctacctacgggtggaatatcgtcaaactcatgagcggaaaggatgtgttctatctgcccccggagaaatgtgacacacttctgtgcgatattggcgaatccagcccttctcccaccgttgaggagtcccgcacaatcagagtgctcaagatggtcgaaccctggctgaagaacaatcagttctgtatcaaagtgctgaacccttacatgcccaccgttgtggagcacctcgaacggcttcaacgcaagcacggcgggatgctggtcagaaatcctctgagccggaactctacgcatgagatgtattggatttccaatggaacaggcaacatcgtggctagcgtgaatatggtctctcgcctcctgcttaacagatttaccatgacccaccggagaccgacaattgaaaaagacgttgatctgggggccggaacgcgccatgtgaacgctgagcccgagacccctaatatggacgtgatcggcgaacggattaagagaatcaaagaggaacacaacagcacatggcactacgacgatgagaatccctataagacctgggcctaccatgggtcctatgaagtcaaggcgacaggatctgccagctccatgatcaacggcgtggttaaactcctgaccaagccttgggacgtggtccccatggtgacacagatggctatgaccgatacgaccccgttcggccagcaacgcgtttttaaagagaaggtggacacacggacccctagaagcatgcccgggacacgccgggtcatgggaattaccgccgagtggctgtggagaacgctcggccgcaataaaaagcctcggctgtgcacaagagaagagttcaccaagaaagtgcgcacaaacgctgccatgggggccgtttttaccgaagagaatcagtgggattccgcgaaggctgccgtggaagacgaggatttctggaaacttgtcgaccgggagagagaactgcacaagctcggacgctgtggctcttgcgtgtacaacatgatggggaaaagagagaagaaactgggcgaatttggaaaggccaagggcagccgggctatctggtacatgtggcttggggcccgctatctggagttcgaggctctcggatttctgaatgaagatcattggttctccagagagaactcttacagcggcgtcgaaggggagggactgcacaaactcggctatattctgcgggacatctccaagattcccgggggcgccatgtacgcggatgacacggccggatgggacaccagaatcacagaagatgaccttcataatgaggagaaaatcacccagcagatggatcctgaacaccggcaactggctaacgccatttttaagctcacatatcagaataaagtggttaaggtgcagcgccccaccccgacaggcaccgtcatggacatcatttctagaaaggatcagcgggggagcggacaagtgggcacgtacgggctgaacacattcaccaatatggaggctcagcttatccgccagatggaaggagagggcgtgctgtccaaagccgacctcgaaaaccctagactgcccgagaagaaaattacccagtggctggagacaaagggggttgaacggctcaaacgcatggcgatcagcggcgatgactgcgtggtcaagcccatcgatgacagatttgccaacgctctgcttgccctgaatgatatgggaaaggtgcggaaagacattcctcaatggcagccgtctaagggctggcacgattggcagcaggttcccttctgttcccatcacttccatgagctcatcatgaaagacgggcgcaagctggtggtcccttgcagaccccaagacgaacttattggacgggctcgcatcagccagggcgccgggtggtctctgagagagaccgcttgtctcggaaaagcctatgcgcagatgtggtccctgatgtactttcaccggcgcgatctgagactcgccagcaacgctatttgctctgccgtgcctgtccactgggtgcccacatcccggacgacctggagcatccatgcccaccatcaatggatgacaaccgaagacatgctgacagtttggaatagagtgtggattgaggataacccttggatggaggacaagacccccgtcacgacctgggaaaatgtgccgtaccttggcaagcgcgaggatcagtggtgtgggtccctgatcggcctcacaagccgggctacctgggcccagaacatccctacagcgattcagcaagttagatctctgatcggaaatgaagagttccttgactatatgcccagcatgaaacgctttcggaaggaggaagagtccgaaggcgctatttggtga

SEQ ID NO: 20761 - RNA, 9873 nt, synthetic construct
  misc_feature 1..9873: note = derived and/or modified CDS sequence (opt5) from DENV-3__FJ639759__SS-prME
  source 1..9873: mol_type = other RNA
acaagcctgtgcctcatgatgatcctgcccgccgctcttgccttccacctgacatcccgggacggcgaacctcggatgattgtggggaagaacgaacgcggaaaatctctcctgtttaagacggcgagcggcatcaatatgtgtacccttattgctatggatctgggggagatgtgcgacgatacagtgacctacaaatgtccgcacatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacacgatcggagtgctggagcagggcaaacggacccttacacctcagcccatggagctgaagtactcttggaaaacctgggggaaggccaagattgtcacagccgaaacccaaaactccagcttcatcattgatggacctaatacacccgagtgcccgtctgcttccagagcgtggaacgtgtgggaagtggaggactatggctttggcgtcttcaccacgaatatctggctcaaactgcgcgaagtttacacacagctgtgtgaccaccggcttatgagcgccgctgtgaaggatgagagagccgtgcacgccgacatggggtactggatcgagtcccagaaaaacggatcttggaagctcgaaaaagctagcctgattgaggtcaagacctgcacctggcctaagtcccatacactgtggtctaatggcgtgctcgaaagcgatatgatcattcccaaatccctggccgggcctatcagccagcacaactatcgccccggataccatacccaaacggcgggcccttggcaccttgggaagctggagctcgactttaattattgcgagggaacaaccgttgtgattacagaaaactgtggcacccggggcccctctctgagaacaaccacggtctccgggaaactgatccacgagtggtgctgtcgcagctgcacccttccgcctctccggtacatgggagaagatggctgttggtatgggatggagatcagacccatttctgaaaaggaggagaatatggtgaaatccctggttagcgctggatctggcgaagtggacaacttcacaatgggggtcctgtgcctcgccatcctgtttgaggaagtgatgcggggaaagttcggcaagaaacatatgattgccggcgttcttttcacctttgtgctgctcctgagcgggcagatcacatggcgcgatatggctcacaccctgattatgatcggatccaatgccagcgacagaatgggcatgggggtcacgtaccttgcgctgattgctacattcaagatccagccctttctcgccctgggattctttctccggaaactgacctctagagagaaccttctgctcggcgtggggctggccatggctacaaccctgcaacttcctgaagatatcgagcagatggccaatggaattgctctgggcctcatggccctgaagctcatcacccagttcgagacatatcagctgtggacggcgcttatttccctgacctgtagcaacacaatctttaccctcacagtggcctggcgcaccgctacgctgattctggccggcgtctcccttctgccggtttgccaatctagctccatgcggaaaacagactggatccccatgaccgtggctgccatgggggtgcctcccctccctctgttcatcttttctctcaaggataccctgaagagacgcagctggccccttaatgaaggagtcatggccgtgggcctggtttccattctggcttctagcctcctgagaaacgacgtgcctatggcggggccccttgtcgccggaggcctgctcatcgcttgttacgtgattacagggacctccgccgatctgacagttgagaaagccgctgacgtgacgtgggaagaggaagccgagcagaccggagtcagccataacctcatgatcacagtggacgatgacggcaccatgcggattaaggatgacgagacagaaaatatcctgaccgtccttctgaaaacggcgctgctcatcgtgtctggcattttcccgtactccatccctgctaccctgcttgtttggcacacatggcagaagcagacccaacgcagcggggtgctgtgggatgtcccctctcctcccgagacacagaaagccgaactcgaggagggagtgtatagaattaagcagcagggcatctttgggaaaacccaagttggagtgggcgtccagaaggaaggggtgttccatacaatgtggcacgtgacgcggggagccgttctgacctacaacggcaagcgcctcgagccgaattgggcttccgtcaaaaaggacctgattagctatggcgggggatggagactttctgcccagtggcaaaaaggcgaagaggtccaggtgatcgcggtcgaacctgggaagaaccccaaaaattttcagacaatgcctggaaccttccagaccacaacgggcgagattggggctatcgccctggatttcaagcccggaacctccggcagccccatcattaaccgggagggcaagatcgtggggctgtacggaaatggcgttgtgaccaagaacgggggatatgtctccggcattgcccaaaccaatgctgaacctgacgggccgacacccgagctcgaagaggaaatgtttaagaaacgcaacctgaccatcatggatcttcaccctggcagcggaaagacgagaaaatacctgcccgccattgtgcgggaggctatcaagcgcagactccggacactgatcctcgcccctaccagagttgtggcggccgagatggaagaggctctgaagggccttcccattcgctatcagacctctgccacaaaaagcgaacataccgggcgggagatcgtcgacctgatgtgccacgctacattcaccatgagactgctctcccctgtgcgcgttccgaattacaacctgattatcatggatgaagcccattttacggaccccgcctctattgctgcgcggggatacatcagcacaagagtgggcatgggggaggccgctgccatcttcatgaccgccacacctcccggaaccgctgatgcctttcctcagtccaatgcgcccattcaggacgaggaacgcgacatcccggagcggtcttggaacagcggcaatgaatggattacggatttcgctgggaagaccgtctggtttgtgccttccatcaaagccggcaacgacattgccaactgtcttagaaagaatggcaaaaaggtgatccaactgtctcgcaagacattcgataccgagtatcagaaaacaaagctcaacgactgggattttgtcgttaccacagacattagcgagatgggagctaatttcaaagccgatcgggtgatcgaccccagacggtgcctgaagcccgtgatcctgaccgatgggcctgaacgcgtcattctcgcgggacccatgcctgtgacggccgcttccgccgctcagagacggggccgcgttgggagaaacccgcagaaagagaatgaccaatacatctttacaggacagccccttaacaatgatgaagaccacgcccattggaccgaggctaagatgctgctggacaacattaatacccctgaaggcatcattcccgccctcttcgagcctgagcgggaaaagagcgcggccatcgatggggagtatagactgaaaggcgaatctcgcaagacattcgtggagcttatgcggagaggagacctgcccgtctggctcgctcacaaagtggcctccgaaggcatcaagtacaccgatcgcaaatggtgctttgacgggcagcggaacaatcagattctggaggagaacatggatgttgaaatctggacaaaggagggagagaagaagaagctgagaccgcgctggctcgacgctcggacgtatagcgatcctcttgccctgaaagagttcaaggactttgccgctggcagaaaatctattgcgctggatctcgtgaccgaaatcgggcgcgtccccacacacctggcccatagaacccggaatgctcttgacaacctggtgatgctccacacatccgagcatggaggcaaggcctaccgccacgccgtcgaggaactgcctgagaccatggaaacgctgctccttctgggcctgatgattctcctgaccgggggagctatgcttttcctgatcagcggcaaagggatcggaaagacatccattggcctcatctgtgtgattgcctctagcgggatgctgtggatggcggagatccccctgcaatggattgcctccgctatcgttctcgagtttttcatgatggtgcttctgattcctgaacccgagaagcagagaaccccgcaggataatcaactggcctatgtggtcatcggaatcctcacactggctgccattatcgcggccaacgaaatgggccttctggagaccacgaaacgggacctcggcatgagcaaggaacctggggttgtgtctcccacatcctacctggatgtggacctgcaccccgctagcgcctggaccctctacgctgtcgccacaaccgtgattacccctatgcttcgccatacaatcgaaaattctacggctaacgttagcctggccgcgattgccaaccaggctgtggtcctgatgggactcgacaaaggctggccgatctccaagatggatctgggggtgccccttctggccctcggatgctattctcaggtcaatcctctgaccctgacagctgccgtgctccttctgatcacccactacgccattatcggccccgggctgcaggcgaaagctacaagagaggcccaaaagcggaccgctgccggaattatgaagaaccctacggttgacggcatcatgacaattgatctcgaccccgtgatctatgatagcaaatttgaaaagcagctgggccaggtcatgcttctggtgctctgtgccgttcagctgctgctcatgagaacctcctgggctctttgcgaggccctgaccctggcgacagggcctatcaccacactctgggaaggatctccgggcaaattctggaatacgaccattgccgtgagcatggctaacatctttcgcgggtcctacctggccggagctggccttgccttcagcattatgaagtctgtcgggacaggaaaacggggcaccggctcccaaggggagacactgggagaaaagtggaagaaaaagctcaatcagctgagcagaaaagagtttgacctgtataagaaatccggcatcaccgaggtggatcgcacggaagcgaaggaggggctcaaacggggagaaattacccatcacgccgtgtctagaggcagcgctaaacttcagtggttcgttgagcggaacatggtcatccccgaagggcgcgtgattgacctgggatgtggcagaggcgggtggtcctactattgcgccggactgaagaaagtgacagaggtccggggctacaccaaagggggacctggccatgaggaacccgttcctatgtctacatacgggtggaatatcgtgaaactcatgagcggaaaggatgtgttttatctgcccccggagaaatgtgacacccttctgtgcgatatcggcgaatccagcccttctcccacagtcgaggagtcccgcaccattagagtgctcaagatggttgaaccctggctgaagaacaatcagttctgtatcaaagtgctgaacccttacatgcccacggtcattgagcacctcgaacggcttcaacgcaagcacggcgggatgctggtgagaaatcctctgagccggaactctacacatgagatgtattggatctccaatggaaccggcaacattgttgctagcgtgaatatggtctctcgcctcctgcttaacagattcaccatgacacaccggagaccgacgatcgaaaaagacgtggatctgggggccggaacccgccatgtgaacgctgagcccgagacacctaatatggacgtcatcggcgaacggattaagagaatcaaagaggaacacaacagcacctggcactacgacgatgagaatccctataagacatgggcctaccatgggtcctatgaagttaaggcgaccggatctgccagctccatgattaacggcgtggtgaaactcctgacaaagccttgggacgtcgtgcccatggttacccagatggctatgacggataccacaccgtttggccagcaacgcgtgttcaaagagaaggtcgacacccggacacctagaagcatgcccgggacccgccgggtgatgggaatcacggccgagtggctgtggagaacactcggccgcaataaaaagcctcggctgtgcaccagagaagagtttacaaagaaagttcgcaccaacgctgccatgggggccgtgttcacggaagagaatcagtgggattccgcgaaggctgccgtcgaagacgaggatttttggaaacttgtggaccgggagagagaactgcacaagctcggaaaatgtggctcttgcgtttacaacatgatggggaagcgcgagaaaaagctgggcgagttcggaaaggccaaaggcagcagagctatttggtacatgtggcttggggcccggtatctggagtttgaggctctcggattcctgaatgaagatcattggttttcccgcgagaactcttacagcggcgtggaaggggagggactgcacaagctcggctatatcctgagagacatctccaaaattcccgggggcgccatgtacgcggatgacaccgccggatgggacacacggatcaccgaagatgaccttcataatgaggagaagattacacagcagatggatcctgaacacagacaactggctaacgccatcttcaaactcacctatcagaataaggtcgtgaaggtccagcggcccacaccgaccggcacggtgatggacattatctctcgcaaagatcagagagggagcggacaagttggcacatacgggctgaacacctttaccaatatggaggctcagcttatccggcagatggaaggagagggcgtgctgtccaaggccgacctcgaaaaccctcatctgcccgagaaaaagattacacagtggctggagaccaaaggggtcgaacgcctcaagagaatggcgatcagcggcgatgactgcgtggtgaagcccattgatgaccggttcgccaacgctctgcttgccctgaatgatatgggaaaagttcgcaaggacatccctcaatggcagccgtctaaaggctggcatgattggcaacaggtgcccttttgttcccaccatttccacgagctcattatgaaggacgggagaaaactggtcgtgccttgccggccccaagacgaacttatcggacgcgctagaattagccagggcgccgggtggtctctgcgggagacagcttgtctcggaaaggcctatgcgcagatgtggtccctgatgtacttccaccgcagagatctgcggctcgccagcaacgctatctgctctgccgttcctgtgcattgggtccccacgtcccgcaccacatggagcatccacgcccatcaccaatggatgaccacagaagacatgctgaccgtgtggaatagagtctggattgaggataacccttggatggaggacaagacgcccgtgaccacatgggaaaatgttccgtaccttggcaaacgggaggatcagtggtgtgggtccctgatcggcctcaccagcagagctacatgggcccagaacattcctaccgcgatccagcaagtgcgctctctgattggaaatgaagagtttcttgactatatgcccagcatgaagcggttcagaaaagaggaagagtccgaaggcgctatctggtga

SEQ ID NO: 20762 - RNA, 9873 nt, synthetic construct
  misc_feature 1..9873: note = derived and/or modified CDS sequence (opt5) from DENV-3__FJ639761__SS-prME
  source 1..9873: mol_type = other RNA
accagcctgtgcctcatgatgatcctgcccgccgctcttgccttccacctgacatcccgggacggcgaacctcggatgattgtggggaagaacgaacgcggaaagtctctcctgtttaagacggcgagcggcatcaatatgtgtacccttattgctatggatctgggggaaatgtgcgacgatacagtgacctacaaatgtccgcacatcacagaagttgaacccgaagacattgattgctggtgtaacctcacctccacatgggtgacctatggaacgtgcaatcaggccggcgaacaccggcgggacaagcgctctgtggccctggctcctcatgtcgggatgggactggataccagaacacagacctggatgagcgccgaaggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctgcagcccattgagggcaaagttgtgcagtatgagaatctcaagtacacagtcatcatcaccgtgcatacaggggaccagcaccaagttggaaacgaaacgcagggcgtgaccgctgagattacacctcaggcctctaccacagaagctatcctgcccgagtatggcaccctggggctcgaatgctcccctcgcacgggactggacttcaatgagatgattcttctgaccatgaaaaacaaggcctggatggtccatagacaatggtttttcgatctccccctgccgtggacaagcggcgccaccacagagacccctacgtggaatcggaaagaacttctggtgacatttaagaacgctcacgcgaaaaagcaggaggtcgtggttctcgggtctcaggaaggagccatgcacaccgctctgacaggcgccaccgagatccaaaattccgggggcaccagcattttcgccggacatctgaagtgtcgcctcaaaatggacaagctggaacttaaaggcatgtcttacgctatgtgcacaaacacgtttgtgctgaagaaagaggtctccgagacccaacacgggacaatcctcatcaaggtggaatacaagggagaggatgttccctgtaaaattcctttcagcaccgaagacggccaggggaaggcccataacggaagactgatcacagcgaatcccgtggtcaccaaaaaggaggagcccgtgaacattgaagctgagcctccgttcggcgaatccaatatcgtgattgggatcggcgataacgccctgaaaatcaattggtataagaagggatctagcattggcaaaatgtttgaggccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggaactgaagtgcggcagcgggattttcgtgacaaacgaggttcatacgtggaccgagcaatacaaatttcaggccgattcccccaagcggctggcgacagccatcgctggcgcctgggaaaatggagtgtgtggcattagaagcaccacacgcatggagaaccttctctggaaacagatcgctaatgaactgaactatatcctgtgggagaataacattaagctcaccgtcgtggttggggacatcattggagtgctggaacagggcaaacggacgcttacccctcaacccatggagctgaagtactcttggaaaacatgggggaaggccaagatcgtcaccgccgagacacagaactccagcttcattatcgatggacctaatacccccgaatgcccgtctgcttccagagcgtggaacgtgtgggaggtggaagactatggctttggcgtcttcacaaccaatatctggctcaaactgcgcgaggtttacacgcagctgtgtgaccaccggcttatgagcgccgctgtgaaggatgaaagagccgtgcacgccgacatggggtactggattgagtcccagaaaaacggatcttggaagctcgagaaagctagcctgatcgaagtcaagacatgcacctggcctaagtcccataccctgtggtctaatggcgtgctcgagagcgatatgattatccccaaatccctggccgggcctattagccaacacaactatcgccccggataccatacacagaccgcgggcccttggcaccttgggaagctggaactcgactttaattattgcgagggaacgacagttgtgatcaccgagaactgtggcacacggggcccctctctgagaaccacaaccgtctccgggaaactgatccacgaatggtgctgtcgcagctgcacgcttccgcctctccggtacatgggagaggatggctgttggtatgggatggaaattagacccatctctgagaaggaagagaatatggtgaaatccctggttagcgctggatctggcgaggtggacaacttcaccatgggggtcctgtgcctcgccattctgtttgaagaggtgatgcggggaaagttcggcaagaaacatatgatcgccggcgttttctttacattcgtgcttctgctcagcgggcagattacctggcgcgatatggctcacacactgatcatgattggatccaatgccagcgacagaatgggcatgggggtcacctacctggcgcttatcgctacgtttaagatccaacccttcctggccctcggatttttcctgcggaaactcacatctagagaaaacctgcttctgggcgtggggctcgccatggctaccacactgcagctgcctgaggatattgaacagatggccaatggaatcgctcttggcctgatggccctcaagctgattacccagtttgagacctatcaactctggacagcgctgatctcccttacgtgtagcaacaccattttcacactgaccgtggcctggcgcacagctaccctcatcctggccggcgtctccctgcttccggtttgccagtctagctccatgcggaaaacggactggctgcccatgacagtggctgccatgggggtgcctcccctccctctgtttatcttctctctcaaggataccctgaagagacgcagctggccccttaatgagggagtcatggccgtgggcctggtttccattctggcttctagcctcctgagaaacgacgtgcctatggcggggccccttgtcgccggaggcctgctcatcgcttgttacgtgattaccgggacatccgccgatctgaccgttgaaaaagccgctgacgtgacatgggaggaagaggccgaacagacgggagtcagccataacctcatgatcaccgtggacgatgacggcacaatgcggattaaggatgacgagaccgagaatatcctgacagtccttctgaaaaccgcgctgctcatcgtgtctggcatttttccgtactccatccctgctacgctgcttgtttggcacacctggcagaagcaaacacagcgcagcggggtgctgtgggatgtcccctctcctcccgaaacccagaaagccgagctcgaagagggagtgtatagaattaagcagcaaggcatcttcgggaaaacacaggttggagtgggcgtccagaaggagggggtgtttcataccatgtggcacgtgacacggggagccgttctgacgtacaacggcaagcgcctcgaaccgaattgggcttccgtcaaaaaggacctgattagctatggcgggggatggagactttctgcccaatggcagaaaggcgaggaagtccaggtgatcgcggtcgagcctgggaagaaccccaaaaatttccagaccatgcctggaacattccaaaccaccacaggcgaaattggggctatcgccctggattttaagcccggaacgtccggcagccccatcattaaccgggagggcaaggtggttgggctgtacggaaatggcgtggtcaccaaaaacgggggatatgtgtccggcatcgcccagacaaatgctgagcctgacgggccgacccccgaactcgaggaagagatgttcaagaaacgcaacctgacaattatggatcttcaccctggcagcggaaagaccagaaaatacctgcccgccatcgttcgggaagctattaagcgcagactccggacgctgatcctcgcccctacaagagtggtcgcggccgagatggaggaagctctgaagggccttcccatccgctatcagaccaccgccacaaaatctgagcataccgggcgggaaattgtggacctgatgtgccacgctacatttaccatgagactgctcagccctgttcgcgtgccgaattacaacctgatcattatggatgaggcccatttcacggaccccgcctccatcgctgcgcggggatacatttctacaagagtcggcatgggggaagccgctgccatctttatgaccgccacacctcccggaaccgctgatgccttccctcagagcaatgcgcccatccaagacgaggagcgcgacattccggaacggtcctggaactctggcaatgagtggatcacggattttgctgggaagaccgtgtggttcgtgcctagcattaaagccggcaacgacatcgccaactgtcttagaaagaatggcaaaaaggtcattcagctgtcccgcaagacatttgataccgaatatcagaaaacaaagctcaacgactgggatttcgttgtgaccacagacatctctgagatgggagctaattttaaagccgatcgggtgattgaccccagacggtgcctgaagcccgtcatcctgaccgatgggcctgagcgcgtgatcctcgcgggacccatgcctgttacggccgctagcgccgctcagagacggggccgcgtggggagaaacccgcaaaaagaaaatgaccagtacattttcacaggacagccccttaacaatgatgaggaccacgcccattggaccgaagctaagatgctgctggacaacatcaatacccctgagggcattatccccgccctcttcgaacctgagcgggagaagtccgcggccattgatggggaatatagactgaaaggcgagagccgcaagacatttgtcgaacttatgcggagaggagacctgcccgtgtggctcgctcacaaagttgcctctgagggcatcaagtacaccgatcgcaaatggtgcttcgacgggcagcggaacaatcaaatcctggaagagaacatggatgtggagatttggacaaaggaaggagagaaaaagaagctgagaccgcgctggctcgacgctcggacgtattccgatcctcttgccctgaaagaatttaaggacttcgccgctggcagaaaaagcatcgcgctggatctcgtcaccgagattgggcgcgtgcccacacacctggcccatagaacccggaatgctcttgacaacctggtcatgctccacacatctgaacatggaggcaaggcctaccgccacgccgtggaggagctgcctgaaaccatggagacgctgctccttctgggcctgatgatcctcctgaccgggggagttatgctttttctgatttccggcaaagggatcggaaagacaagcatcggcctcatttgtgtgatcgcttcctctgggatgctgtggatggccgaaattcccctgcagtggatcgcgagcgccattgtgctcgagttctttatgatggtccttctgatccctgagcccgaaaagcagagaaccccgcaagataatcagctggcttatgttgtgattggaatcctcacactggccgctatcattgccgcgaacgagatgggccttctggaaaccacgaaacgggacctcggcatgtccaaggagcctggggtggtcagccccacatcttacctggatgtggacctgcaccccgcctccgcttggaccctctacgccgttgctacaaccgtgatcacccctatgcttcgccatacaattgaaaatagcacggccaacgtctctctggctgccatcgcgaaccaggccgtggtcctgatgggactcgacaaaggctggccgattagcaagatggatctgggggtgccccttctggctctcggatgctattcccaggttaatcctctgaccctgacagccgctgtgctccttctgatcacccactacgccatcattggccccgggctgcaagccaaagcgacaagagaggctcagaagcggaccgccgctggaatcatgaagaaccctacggtcgacggcattatgacaatcgatctcgaccccgtgatttatgattctaaattcgagaagcagctgggccaggttatgcttctggtgctctgtgccgtccaactgctgctcatgagaaccagctgggccctttgcgaagctctgaccctggccacagggcctatcaccacactctgggagggatccccgggcaaattttggaatacgaccatcgcggtgtctatggccaacattttccgcgggagctacctggctggagccggccttgctttttccatcatgaaaagcgtggggacaggaaaacggggcaccggcctgcagggggaaacactcggagagaagtggaagaaaaagctgaatcagctgtctagaaaagagttcgacctctataagaaatccggcattaccgaggttgatcgcacggaggccaaggaagggcttaaacggggagagatcacccatcacgcggtcagcagaggctccgccaagctgcagtggtttgtggaacggaacatggtgattcccgaggggcgcgtcatcgacctgggatgtggcagaggcgggtggtcttactattgcgctggactcaagaaagttacagaagtgcggggctacaccaaagggggacctggccatgaggagcccgtgcctatgagcacatacgggtggaatattgtcaaactgatgtccggaaaggatgtgttctatcttcccccggaaaaatgtgacaccctgctctgcgatatcggcgagtctagcccttcccccacagttgaagagagccgcaccatcagagtgctgaagatggtcgagccctggctgaagaacaatcaattctgtattaaagtgctcaacccttacatgcccacggttatcgaacaccttgagcggctgcagcgcaagcacggcgggatgctggtgagaaatcctctctctcggaactccacacatgaaatgtattggattagcaatggaaccggcaacatcgtcgcctctgtgaatatggtgtcccgcctgcttctgaacagatttaccatgacacaccggagaccgacgattgagaaagacgtcgatctcggggctggaacccgccatgttaacgccgaacccgagacacctaatatggacgtgatcggcgagcggatcaagagaattaaagaagaacacaacagcacctggcactacgacgatgaaaatccctataagacatgggcttaccatgggtcttatgaggtgaaggccaccggaagcgcgtcctctatgatcaacggcgtcgtgaaactgctgacaaagccttgggacgttgtgcccatggtcacccagatggccatgacggataccacaccgttcggccaacagcgcgtgtttaaagaaaaggttgacacccggacacctagaagcatgcccgggacccgccgggtgatgggaattacggctgagtggctctggagaacactgggccgcaataaaaagcctcggctttgcaccagagaggagttcacaaagaaagtccgcaccaacgccgctatgggggccgtgtttacggaggaaaatcagtgggattccgccaaggcggctgttgaggacgaagatttctggaaactggtggaccgggagagagagctccacaagctgggaaaatgtggcagctgcgtctacaacatgatggggaagcgcgagaagaaacttggcgagtttggaaaggccaaaggctccagagccatctggtacatgtggctgggggctcggtatctcgagttcgaggccctgggatttctgaatgaggatcattggttctctcgcgaaaacagctactccggcgtggagggggaaggactccacaagctgggctatattcttagagacatctctaaaatccccgggggcgctatgtacgccgatgacaccgcgggatgggacacacggattaccgaggatgacctgcataatgaagagaagatcacacagcaaatggatcctgagcacagacagctcgccaacgctatttttaaactgacctatcagaataaggtcgtgaaggttcagcggcccacaccgaccggcacggtgatggacatcattagccgcaaagatcaaagagggtccggacaggtcggcacatacgggcttaacaccttcaccaatatggaagcccagctgatccggcagatggagggagaaggcgtgctctctaaggctgacctggagaaccctcatctgcccgagaagaagatcacacaatggctcgagaccaaaggggtggagcgcctgaagagaatggccattagcggcgatgactgcgttgtgaagcccatcgatgaccggtttgcgaacgcccttctggctctcaatgatatgggaaaagtccgcaaggacattcctcagtggcagccgtccaaaggctggcatgattggcagcaagtgcccttctgtagccaccatttccacgaactgatcatgaaggacgggagaaaacttgttgtgccttgccggccccaggacgagctgattggacgcgccagaatctctcagggcgctgggtggtccctccgggaaacagcctgtctgggaaaggcttatgcccaaatgtggagcctgatgtactttcaccgcagagatctccggctggcgtctaacgccatttgctccgctgtccctgtgcattgggtccccacgagccgcaccacatggtctatccacgcccatcaccagtggatgaccacagaggacatgcttaccgtgtggaatagagtttggatcgaagataacccttggatggaggacaagacgcccgtgaccacatgggagaatgtcccgtacctgggcaaacgggaagatcagtggtgtgggtccctcattggcctgaccagcagagccacatgggctcagaacatccctaccgccattcaacaggtgcgctcccttatcggaaatgaggagttcctggactatatgcccagcatgaagcggtttagaaaagaggaggaatctgagggcgcgatttggtga

SEQ ID NO: 20763 - RNA, 9873 nt, synthetic construct
  misc_feature 1..9873: note = derived and/or modified CDS sequence (opt5) from DENV-3__FJ639762__SS-prME
  source 1..9873: mol_type = other RNA
accagcctgtgcctcatgatgatcctgcccgccgctcttgccttccacctgacatcccgggacggcgagcctcggatgattgtggggaagaacgaacgcggaaagtctctcctgtttaagacggcgagcggcatcaatatgtgtacccttattgctatggatctgggggaaatgtgcgacgatacagtgacctacaagtgtccgcacatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaagattgagtacaagggagaagatgtgccctgtaaaatccctttcagcaccgaggacggccaagggaaggcccataacggaagactgattacagcgaatcccgttgtgaccaaaaaggaggaacccgtcaacatcgaggctgaacctccgttcggcgagtccaatattgtgatcgggatcggcgataacgccctgaaaattaattggtataagaagggatctagcatcggcaaaatgtttgaagccacggctagaggggccagacgcatggctattcttggagacacagcctgggatttcggctccgtcgggggagttctcaacagcctgggcaagatggtccaccagatctttgggtctgcgtacaccgccctgttctccggcgtgagctgggtgatgaaaattggaatcggcgtcctcctgacctggattgggcttaattctaagaacacaagcatgtccttttcttgcatcgctatcggaattatcaccctgtatctcggcgccgtggttcaggctgacatggggtgtgtgattaattggaaaggaaaggagctgaagtgcggcagcgggatcttcgtcacaaacgaggtgcatacgtggaccgaacagtacaaatttcaagccgattcccccaagcggctggcgacagccattgctggcgcctgggagaatggagtttgtggcatcagaagcaccacacgcatggaaaaccttctctggaaacagatcgctaatgagctgaactatattctgtgggaaaataacatcaagctcaccgtggtcgtgggggacattatcggagttctggagcagggcaaacggacgcttacccctcagcccatggagctgaagtactcttggaaaacatgggggaaggccaagattgtgaccgccgaaacacaaaactccagcttcatcatcgatggacctaatacccccgagtgcccgtctgcttccagagcgtggaacgtctgggaagtggaggactatggctttggcgtgttcacaaccaatatttggctcaaactgcgcgaagtctacacgcagctgtgtgaccaccggcttatgagcgccgctgttaaggatgagagagccgtgcacgccgacatggggtactggatcgagtcccagaaaaacggatcttggaagctcgaaaaagctagcctgattgaggtgaagacatgcacctggcctaagtcccataccctgtggtctaatggcgtcctcgaaagcgatatgatcattcccaaatccctggccgggcctatcagccagcacaactatcgccccggataccatacacaaaccgcgggcccttggcaccttgggaagctggagctcgactttaattattgcgagggaacgacagtggttatcaccgaaaactgtggcacacggggcccctctctgagaaccacaaccgtgtccgggaaactgattcacgagtggtgctgtcgcagctgcacgcttccgcctctccggtacatgggagaagatggctgttggtatgggatggagatcagacccatttctgaaaaggaggagaatatggtcaaatccctggtgagcgctggatctggcgaagttgacaacttcaccatgggggtgctgtgcctcgccatcctgtttgaggaagtcatgcggggaaagttcggcaagaaacatatgattgccggcatcttctttacattcgtgcttctgctcagcgggcagattacctggcgcgatatggctcacacactgatcatgatcggatccaatgccagcgacagaatgggcatgggggttacctacctggcgcttattgctacgtttaagatccagcccttcctggccctcggatttttcctgcggaaactcacatctagagagaacctgcttctgggcgtggggctcgccatggctaccacactgcaactgcctgaagatattgagcagatggccaatggaatcgctcttggcctgatggccctcaagctgattacccagtttgagacctatcagctctggacagcgctgatctcccttacgtgtagcaacaccatcttcacactgaccgtcgcctggcgcacagctaccctcattctggccggcgtgtccctgcttccggtgtgccaatctagctccatgcggaaaacggactggctgcccatgacagtcgctgccatgggggttcctcccctccctctgtttatcttctctctcaaggataccctgaagagacgcagctggccccttaatgaaggagtgatggccgtgggcctggtctccattctggcttctagcctcctgagaaacgacgtgcctatggcggggccccttgttgccggaggcctgctcatcgcttgttacgtgattaccgggacatccgccgatctgaccgtcgagaaagccgctgacgtgacatgggaagaggaagccgagcagacgggagttagccataacctcatgatcaccgtggacgatgacggcacaatgcggatcaaggatgacgagaccgaaaatattctgacagtccttctgaaaaccgcgctgctcatcgtgtctggcatttttccgtactccatccctgctacgctgcttgtctggcacacctggcagaagcagacacaacgcagcggggtgctgtgggatgttccctctcctcccgagacccagaaagccgaactcgaggagggagtgtatagaattaagcagcagggcatcttcgggaaaacacaagtcggagtgggcgttcagaaggaaggggtgtttcataccatgtggcacgtcacacggggagccgtgctgacgtacaacggcaagcgcctcgagccgaattgggcttccgtgaaaaaggacctgattagctatggcgggggatggagactttctgcccagtggcaaaaaggcgaagaggttcaggtcatcgcggtggaacctgggaagaaccccaaaaatttccagaccatgcctggaacattccagaccaccacaggcgagatcggggctattgccctggattttaagcccggaacgtccggcagccccatcattaaccgggagggcaagatcgtggggctgtacggaaatggcgtcgtgaccaaaaacgggggatatgtttccggcattgcccaaacaaatgctgaacctgacgggccgacccccgagctcgaagaggaaatgttcaagaaacgcaacctgacaatcatggatcttcaccctggcagcggaaagaccagaaaatacctgcccgccatcgtgcgggaggctattaagcgcagactccggacgctgatcctcgcccctacaagagtcgtggcggccgagatggaagaggctctgaagggccttcccattcgctatcagaccaccgccacaaaatctgaacataccgggcgggagatcgttgacctgatgtgccacgctacatttaccatgagactgctcagccctgtgcgcgtcccgaattacaacctgattatcatggatgaagcccatttcacggaccccgcctccatcgctgcgcggggatacatttctacaagagtgggcatgggggaggccgctgccatctttatgaccgccacacctcccggaaccgctgatgccttccctcagagcaatgcgcccattcaggacgaggaacgcgacatcccggagcggtcctggaactctggcaatgaatggattacggattttgctgggaagaccgtttggttcgtgcctagcatcaaagccggcaacgacattgccaactgtcttagaaagaatggcaaaaaggtcatccaactgtcccgcaagacatttgataccgagtatcagaaaacaaagctcaacgactgggatttcgtggtgaccacagacatctctgagatgggagctaattttaaagccgatcgggtcattgaccccagacggtgcctgaagcccgttatcctgaccgatgggcctgaacgcgtgattctcgcgggacccatgcctgtgacggccgctagcgccgctcagagacggggccgcgtcgggagaaacccgcagaaagagaatgaccaatacatcttcacaggacagccccttaacaatgatgaagaccacgcccattggaccgaggctaagatgctgctggacaacattaatacccctgaaggcatcatccccgccctcttcgagcctgagcgggaaaagtccgcggccattgatggggagtatagactgaaaggcgaaagccgcaagacatttgtggagcttatgcggagaggagacctgcccgtttggctcgctcacaaagtggcctctgaaggcatcaagtacaccgatcgcaaatggtgcttcgacgggcagcggaacaatcagattctggaggagaacatggatgtcgaaatctggacaaaggagggagagaagaagaagctgagaccgcgctggctcgacgctcggacgtattccgatcctcttgccctgaaagagtttaaggacttcgccgctggcagaaaaagcattgcgctggatctcgtgaccgaaatcgggcgcgttcccacacacctggcccatagaacccggaatgctcttgacaacctggtgatgctccacacatctgagcatggaggcaaggcctaccgccacgccgtcgaggaactgcctgagaccatggaaacgctgctccttctgggcctgatgatcctcctgaccgggggagctatgctttttctgatttccggcaaagggatcggaaagacaagcattggcctcatctgtgtgattgcctcctctgggatgctgtggatggcggagatccccctgcaatggattgccagcgctatcgtcctcgagttctttatgatggtgcttctgatccctgaacccgagaagcagagaaccccgcaggataatcaactggcctatgttgtgattggaatcctcacactggctgccattatcgcggccaacgaaatgggccttctggagaccacgaaacgggacctcggcatgtccaaggaacctggggtggtcagccccacatcttacctggatgttgacctgcaccccgcttccgcctggaccctctacgctgtggccacaaccgtgattacccctatgcttcgccatacaatcgagaatagcacggctaacgtctctctggccgcgatcgccaaccaggctgtggttctgatgggactcgacaaaggctggccgattagcaagatggatctgggggtgccccttctggccctcggatgctattcccaggtcaatcctctgaccctgacagctgccgtgctccttctgatcacccactacgccattatcggccccgggctgcaggcgaaagctacaagagaggcccaaaagcggaccgctgccggaattatgaagaaccctacggtcgacggcatcatgacaatcgatctcgaccccgtgatttatgattctaaattcgaaaagcagctgggccaggttatgcttctggtgctctgtgccgtccagctgctgctcatgagaaccagctgggctctttgcgaggccctgaccctggcgacagggcctatcaccacactctgggaaggatccccgggcaaattttggaatacgaccattgccgtgtctatggctaacatcttccgcgggagctacctggccggagctggccttgccttttccattatgaaaagcgttgggacaggaaaacggggcaccggctctcaaggggagacactgggagaaaagtggaagaaaaagctcaatcagctgtccagaaaagagttcgacctgtataagaaaagcggcatcaccgaggtggatcgcacggaagcgaaggaggggctcaaacggggagaaattacccatcacgccgtctccagaggctctgctaaacttcagtggtttgtggagcggaacatggtgatccccgaagggcgcgttatcgacctgggatgtggcagaggcgggtggagctactattgcgccggactgaagaaagtcacagaggtgcggggctacaccaaagggggacctggccatgaggaacccgtgcctatgtccacatacgggtggaatattgtcaaactcatgtctggaaaggatgttttctatctgcccccggagaaatgtgacacccttctgtgcgatatcggcgaaagctcccctagccccacagtggaggagtctcgcaccattagagtgctcaagatggtcgaaccctggctgaagaacaatcagttctgtatcaaagtgctgaacccttacatgcccacggttattgagcacctcgaacggcttcaacgcaagcacggcgggatgctggtgagaaatcctctgtcccggaacagcacacatgagatgtattggatctctaatggaaccggcaacatcgtcgcttccgtgaatatggttagccgcctcctgcttaacagatttaccatgacacaccggagaccgacgattgaaaaagacgtggatctgggggccggaacccgccatgtcaacgctgagcccgagacacctaatatggacgtgatcggcgaacggattaagagaatcaaagaggaacacaactctacctggcactacgacgatgagaatccctataagacatgggcctaccatgggagctatgaagtgaaggcgaccggatccgcctctagcatgattaacggcgtcgttaaactcctgacaaagccttgggacgtggtgcccatggtcacccagatggctatgacggataccacaccgttcggccagcaacgcgtgtttaaagagaaggttgacacccggacacctagatccatgcccgggacccgccgggtgatgggaatcacggccgagtggctgtggagaacactcggccgcaataaaaagcctcggctgtgcaccagagaagagttcacaaagaaagtccgcaccaacgctgccatgggggccgtgtttacggaagagaatcagtgggatagcgcgaaggctgccgttgaagacgaggatttctggaaacttgtggaccgggagagagaactgcacaagctcggaaaatgtggctcctgcgtctacaacatgatggggaagcgcgagaaaaagctgggcgaatttggaaaggccaaaggctctagagctatctggtacatgtggcttggggcccggtatctggagttcgaggctctcggatttctgaatgaagatcattggttcagccgcgagaactcctactctggcgtggaaggggagggactgcacaagctcggctatattctgagagacatcagcaaaattcccgggggcgccatgtacgcggatgacaccgccggatgggacacacggatcaccgaagatgaccttcataatgaggagaagattacacagcagatggatcctgaacacagacaactggctaacgccatctttaaactcacctatcagaataaggttgtgaaggtccagcggcccacaccgaccggcacggtgatggacatcatttcccgcaaagatcagagagggtctggacaagtcggcacatacgggctgaacaccttcaccaatatggaggctcagcttatccggcagatggaaggagagggcgtgctgagcaaggccgacctcgaaaaccctcatctgcccgagaaaaagattacacagtggctggagaccaaaggggttgaacgcctcaagagaatggcgatctccggcgatgactgcgtggtcaagcccattgatgaccggtttgccaacgctctgcttgccctgaatgatatgggaaaagtgcgcaaggacatccctcaatggcagccgagcaaaggctggcatgattggcaacaggtgcccttctgttctcaccatttccacgagctcattatgaaggacgggagaaaactggttgtgccttgccggccccaagacgaacttatcggacgcgctagaatctcccagggcgccgggtggagcctgcgggagacagcttgtctcggaaaggcctatgcgcagatgtggtctctgatgtactttcaccgcagagatctgcggctcgcctccaacgctatttgcagcgccgtccctgtgcattgggttcccacgtctcgcaccacatggtccatccacgcccatcaccaatggatgaccacagaagacatgctgaccgtgtggaatagagtctggattgaggataacccttggatggaggacaagacgcccgtgaccacatgggaaaatgtcccgtaccttggcaaacgggaggatcagtggtgtgggagcctgatcggcctcacctccagagctacatgggcccagaacattcctaccgcgatccagcaagtgcgcagcctgatcggaaatgaagagttccttgactatatgccctctatgaagcggtttagaaaagaggaagagagcgaaggcgctatttggtga

SEQ ID NO: 20764 - RNA, 9873 nt, synthetic construct
  misc_feature 1..9873: note = derived and/or modified CDS sequence (opt5) from DENV-3__FJ639763__SS-prME
  source 1..9873: mol_type = other RNA
accagcctgtgcctcatgatgatcctgcccgcggctcttgccttccacctgacgtcccgggacggcgaacctcggatgattgtggggaagaacgaacgcggaaagtctctcctgtttaagacggcgagcggcatcaatatgtgtacccttattgctatggatctgggggagatgtgcgacgatacagtcacctacaaatgtccgcacatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggctgtgattttcatcctgcttatgctggtcaccccttctatgacaatgagatgtgtgggagttggcaaccgggactttgtggaagggctcagcggagccacctgggtcgatgtggtgctggagcacggcgggtgcgtcaccacaatggctaagaataaacccacgctggacattgagctccagaagaccgaagccacacagctggcgacccttcgcaaactgtgtatcgagggaaagattacaaacatcaccacggattccagatgccctacacagggcgaagccgttctcccggaggaacaggaccagaattatgtgtgtaaacacacctacgtggatcggggctgggggaacggatgcggcctgttcgggaagggaagccttgtgacctgcgctaagtttcaatgtctggagcccattgagggcaaagtggttcagtatgaaaatctcaagtacacagtgatcatcaccgtccatacaggggaccagcaccaggtgggaaacgagacgcaaggcgttaccgccgaaattacacctcaggcttctaccacagaggccatcctgcccgaatatggcaccctggggctcgagtgctcccctcgcacgggactggacttcaatgagatgattcttctgaccatgaaaaacaaggcctggatggtgcatagacagtggtttttcgatctccccctgccgtggacaagcggcgctaccacagaaacccctacgtggaatcggaaagagcttctggtcacatttaagaacgcgcacgccaaaaagcaagaagtggtcgtgctcgggtctcaggagggagctatgcacaccgccctgacaggcgccaccgaaatccaaaattccgggggcaccagcattttcgctggacatctgaagtgtcgcctcaaaatggacaagctggagcttaaaggcatgtcttacgccatgtgcacaaacacgtttgttctgaagaaagaggtgtccgaaacccagcacgggacaatcctcatcaaggtcgagtacaagggagaagatgtgccctgtaaaattcctttcagcaccgaggacggccaagggaaggcgcataacggaagactgatcacagctaatcccgttgtgaccaaaaaggaggaacccgtcaacattgaggccgaacctccgttcggcgagtccaatatcgtgattgggatcggcgataacgccctgaaaatcaattggtataagaagggatctagcattggcaaaatgtttgaagctacggccagaggggctagacgcatggccatccttggagacacagcgtgggatttcggctccgtcgggggagttctcaacagcctgggcaagatggtccaccagatttttgggtctgcctacaccgctctgttctccggcgtgagctgggtgatgaaaatcggaattggcgtcctcctgacctggatcgggcttaattctaagaacacaagcatgtccttttcttgcattgccatcggaatcattaccctgtatctcggcgctgtggttcaggccgacatggggtgtgtgatcaattggaaaggaaaggagctgaagtgcggcagcgggattttcgtcacaaacgaggtgcatacgtggaccgaacagtacaaatttcaagcggattcccccaagcggctggccacagctatcgccggcgcttgggagaatggagtttgtggcattagaagcaccacacgcatggaaaaccttctctggaaacagatcgccaatgagctgaactatatcctgtgggaaaataacattaagctcaccgtggtcgtgggggacatcattggagttctggagcagggcaaacggacgcttacccctcagcccatggagctgaagtactcttggaaaacatgggggaaggccaagatcgtgaccgctgaaacacaaaactccagcttcattatcgatggacctaatacccccgagtgcccgtctgcgtccagagcctggaacgtctgggaagtggaggactatggctttggcgtgttcacaaccaatatctggctcaaactgcgcgaagtctacacgcagctgtgtgaccaccggcttatgagcgctgccgttaaggatgagagagccgtgcacgctgacatggggtactggattgagtcccagaaaaacggatcttggaagctcgaaaaagccagcctgatcgaggtgaagacatgcacctggcctaagtcccataccctgtggtctaatggcgtcctcgaaagcgatatgattatccccaaatccctggcggggcctattagccagcacaactatcgccccggataccatacacaaaccgctggcccttggcaccttgggaagctggagctcgactttaattattgcgagggaacgacagtggttatcaccgaaaactgtggcacacggggcccctctctgagaaccacaaccgtgtccgggaaactgatccacgagtggtgctgtcgcagctgcacgcttccgcctctccggtacatgggagaagatggctgttggtatgggatggagattagacccatctctgaaaaggaggagaatatggtcaaatccctggtgagcgccggatctggcgaagttgacaacttcaccatgggggtgctgtgcctcgccattctgtttgaggaagtcatgcggggaaagttcggcaagaaacatatgatcgctggcgtgttctttacattcgttcttctgctcagcgggcagattacctggcgcgatatggcccacacactgatcatgattggatccaatgcgagcgacagaatgggcatgggggtgacctacctggctcttatcgccacgtttaagatccagcccttcctggccctcggatttttcctgcggaaactcacatctagagagaacctgcttctgggcgtcgggctcgctatggccaccacactgcaactgcctgaagatattgagcagatggctaatggaatcgcccttggcctgatggcgctcaagctgattacccagtttgagacctatcagctctggacagccctgatctcccttacgtgtagcaacaccattttcacactgaccgtggcttggcgcacagccaccctcatcctggctggcgtgtccctgcttccggtctgccaatctagctccatgcggaaaacggactggctgcccatgacagttgccgccatgggggtgcctcccctccctctgtttatcttctctctcaaggataccctgaagagacgcagctggccccttaatgaaggagtgatggctgtcggcctggtgtccattctggcgtctagcctcctgagaaacgacgttcctatggccgggccccttgtggctggaggcctgctcatcgcctgttacgtcattaccgggacatccgccgatctgaccgtggagaaagctgccgacgttacatgggaagaggaagcggagcagacgggagtgagccataacctcatgatcaccgtcgacgatgacggcacaatgcggattaaggatgacgagaccgaaaatatcctgacagtgcttctgaaaaccgctctgctcatcgtctctggcatttttccgtactccatccctgccacgctgcttgtgtggcacacctggcagaagcagacacaacgcagcggggttctgtgggatgtgccctctcctcccgagacccagaaagccgaactcgaggagggagtctatagaattaagcagcagggcatcttcgggaaaacacaagtgggagttggcgtgcagaaggaaggggtctttcataccatgtggcacgtgacacggggagctgtgctgacgtacaacggcaagcgcctcgagccgaattgggcctccgttaaaaaggacctgattagctatggcgggggatggagactttctgcgcagtggcaaaaaggcgaagaggtccaggtgatcgctgtggaacctgggaagaaccccaaaaatttccagaccatgcctggaacattccagaccaccacaggcgagattggggccatcgccctggattttaagcccggaacgtccggcagccccatcattaaccgggagggcaaggtcgtggggctgtacggaaatggcgttgtgaccaaaaacgggggatatgtctccggcatcgctcaaacaaatgccgaacctgacgggccgacccccgagctcgaagaggaaatgttcaagaaacgcaacctgacaattatggatcttcaccctggcagcggaaagaccagaaaatacctgcccgctatcgtgcgggaggccattaagcgcagactccggacgctgatcctcgcgcctacaagagttgtggccgctgagatggaagaggccctgaagggccttcccatccgctatcagaccaccgctacaaaatctgaacataccgggcgggagattgtcgacctgatgtgccacgccacatttaccatgagactgctcagccctgtgcgcgttccgaattacaacctgatcattatggatgaagcccatttcacggaccccgcttccatcgcggcccggggatacatttctacaagagtgggcatgggggaggctgccgccatctttatgaccgctacacctcccggaaccgccgatgcgttccctcagagcaatgctcccatccaggacgaggaacgcgacattccggagcggtcctggaactctggcaatgaatggatcacggattttgccgggaagaccgtctggttcgtgcctagcattaaagccggcaacgacatcgctaactgtcttagaaagaatggcaaaaaggtgattcaactgtcccgcaagacatttgataccgagtatcagaaaacaaagctcaacgactgggatttcgtcgttaccacagacatctctgagatgggagccaattttaaagcggatcgggtgattgaccccagacggtgcctgaagcccgtgatcctgaccgatgggcctgaacgcgtcatcctcgccggacccatgcctgtgacggctgccagcgctgcccagagacggggccgcgttgggagaaacccgcagaaagagaatgaccaatacattttcacaggacagccccttaacaatgatgaagaccacgctcattggaccgaggccaagatgctgctggacaacatcaatacccctgaaggcattatccccgccctcttcgagcctgagcgggaaaagtccgccgctattgatggggagtatagactgaaaggcgaaagccgcaagacatttgtggagcttatgcggagaggagacctgcccgtctggctcgcccacaaagtggcttctgaaggcatcaagtacaccgatcgcaaatggtgcttcgacgggcagcggaacaatcagatcctggaggagaacatggatgttgaaatttggacaaaggagggagagaagaagaagctgagaccgcgctggctcgacgcccggacgtattccgatcctcttgccctgaaagagtttaaggacttcgctgcgggcagaaaaagcatcgccctggatctcgtgaccgaaattgggcgcgtcccctctcacctggctcatagaacacggaatgcccttgacaacctggtgatgctccacacctccgagcatggaggcaaggcctaccgccacgctgtcgaggaactgcctgagacaatggaaaccctgctccttctgggcctgatgatcctcctgacagggggagccatgctttttctgattagcggcaaagggatcggaaagacctccatcggcctcatttgtgtgatcgcgtctagcgggatgctgtggatggccgagattcccctgcaatggatcgcttccgccattgttctcgagttctttatgatggtgcttctgatccctgaacccgagaagcagagaacaccgcaggataatcaactggcttatgtggtcattggaatcctcaccctggccgcgatcattgccgctaacgaaatgggccttctggagacaaccaaacgggacctcggcatgagcaaggaacctggggttgtgtctcccacgtcctacctggatgtggacctgcaccccgccagcgcttggacactctacgccgtcgctaccacagtgatcacccctatgcttcgccataccattgaaaattctacagccaacgttagcctggcggccatcgctaaccaggccgtggtcctgatgggactcgacaaaggctggccgatttccaagatggatctgggggtgccccttctggctctcggatgctattctcaggtcaatcctctgacgctgaccgccgccgtgctccttctgatcacacactacgcgatcattggccccgggctgcaggctaaagccaccagagaggctcaaaagcggacagccgccggaatcatgaagaaccctaccgttgacggcattatgacgatcgatctcgaccccgtgatttatgatagcaaattcgagaagcagctgggccaggtcatgcttctggtgctctgtgctgttcagctgctgctcatgagaacatcctgggccctttgcgaggcgctgaccctggccaccgggcctatcacaaccctctgggaaggatctccgggcaaattttggaatacaacgatcgctgtgagcatggccaacattttccgcgggtcctacctggctggagccggccttgcgtttagcatcatgaagtctgtcgggaccggaaaacggggcacaggctcccaaggggagaccctgggagaaaagtggaagaaaaagctcaatcagctgagcagaaaagagttcgacctgtataagaaatccggcattacagaggtggatcgcaccgaagccaaggaggggctcaaacggggagaaatcacgcatcacgctgtgtctagaggcagcgccaaacttcagtggtttgttgagcggaacatggtcattcccgaagggcgcgtgatcgacctgggatgtggcagaggcgggtggtcctactattgcgctggactgaagaaagtgaccgaggtccggggctacacaaaagggggacctggccatgaggaacccgttcctatgtctacctacgggtggaatattgtgaaactcatgagcggaaaggatgtgttctatctgcccccggagaaatgtgacacacttctgtgcgatatcggcgaatccagcccttctcccaccgtcgaggagtcccgcacaatcagagtgctcaagatggttgaaccctggctgaagaacaatcagttctgtattaaagtgctgaacccttacatgcccaccgtcatcgagcacctcgaacggcttcaacgcaagcacggcgggatgctggtgagaaatcctctgagccggaactctacgcatgagatgtattggatttccaatggaacaggcaacatcgttgccagcgtgaatatggtctctcgcctcctgcttaacagatttaccatgacccaccggagaccgacaattgaaaaagacgtggatctgggggctggaacgcgccatgtgaacgccgagcccgagacccctaatatggacgtcatcggcgaacggatcaagagaattaaagaggaacacaacagcacatggcactacgacgatgagaatccctataagacctgggcgtaccatgggtcctatgaagttaaggccacaggatctgctagctccatgatcaacggcgtggtgaaactcctgaccaagccttgggacgtcgtgcccatggttacacagatggccatgaccgatacgaccccgttcggccagcaacgcgtgtttaaagagaaggtcgacacacggacccctagaagcatgcccgggacacgccgggtgatgggaattaccgctgagtggctgtggagaacgctcggccgcaataaaaagcctcggctgtgcacaagagaagagttcaccaagaaagttcgcacaaacgccgccatgggggcggtgtttaccgaagagaatcagtgggattccgctaaggccgccgtcgaagacgaggatttctggaaacttgtggaccgggagagagaactgcacaagctcggaaaatgtggctcttgcgtttacaacatgatggggaagcgcgagaaaaagctgggcgaatttggaaaggctaaaggcagcagagccatctggtacatgtggcttggggctcggtatctggagttcgaggccctcggatttctgaatgaagatcattggttctcccgcgagaactcttacagcggcgtggaaggggagggactgcacaagctcggctatattctgagagacatctccaaaatccccgggggcgcgatgtacgccgatgacacggctggatgggacacccggattacagaagatgaccttcataatgaggagaagatcacccagcagatggatcctgaacacagacaactggccaacgctatttttaaactcacatatcagaataaggtcgtgaaggtccagcggcccaccccgacaggcaccgtgatggacatcatttctcgcaaagatcagagagggagcggacaagttggcacgtacgggctgaacacattcaccaatatggaggcccagcttatccggcagatggaaggagagggcgtgctgtccaaggcggacctcgaaaaccctcatctgcccgagaaaaagatcacccagtggctggagacaaacggggtcgaacgcctcaaaagaatggccattagcggcgatgactgcgtggtgaagcccatcgatgaccggtttgctaatgccctgcttgctctgaacgatatgggaaaggttcgcaaagacattcctcaatggcagccgtctaagggctggcatgattggcaacaggtgcccttctgttcccaccatttccacgagctcatcatgaaagacgggagaaagctggtcgtgccttgccggccccaagacgaacttattggacgcgccagaatcagccagggcgctgggtggtctctgcgggagaccgcctgtctcggaaaagcgtatgcccagatgtggtccctgatgtactttcaccgcagagatctgcggctcgctagcaatgccatttgctctgccgttcctgtgcattgggtccccacatcccgcacgacctggagcatccacgctcatcaccaatggatgacaaccgaagacatgctgacagtgtggaacagagtctggatcgaggataatccttggatggaggacaagacccccgtgacgacctgggaaaacgttccgtaccttggcaagcgggaggatcagtggtgtgggtccctgattggcctcacaagcagagccacctgggcgcagaatatccctacagctattcagcaagtgcgctctctgatcggaaacgaagagttccttgactatatgcccagcatgaaacggtttagaaaggaggaagagtccgaaggcgccatttggtga

SEQ ID NO: 20765 - RNA, 9873 nt, synthetic construct
  misc_feature 1..9873: note = derived and/or modified CDS sequence (opt5) from DENV-3__FJ639765__SS-prME
  source 1..9873: mol_type = other RNA
accagcctgtgcctcatgatgatcctgcccgccgctcttgccttccacctgacatcccgggacggcgagcctcggatgattgtggggaagaacgaacgcggaaagtctctcctgtttaagacggcgagcggcatcaatatgtgtacccttattgctatggatctgggggaaatgtgcgacgatacagtgacctacaagtgtccgcacatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacatcattggagtgctggagcagggcaaacggacgcttacccctcagcccatggagctgaagtactcttggaaaacatgggggaaggccaagatcgtcaccgccgaaacacaaaactccagcttcattatcgatggacctaatacccccgagtgcccgtctgcttccagagcgtggaacgtgtgggaagtggaggactatggctttggcgtcttcacaaccaatatctggctcaaactgcgcgaagtttacacgcagctgtgtgaccaccggcttatgagcgccgctgtgaaggatgagagagccgtgcacgccgacatggggtactggattgagtcccagaaaaacggatcttggaagctcgaaaaagctagcctgatcgaggtcaagacatgcacctggcctaagtcccataccctgtggtctaatggcgtgctcgaaagcgatatgattatccccaaatccctggccgggcctattagccagcacaactatcgccccggataccatacacaaaccgcgggcccttggcaccttgggaagctggagctcgactttaattattgcgagggaacgacagttgtgatcaccgaaaactgtggcacacggggcccctctctgagaaccacaaccgtctccgggaaactgatccacgagtggtgctgtcgcagctgcacgcttccgcctctccggtacatgggagaagatggctgttggtatgggatggagattagacccatctctgaaaaggaggagaatatggtgaaatccctggttagcgctggatctggcgaagtggacaacttcaccatgggggtcctgtgcctcgccattctgtttgaggaagtgatgcggggaaagttcggcaagaaacatatgatcgccggcgttttctttacattcgtgcttctgctcagcgggcagattacctggcgcgatatggctcacacactgatcatgattggatccaatgccagcgacagaatgggcatgggggtcacctacctggcgcttatcgctacgtttaagatccagcccttcctggccctcggatttttcctgcggaaactcacatctagagagaacctgcttctgggcgtggggctcgccatggctaccacactgcaactgcctgaagatattgagcagatggccaatggaatcgctcttggcctgatggccctcaagctgattacccagtttgagacctatcagctctggacagcgctgatctcccttacgtgtagcaacaccattttcacactgaccgtggcctggcgcacagctaccctcatcctggccggcgtctccctgcttccggtttgccaatctagctccatgcggaaaacggactggctgcccatgacagtggctgccatgggggtgcctcccctccctctgtttatcttctctctcaaggataccctgaagagacgcagctggccccttaatgaaggagtcatggccgtgggcctggtttccattctggcttctagcctcctgagaaacgacgtgcctatggcggggccccttgtcgccggaggcctgctcatcgcttgttacgtgattaccgggacatccgccgatctgaccgttgagaaagccgctgacgtgacatgggaagaggaagccgagcagacgggagtcagccataacctcatgatcaccgtggacgatgacggcacaatgcggattaaggatgacgagaccgaaaatatcctgacagtccttctgaaaaccgcgctgctcatcgtgtctggcatttttccgtactccatccctgctacgctgcttgtttggcacacctggcagaagcagacacaacgcagcggggtgctgtgggatgtcccctctcctcccgagacccagaaagccgaactcgaggagggagtgtatagaattaagcagcagggcatcttcgggaaaacacaagttggagtgggcgtccagaaggaaggggtgtttcataccatgtggcacgtgacacggggagccgttctgacgtacaacggcaagcgcctcgagccgaattgggcttccgtcaaaaaggacctgattagctatggcgggggatggagactttctgcccagtggcaaaaaggcgaagaggtccaggtgatcgcggtcgaacctgggaagaaccccaaaaatttccagaccatgcctggaacattccagaccaccacaggcgagattggggctatcgccctggattttaagcccggaacgtccggcagccccatcattaaccgggagggcaaggtggttgggctgtacggaaatggcgtggtcaccaaaaacgggggatatgtgtccggcatcgcccaaacaaatgctgaacctgacgggccgacccccgagctcgaagaggaaatgttcaagaaacgcaacctgacaattatggatcttcaccctggcagcggaaagaccagaaaatacctgcccgccatcgttcgggaggctattaagcgcagactccggacgctgatcctcgcccctacaagagtggtcgcggccgagatggaagaggctctgaagggccttcccatccgctatcagaccaccgccacaaaatctgaacataccgggcgggagattgtggacctgatgtgccacgctacatttaccatgagactgctcagccctgttcgcgtgccgaattacaacctgatcattatggatgaagcccatttcacggaccccgcctccatcgctgcgcggggatacatttctacaagagtcggcatgggggaggccgctgccatctttatgaccgccacacctcccggaaccgctgatgccttccctcagagcaatgcgcccatccaggacgaggaacgcgacattccggagcggtcctggaactctggcaatgaatggatcacggattttgctgggaagaccgtgtggttcgtgcctagcattaaagccggcaacgacatcgccaactgtcttagaaagaatggcaaaaaggtcattcaactgtcccgcaagacatttgataccgagtatcagaaaacaaagctcaacgactgggatttcgttgtgaccacagacatctctgagatgggagctaattttaaagccgatcgggtgattgaccccagacggtgcctgaagcccgtcatcctgaccgatgggcctgaacgcgtgatcctcgcgggacccatgcctgttacggccgctagcgccgctcagagacggggccgcgtggggagaaacccgcagaaagagaatgaccaatacattttcacaggacagccccttaacaatgatgaagaccacgcccattggaccgaggctaagatgctgctggacaacatcaatacccctgaaggcattatccccgccctcttcgagcctgagcgggaaaagtccgcggccattgatggggagtatagactgaaaggcgaaagccgcaagacatttgtcgagcttatgcggagaggagacctgcccgtgtggctcgctcacaaagttgcctctgaaggcatcaagtacaccgatcgcaaatggtgcttcgacgggcagcggaacaatcagatcctggaggagaacatggatgtggaaatttggacaaaggagggagagaagaagaagctgagaccgcgctggctcgacgctcggacgtattccgatcctcttgccctgaaagagtttaaggacttcgccgctggcagaaaaagcatcgcgctggatctcgtcaccgaaattgggcgcgtgcccacacacctggcccatagaacccggaatgctcttgacaacctggtcatgctccacacatctgagcatggaggcaaggcctaccgccacgccgtggaggaactgcctgagaccatggaaacgctgctccttctgggcctgatgatcctcctgaccgggggagctatgctttttctgatttccggcaaagggatcggaaagacaagcatcggcctcatttgtgttatcgcctcctctgggatgctgtggatggcggagattcccctgcaatggatcgccagcgctattatcctcgagttctttatgatggtgcttctgattcctgaacccgagaagcagagaaccccgcaggataatcaactggcctatgtggtcatcggaatcctcacactggctgccattatcgcggccaacgaaatgggccttctggagaccacgaaacgggacctcggcatgtccaaggaacctggggttgtgagccccacatcttacctggatgtggacctgcaccccgcttccgcctggaccctctacgctgtcgccacaaccgtgattacccctatgcttcgccatacaatcgagaatagcacggctaacgtttctctggccgcgattgccaaccaggctgtggtcctgatgggactcgacaaaggctggccgatcagcaagatggatctgggggtgccccttctggccctcggatgctattcccaggtcaatcctctgaccctgacagctgccgtgctccttctgatcacccactacgccattatcggccccgggctgcaggcgaaagctacaagagaggcccaaaagcggaccgctgccggaattatgaagaaccctacggttgacggcatcatgacaattgatctcgaccccgtgatctatgattctaaattcgaaaagcagctgggccaggtcatgcttctggtgctctgtgccgttcagctgctgctcatgagaaccagctgggctctttgcgaggccctgaccctggcgacagggcctatcaccacactctgggaaggatccccgggcaaattttggaatacgaccattgccgtgtctatggctaacatcttccgcgggagctacctggccggagctggccttgccttttccattatgaaaagcgtcgggacaggaaaacggggcaccggctctcaaggggagacactgggagaaaagtggaagaaaaagctcaatcagctgtccagaaaagagttcgacctgtataagaaaagcggcatcaccgaggtggatcgcacggaagcgaaggaggggctcaaacggggagaaattacccatcacgccgtgtccagaggctctgctaaacttcagtggtttgttgagcggaacatggtcatccccgaagggcgcgtgattgacctgggatgtggcagaggcgggtggagctactattgcgccggactgaagaaagtgacagaggtccggggctacaccaaagggggacctggccatgaggaacccgttcctatgtccacatacgggtggaatatcgtgaaactcatgtctggaaaggatgtgttctatctgcccccggagaaatgtgacacccttctgtgcgatatcggcgaaagctcccctagccccacagtcgaggagtctcgcaccattagagtgctcaagatggttgaaccctggctgaagaacaatcagttctgtatcaaagtgctgaacccttacatgcccacggtcattgagcacctcgaacggcttcaacgcaagcacggcgggatgctggtgagaaatcctctgtcccggaacagcacacatgagatgtattggatctctaatggaaccggcaacattgttgcttccgtgaatatggtcagccgcctcctgcttaacagatttaccatgacacaccggagaccgacgatcgaaaaagacgtggatctgggggccggaacccgccatgtgaacgctgagcccgagacacctaatatggacgtcatcggcgaacggattaagagaatcaaagaggaacacaactctacctggcactacgacgatgagaatccctataagacatgggcctaccatgggagctatgaagttaaggcgaccggatccgcctctagcatgattaacggcgtggtgaaactcctgacaaagccttgggacgtcgtgcccatggttacccagatggctatgacggataccacaccgttcggccagcaacgcgtgtttaaagagaaggtcgacacccggacacctagatccatgcccgggacccgccgggtgatgggaatcacggccgagtggctgtggagaacactcggccgcaataaaaagcctcggctgtgcaccagagaagagttcacaaagaaagttcgcaccaacgctgccatgggggccgtgtttacggaagagaatcagtgggatagcgcgaaggctgccgtcgaagacgaggatttctggaaacttgtggaccgggagagagaactgcacaagctcggaaaatgtggctcctgcgtttacaacatgatggggaagcgcgagaaaaagctgggcgaatttggaaaggccaaaggctctagagctatttggtacatgtggcttggggcccggtatctggagttcgaggctctcggatttctgaatgaagatcattggttcagccgcgagaactcctactctggcgtggaaggggagggactgcacaagctcggctatatcctgagagacatcagcaaaattcccgggggcgccatgtacgcggatgacaccgccggatgggacacacggatcaccgaagatgaccttcataatgaggagaagattacacagcagatggatcctgaacacagacaactggctaacgccatctttaaactcacctatcagaataaggtcgtgaaggtccagcggcccacaccgaccggcacggtgatggacattatctcccgcaaagatcagagagggtctggacaagttggcacatacgggctgaacaccttcaccaatatggaggctcagcttatccggcagatggaaggagagggcgtgctgagcaaggccgacctcgaaaaccctcatctgcccgagaaaaagattacacagtggctggagaccaaaggggtcgaacgcctcaagagaatggcgatctccggcgatgactgcgtggtgaagcccattgatgaccggtttgccaacgctctgcttgccctgaatgatatgggaaaagttcgcaaggacatccctcaatggcagccgagcaaaggctggcatgattggcaacaggtgcccttctgttctcaccatttccacgagctcattatgaaggacgggagaaaactggtcgtgccttgccggccccaagacgaacttatcggacgcgctagaatttcccagggcgccgggtggagcctgcgggagacagcttgtctcggaaaggcctatgcgcagatgtggtctctgatgtactttcaccgcagagatctgcggctcgcctccaacgctatctgcagcgccgttcctgtgcattgggtccccacgtctcgcaccacatggtccatccacgcccatcaccaatggatgaccacagaagacatgctgaccgtgtggaatagagtctggattgaggataacccttggatggaggacaagacgcccgtgaccacatgggaaaatgttccgtaccttggcaaacgggaggatcagtggtgtgggagcctgatcggcctcacctccagagctacatgggcccagaacattcctaccgcgatccagcaagtgcgcagcctgattggaaatgaagagttccttgactatatgccctctatgaagcggtttagaaaagaggaagagagcgaaggcgctatctggtga

SEQ ID NO: 20766 - RNA, 9873 nt, synthetic construct
  misc_feature 1..9873: note = derived and/or modified CDS sequence (opt5) from DENV-3__FJ639766__SS-prME
  source 1..9873: mol_type = other RNA
accagcctgtgcctcatgatgatcctgcccgccgctcttgccttccacctgacatcccgggacggcgagcctcggatgattgtggggaagaatgaacgcggaaagtctctcctgtttaagacggcgagcggcatcaatatgtgtacccttattgctatggatctgggggaaatgtgcgacgatacagtgacctacaaatgtccgcacatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggatacccggacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacatcattggagtgctggagcagggcaaacggacgcttacccctcagcccatggagctgaagtactcttggaaaacatgggggaaggccaagatcgtcaccgccgaaacacaaaactccagcttcattatcgatggacctaatacccccgagtgcccgtctgcttccagagcgtggaacgtgtgggaagtggaggactatggctttggcgtcttcacaaccaatatctggctcaaactgcgcgaagtttacacgcagctgtgtgaccaccggcttatgagcgccgctgtgaaggatgagagagccgtgcacgccgacatggggtactggattgagtcccagaaaaacggatcttggaagctcgaaaaagctagcctgatcgaggtcaagacatgcacctggcctaagtcccataccctgtggtctaatggcgtgctcgaaagcgatatgattatccccaaatccctggccgggcctattagccagcacaactatcgccccggataccatacacaaaccgcgggcccttggcaccttgggaagctggagctcgactttaattattgcgagggaacgacagttgtgatcaccgaaaactgtggcacacggggcccctctctgagaaccacaaccgtctccgggaaactgatccacgagtggtgctgtcgcagctgcacgcttccgcctctccggtacatgggagaagatggctgttggtatgggatggagattagacccatctctgaaaaggaggagaatatggtgaaatccctggttagcgctggatctggcgaagtggacaacttcaccatgggggtcctgtgcctcgccattctgtttgaggaagtgatgcggggaaagttcggcaagaaacatatgatcgccggcgttttctttacattcgtgcttctgctcagcgggcagattacctggcgcgatatggctcacacactgatcatgattggatccaatgccagcgacagaatgggcatgggggtcacctacctggcgcttatcgctacgtttaagatccagcccttcctggccctcggatttttcctgcggaaactcacatctagagagaacctgcttctgggcgtggggctcgccatggctaccacactgcaactgcctgaagatattgagcagatggccaatggaatcgctcttggcctgatggccctcaagctgattacccagtttgagacctatcagctctggacagcgctgatctcccttacgtgtagcaacaccattttcacactgaccgtggcctggcgcacagctaccctcatcctggccggcgtctccctgcttccggtttgccaatctagctccatgcggaaaacggactggctgcccatgacagtggctgccatgggggtgcctcccctccctctgtttatcttcaatctcaaggataccctgaagagacgctcttggccccttaacgaaggagtcatggccgtgggcctggttagcattctggcttcctctctcctgagaaacgacgtgcctatggcggggccccttgtcgccggaggcctgctcatcgcttgttacgtgattaccgggacaagcgccgatctgaccgttgagaaagccgctgacgtgacatgggaagaggaagccgagcagacgggagtctcccataatctcatgatcaccgtggacgatgacggcacaatgcggattaaggatgacgagaccgaaaacatcctgacagtccttctgaaaaccgcgctgctcatcgtgagcggcatttttccgtactctatccctgctacgctgcttgtttggcacacctggcagaagcagacacaacgctccggggtgctgtgggatgtccccagccctcccgagacccagaaagccgaactcgaggagggagtgtatagaattaagcagcagggcatcttcgggaaaacacaagttggagtgggcgtccagaaggaaggggtgtttcataccatgtggcacgtgacacggggagccgttctgacgtacaatggcaagcgcctcgagccgaactgggcttctgtcaaaaaggacctgatttcctatggcgggggatggagacttagcgcccagtggcaaaaaggcgaagaggtccaggtgatcgcggtcgaacctgggaagaatcccaaaaacttccagaccatgcctggaacattccagaccaccacaggcgagattggggctatcgccctggattttaagcccggaacgtctggctcccccatcattaatcgggagggcaaggtggttgggctgtacggaaacggcgtggtcaccaaaaatgggggatatgtgagcggcatcgcccaaacaaacgctgaacctgacgggccgacccccgagctcgaagaggaaatgttcaagaaacgcaatctgacaattatggatcttcaccctggctccggaaagaccagaaaatacctgcccgccatcgttcgggaggctattaagcgcagactccggacgctgatcctcgcccctacaagagtggtcgcggccgagatggaagaggctctgaagggccttcccatccgctatcagaccaccgccacaaaaagcgaacataccgggcgggagattgtggacctgatgtgccacgctacatttaccatgagactgctctctcctgttcgcgtgccgaactacaatctgatcattatggatgaagcccatttcacggaccccgccagcatcgctgcgcggggatacatttccacaagagtcggcatgggggaggccgctgccatctttatgaccgccacacctcccggaaccgctgatgccttccctcagtctaacgcgcccatccaggacgaggaacgcgacattccggagcggagctggaactccggcaacgaatggatcacggattttgctgggaagaccgtgtggttcgtgccttctattaaagccggcaacgacatcgccaattgtcttagaaagaacggcaaaaaggtcattcaactgagccgcaagacatttgataccgagtatcagaaaacaaagctcaatgactgggatttcgttgtgaccacagacatctccgagatgggagctaactttaaagccgatcgggtgattgaccccagacggtgcctgaagcccgtcatcctgaccgatgggcctgaacgcgtgatcctcgcgggacccatgcctgttacggccgcttctgccgctcagagacggggccgcgtggggagaaatccgcagaaagagaacgaccaatacattttcacaggacagccccttaataacgatgaagaccacgcccattggaccgaggctaagatgctgctggacaatatcaacacccctgaaggcattatccccgccctcttcgagcctgagcgggaaaagagcgcggccattgatggggagtatagactgaaaggcgaatcccgcaagacatttgtcgagcttatgcggagaggagacctgcccgtgtggctcgctcacaaagttgccagcgaaggcatcaagtacaccgatcgcaaatggtgcttcgacgggcagcggaataaccagatcctggaggagaatatggatgtggaaatttggacaaaggagggagagaagaagaagctgagaccgcgctggctcgacgctcggacgtattctgatcctcttgccctgaaagagtttaaggacttcgccgctggcagaaaatccatcgcgctggatctcgtcaccgaaattgggcgcgtgcccacacacctggcccatagaacccggaacgctcttgacaatctggtcatgctccacacaagcgagcatggaggcaaggcctaccgccacgccgtggaggaactgcctgagaccatggaaacgctgctccttctgggcctgatgatcctcctgaccgggggagctatgctttttctgatttctggcaaagggatcggaaagacatccatcggcctcatttgtgttatcgccagctccgggatgctgtggatggcggagattcccctgcaatggatcgcctctgctattgtgctcgagttctttatgatggtgcttctgatccctgaacccgagaagcagagaaccccgcaggataaccaactggcctatgtcgttattggaatcctcacactggctgccatcattgcggccaatgaaatgggccttctggagaccacgaaacgggacctcggcatgagcaaggaacctggggtggtgtcccccacaagctacctggatgtcgacctgcaccccgcttctgcctggaccctctacgctgtggccacaaccgttatcacccctatgcttcgccatacaattgagaactccacggctaacgtgagcctggccgcgatcgccaatcaggctgtcgtgctgatgggactcgacaaaggctggccgatttctaagatggatctgggggtcccccttctggccctcggatgctatagccaggtgaaccctctgaccctgacagctgccgttctccttctgatcacccactacgccatcattggccccgggctgcaggcgaaagctacaagagaggcccaaaagcggaccgctgccggaatcatgaagaatcctacggtggacggcattatgacaatcgatctcgaccccgtcatttatgattccaaattcgaaaagcagctgggccaggtgatgcttctggttctctgtgccgtgcagctgctgctcatgagaacctcttgggctctttgcgaggccctgaccctggcgacagggcctatcaccacactctgggaaggaagcccgggcaaattttggaacacgaccatcgccgtctccatggctaatattttccgcgggtcttacctggccggagctggccttgcctttagcatcatgaagtccgtggggacaggaaaacggggcaccggcagccaaggggagacactgggagaaaagtggaagaaaaagctcaaccagctgtctagaaaagagttcgacctgtataagaaatccggcattaccgaggtggatcgcacggaagcgaaggaggggctcaaacggggagaaatcacccatcacgccgttagcagaggctccgctaaacttcagtggtttgtcgagcggaatatggtgattcccgaagggcgcgtgatcgacctgggatgtggcagaggcgggtggtcttactattgcgccggactgaagaaagtcacagaggttcggggctacaccaaagggggacctggccatgaggaacccgtgcctatgagcacatacgggtggaacattgtgaaactcatgtccggaaaggatgtcttctatctgcccccggagaaatgtgacacccttctgtgcgatatcggcgaatctagcccttcccccacagtggaggagagccgcaccatcagagttctcaagatggtggaaccctggctgaagaataaccagttctgtattaaagtcctgaatccttacatgcccacggtgatcgagcacctcgaacggcttcaacgcaagcacggcgggatgctggttagaaaccctctgtctagaaattccacacatgagatgtattggattagcaacggaaccggcaatatcgtggcttctgtcaacatggtgtcccgcctcctgcttaacagatttaccatgacacaccggagaccgacgattgaaaaagacgtggatctgggggccggaacccgccatgtcaatgctgagcccgagacacctaacatggacgttatcggcgaacggatcaagagaattaaagaggaacacaatagcacctggcactacgacgatgagaacccctataagacatgggcctaccatgggtcttatgaagtgaaggcgaccggaagcgcctcctctatgatcaatggcgtggtcaaactcctgacaaagccttgggacgtggttcccatggtgacccagatggctatgacggataccacaccgttcggccagcaacgcgtctttaaagagaaggtggacacccggacacctagaagcatgcccgggacccgccgggttatgggaattacggccgagtggctgtggagaacactcggccgcaacaaaaagcctcggctgtgcaccagagaagagttcacaaagaaagtgcgcaccaatgctgccatgggggccgtctttacggaagagaaccagtgggattccgcgaaggctgccgtggaagacgaggatttctggaaacttgttgaccgggagagagaactgcacaagctcggaaaatgtggcagctgcgtgtacaatatgatggggaagcgcgagaaaaagctgggcgaatttggaaaggccaaaggctccagagctatctggtacatgtggcttggggcccggtatctggagttcgaggctctcggatttctgaacgaagatcattggttctctcgcgagaatagctactccggcgtcgaaggggagggactgcacaagctcggctatattctgagagacatctctaaaatccccgggggcgccatgtacgcggatgacaccgccggatgggacacacggattaccgaagatgaccttcataacgaggagaagatcacacagcagatggatcctgaacacagacaactggctaatgccatttttaaactcacctatcagaacaaggtggtcaaggtgcagcggcccacaccgaccggcacggttatggacatcattagccgcaaagatcagagagggtccggacaagtgggcacatacgggctgaataccttcaccaacatggaggctcagcttatccggcagatggaaggagagggcgtcctgtctaaggccgacctcgaaaaccctcatctgcccgagaaaaagatcacacagtggctggagaccaaaggggtggaacgcctcaagagaatggcgattagcggcgatgactgcgtggttaagcccatcgatgaccggtttgccaatgctctgcttgccctgaacgatatgggaaaagtgcgcaaggacattcctcaatggcagccgtccaaaggctggcatgattggcagcaggtccccttctgtagccaccatttccacgagctcatcatgaaggacgggagaaaactggtggttccttgccggccccaagacgaacttattggacgcgctagaatctctcagggcgccgggtggtccctgcgggagacagcttgtctcggaaaggcctatgcgcagatgtggagcctgatgtactttcaccgcagagatctgcggctcgcctctaatgctatttgctccgccgtgcctgtccattgggtgcccacgagccgcaccacatggtctatccacgcccatcaccaatggatgaccacagaagacatgctgaccgtctggaacagagtgtggatcgaggataatccttggatggaggacaagacgcccgttaccacatgggaaaacgtgccgtaccttggcaaacgggaggatcagtggtgtgggtccctgattggcctcaccagcagagctacatgggcccagaatatccctaccgcgattcagcaagtccgctccctgatcggaaacgaagagttccttgactatatgcccagcatgaagcggtttagaaaagaggaagagtctgaaggcgctatttggtga

SEQ ID NO: 20767 - RNA, 9873 nt, synthetic construct
  misc_feature 1..9873: note = derived and/or modified CDS sequence (opt5) from DENV-3__FJ639767__SS-prME
  source 1..9873: mol_type = other RNA
accagcctgtgcctcatgatgatcctgcccgccgctcttgccttccacctgacgtcccgggacggcgaacctcggatgattgtggggaagaacgaacgcggaaagtctctcctgtttaagacggcgagcggcatcaatatgtgtacccttattgctatggatctgggggagatgtgcgacgatacagtgacctacaaatgtccgcacatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacatcattggagtgctggagcagggcaaacggacgcttacccctcagcccatggagctgaagtactcttggaaaacatgggggaaggccaagatcgtcaccgccgaaacacaaaactccagcttcattatcgatggacctaatacccccgagtgcccgtctgcttccagagcgtggaacgtgtgggaagtggaggactatggctttggcgtcttcacaaccaatatctggctcaaactgcgcgaagtttacacgcagctgtgtgaccaccggcttatgagcgccgctgtgaaggatgagagagccgtgcacgccgacatggggtactggattgagtcccagaaaaacggatcttggaagctcgaaaaagctagcctgatcgaggtcaagacatgcacctggcctaagtcccataccctgtggtctaatggcgtgctcgaaagcgatatgattatccccaaatccctggccgggcctattagccagcacaactatcgccccggataccatacacaaaccgcgggcccttggcaccttgggaagctggagctcgactttaattattgcgagggaacgacagttgtgatcaccgaaaactgtggcacacggggcccctctctgagaaccacaaccgtctccgggaaactgatccacgagtggtgctgtcgcagctgcacgcttccgcctctccggtacatgggagaagatggctgttggtatgggatggagattagacccatctctgaaaaggaggagaatatggtgaaatccctggttagcgctggatctggcgaagtggacaacttcaccatgggggtcctgtgcctcgccattctgtttgaggaagtgatgcggggaaagttcggcaagaaacatatgatcgccggcgttttctttacattcgtgcttctgctcagcgggcagattacctggcgcgatatggctcacacactgatcatgattggatccaatgccagcgacagaatgggcatgggggtcacctacctggcgcttatcgctacgtttaagatccagcccttcctggccctcggatttttcctgcggaaactcacatctagagagaacctgcttctgggcgtggggctcgccatggctaccacactgcaactgcctgaagatattgagcagatggccaatggaatcgctcttggcctgatggccctcaagctgattacccagtttgagacctatcagctctggacagcgctgatctcccttacgtgtagcaacaccattttcacactgaccgtggcctggcgcacagctaccctcatcctggccggcgtctccctgcttccggtttgccaatctagctccatgcggaaaacggactggctgcccatgacagtggctgccatgggggtgcctcccctccctctgtttatcttctctctcaaggataccctgaagagacgcagctggccccttaatgaaggagtcatggccgtgggcctggtttccattctggcttctagcctcctgagaaacgacgtgcctatggcggggccccttgtcgccggaggcctgctcatcgcttgttacgtgattaccgggacatccgccgatctgaccgttgagaaagccgctgacgtgacatgggaagaggaagccgagcagacgggagtcagccataacctcatgatcaccgtggacgatgacggcacaatgcggattaaggatgacgagaccgaaaatatcctgacagtccttctgaaaaccgcgctgctcatcgtgtctggcatttttccgtactccatccctgctacgctgcttgtttggcacacctggcagaagcagacacaacgcagcggggtgctgtgggatgtcccctctcctcccgagacccagaaagccgaactcgaggagggagtgtatagaattaagcagcagggcatcttcgggaaaacacaagttggagtgggcgtccagaaggaaggggtgtttcataccatgtggcacgtgacacggggagccgttctgacgtacaacggcaagcgcctcgagccgaattgggcttccgtcaaaaaggacctgattagctatggcgggggatggagactttctgcccagtggcaaaaaggcgaagaggtccaggtgatcgcggtcgaacctgggaagaaccccaaaaatttccagaccatgcctggaacattccagaccaccacaggcgagattggggctatcgccctggattttaagcccggaacgtccggcagccccatcattaaccgggagggcaaggtggttgggctgtacggaaatggcgtggtcaccaaaaacgggggatatgtgtccggcatcgcccaaacaaatgctgaacctgacgggccgacccccgagctcgaagaggaaatgttcaagaaacgcaacctgacaattatggatcttcaccctggcagcggaaagaccagaaaatacctgcccgccatcgttcgggaggctattaagcgcagactccggacgctgatcctcgcccctacaagagtggtcgcggccgagatggaagaggctctgaagggccttcccatccgctatcagaccaccgccacaaaatctgaacataccgggcgggagattgtggacctgatgtgccacgctacatttaccatgagactgctcagccctgttcgcgtgccgaattacaacctgatcattatggatgaagcccatttcacggaccccgcctccatcgctgcgcggggatacatttctacaagagtcggcatgggggaggccgctgccatctttatgaccgccacacctcccggaaccgctgatgccttccctcagagcaatgcgcccatccaggacgaggaacgcgacattccggagcggtcctggaactctggcaatgaatggatcacggattttgctgggaagaccgtgtggttcgtgcctagcattaaagccggcaacgacatcgccaactgtcttagaaagaatggcaaaaaggtcattcaactgtcccgcaagacatttgataccgagtatcagaaaacaaagctcaacgactgggatttcgttgtgaccacagacatctctgagatgggagctaattttaaagccgatcgggtgattgaccccagacggtgcctgaagcccgtcatcctgaccgatgggcctgaacgcgtgatcctcgcgggacccatgcctgttacggccgctagcgccgctcagagacggggccgcgtggggagaaacccgcagaaagagaatgaccaatacattttcacaggacagccccttaacaatgatgaagaccacgcccattggaccgaggctaagatgctgctggacaacatcaatacccctgaaggcattatccccgccctcttcgagcctgagcgggaaaagtccgcggccattgatggggagtatagactgaaaggcgaaagccgcaagacatttgtcgagcttatgcggagaggagacctgcccgtgtggctcgctcacaaagttgcctctgaaggcatcaagtacaccgatcgcaaatggtgcttcgacgggcagcggaacaatcagatcctggaggagaacatggatgtggaaatttggacaaaggagggagagaagaagaagctgagaccgcgctggctcgacgctcggacgtattccgatcctcttgccctgaaagagtttaaggacttcgccgctggcagaaaaagcatcgcgctggatctcgtcaccgaaattgggcgcgtgccctctcacctggcccatagaacacggaatgctcttgacaacctggtcatgctccacacctccgagcatggaggcaaggcctaccgccacgccgtggaggaactgcctgagacaatggaaaccctgctccttctgggcctgatgatcctcctgacagggggagctatgctttttctgattagcggcaaagggatcggaaagacctccatcggcctcatttgtgttatcgcctctagcgggatgctgtggatggcggagattcccctgcaatggatcgcctccgctattgtgctcgagttctttatgatggtgcttctgatccctgaacccgagaagcagagaacaccgcaggataatcaactggcctatgtcgttattggaatcctcaccctggctgccatcattgcggccaacgaaatgggccttctggagacaaccaaacgggacctcggcatgagcaaggaacctggggtggtgtctcccatctcctacctggatgtcgacctgcaccccgctagcgcctggacgctctacgctgtggccacaaccgttattacacctatgcttcgccataccatcgaaaattctaccgctaacgtgagcctggccgcgattgccaaccaggctgtcgtgctgatgggactcgacaaaggctggccgatctccaagatggatctgggggtcccccttctggccctcggatgctattctcaggtgaatcctctgacactgacggctgccgttctccttctgatcacccactacgccattatcggccccgggctgcaggcgaaagctacaagagaggcccaaaagcggaccgctgccggaattatgaagaaccctacagtggacggcatcatgaccattgatctcgaccccgtcatctatgatagcaaattcgagaagcagctgggccaggtgatgcttctggttctctgtgccgtgcagctgctgctcatgagaacgtcctgggctctttgcgaggccctgacactggcgaccgggcctatcaccacactctgggaaggatctccgggcaaattttggaataccacaattgccgtcagcatggctaacatcttccgcgggtcctacctggccggagctggccttgcctttagcattatgaagtctgtggggacgggaaaacggggcaccggctcccaaggggagacactgggagaaaagtggaagaaaaagctcaatcagctgagcagaaaagagttcgacctgtataagaaatccggcatcaccgaggtggatcgcacagaagcgaaggaggggctcaaacggggagaaattacccatcacgccgtttctagaggcagcgctaaacttcagtggtttgtcgagcggaacatggtgatccccgaagggcgcgtgattgacctgggatgtggcagaggcgggtggtcctactattgcgccggactgaagaaagtcacggaggttcggggctacaccaaagggggacctggccatgaggaacccgtgcctatgtctacatacgggtggaatatcgtgaaactcatgagcggaaaggatgtcttctatctgcccccggagaaatgtgacacccttctgtgcgatatcggcgaatccagcccttctcccacagtggaggagtcccgcaccattagagttctcaagatggtggaaccctggctgaagaacaatcagttctgtatcaaagtcctgaacccttacatgcccacagtgattgagcacctcgaacggcttcaacgcaagcacggcgggatgctggttagaaatcctctgagccggaactctacccatgagatgtattggatctccaatggaacgggcaacattgtggctagcgtcaatatggtgtctcgcctcctgcttaacagatttacaatgacccaccggagaccgaccatcgaaaaagacgtggatctgggggccggaacacgccatgtcaacgctgagcccgagacgcctaatatggacgttatcggcgaacggattaagagaatcaaagaggaacacaacagcacctggcactacgacgatgagaatccctataagacatgggcctaccatgggtcctatgaagtgaaggcgaccggatctgccagctccatgattaacggcgtggtcaaactcctgacaaagccttgggacgtggttcccatggtgacccagatggctatgacagataccacgccgttcggccagcaacgcgtctttaaagagaaggtggacacccggacacctagaagcatgcccgggacccgccgggttatgggaatcacagccgagtggctgtggagaaccctcggccgcaataaaaagcctcggctgtgcacgagagaagagttcacaaagaaagtgcgcaccaacgctgccatgggggccgtctttacagaagagaatcagtgggattccgcgaaggctgccgtggaagacgaggatttctggaaacttgttgaccgggagagagaactgcacaagctcggaaaatgtggctcttgcgtgtacaacatgatggggaagcgcgagaaaaagctgggcgaatttggaaaggccaaaggcagcagagctatttggtacatgtggcttggggcccggtatctggagttcgaggctctcggatttctgaatgaagatcattggttctcccgcgagaactcttacagcggcgtcgaaggggagggactgcacaagctcggctatatcctgagagacatctccaaaattcccgggggcgccatgtacgcggatgacaccgccggatgggacacgcggatcaccgaagatgaccttcataatgaggagaagattacacagcagatggatcctgaacacagacaactggctaacgccatctttaaactcacctatcagaataaggtggtcaaggtgcagcggcccacaccgaccggcacagttatggacattatctctcgcaaagatcagagagggagcggacaagtgggcacctacgggctgaacacgttcacaaatatggaggctcagcttatccggcagatggaaggagagggcgtcctgtccaaggccgacctcgaaaaccctcatctgcccgagaaaaagattacccagtggctggagaccaaaggggtggaacgcctcaagagaatggcgatcagcggcgatgactgcgtggttaagcccattgatgaccggtttgccaacgctctgcttgccctgaatgatatgggaaaagtgcgcaaggacatccctcaatggcagccgtctaaaggctggcatgattggcagcaggtccccttctgttcccaccatttccacgagctcattatgaaggacgggagaaaactggtggttccttgccggccccaagacgaacttatcggacgcgctagaattagccagggcgccgggtggtctctgcgggagacagcttgtctcggaaaggcctatgcgcagatgtggtccctgatgtactttcaccgcagagatctgcggctcgccagcaacgctatctgctctgccgtgcctgtccattgggtgcccacctcccgcacaacgtggagcatccacgcccatcaccaatggatgaccacagaagacatgctgaccgtctggaatagagtgtggattgaggataacccttggatggaggacaagacacccgttaccacgtgggaaaatgtgccgtaccttggcaaacgggaggatcagtggtgtgggtccctgatcggcctcaccagcagagctacatgggcccagaacattcctaccgcgatccagcaagtccgctctctgattggaaatgaagagttccttgactatatgcccagcatgaagcggtttagaaaagaggaagagtccgaaggcgctatctggtga

SEQ ID NO: 20768 - RNA, 9873 nt, synthetic construct
  misc_feature 1..9873: note = derived and/or modified CDS sequence (opt5) from DENV-3__FJ639768__SS-prME
  source 1..9873: mol_type = other RNA
accagcctctgcctcatgatgatcctgcccgccgctcttgccttccacctgacgtcccgggacggcgaacctcggatgattgtggggaagaatgaacgcggaaagtctctcctgtttaagacggcgagcggcatcaatatgtgtacccttattgctatggatctgggggagatgtgcgacgatacagtgacctacaaatgtccgcatatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacatcattggagtgctggagcagggcaaacggacgcttacccctcagcccatggagctgaagtactcttggaaaacatgggggaaggccaagatcgtcaccgccgaaacacaaaactccagcttcattatcgatggacctaatacccccgagtgcccgtctgcttccagagcgtggaacgtgtgggaagtggaggactatggctttggcgtcttcacaaccaatatctggctcaaactgcgcgaagtttacacgcagctgtgtgaccaccggcttatgagcgccgctgtgaaggatgagagagccgtgcacgccgacatggggtactggattgagtcccagaaaaacggatcttggaagctcgaaaaagctagcctgatcgaggtcaagacatgcacctggcctaagtcccataccctgtggtctaatggcgtgctcgaaagcgatatgattatccccaaatccctggccgggcctattagccagcacaactatcgccccggataccatacacaaaccgcgggcccttggcaccttgggaagctggagctcgactttaattattgcgagggaacgacagttgtgatcaccgaaaactgtggcacacggggcccctctctgagaaccacaaccgtctccgggaaactgatccacgagtggtgctgtcgcagctgcacgcttccgcctctccggtacatgggagaagatggctgttggtatgggatggagattagacccatctctgaaaaggaggagaatatggtgaaatccctggttagcgctggatctggcgaagtggacaacttcaccatgggggtcctgtgcctcgccattctgtttgaggaagtgatgcggggaaagttcggcaagaaacatatgatcgccggcgttttctttacattcgtgcttctgctcagcgggcagattacctggcgcgatatggctcacacactgatcatgattggatccaatgccagcgacagaatgggcatgggggtcacctacctggcgcttatcgctacgtttaagatccagcccttcctggccctcggatttttcctgcggaaactcacatctagagagaacctgcttctgggcgtggggctcgccatggctaccacactgcaactgcctgaagatattgagcagatggccaatggaatcgctcttggcctgatggccctcaagctgattacccagtttgagacctatcagctctggacagcgctgatctcccttacgtgtagcaacaccattttcacactgaccgtggcctggcgcacagctaccctcatcctggccggcgtctccctgcttccggtttgccaatctagctccatgcggaaaacggactggctgcccatgacagtggctgccatgggggtgcctcccctccctctgtttatcttctctctcaaggataccctgaagagacgcagctggccccttaatgaaggagtcatggccgtgggcctggtttccattctggcttctagcctcctgagaaacgacgtgcctatggcggggccccttgtcgccggaggcctgctcatcgcttgttacgtgattaccgggacatccgccgatctgaccgttgagaaagccgctgacgtgacatgggaagaggaagccgagcagacgggagtcagccataacctcatgatcaccgtggacgatgacggcacaatgcggattaaggatgacgagaccgaaaatatcctgacagtccttctgaaaaccgcgctgctcatcgtgtctggcatttttccgtactccatccctgctacgctgcttgtttggcacacctggcagaagcagacacaacgcagcggggtgctgtgggatgtcccctctcctcccgagacccagaaagccgaactcgaggagggagtgtatagaattaagcagcagggcatcttcgggaaaacacaagttggagtgggcgtccagaaggaaggggtgtttcataccatgtggcacgtgacacggggagccgttctgacgtacaacggcaagcgcctcgagccgaattgggcttccgtcaaaaaggacctgattagctatggcgggggatggagacttaacgcccagtggcaaaaaggcgaagaggtccaggtgatcgcggtcgaacctgggaagaatcccaaaaacttccagaccatgcctggaacattccagaccaccacaggcgagattggggctatcgccctggattttaagcccggaacgtctggctcccccatcattaatcgggagggcaaggtggttgggctgtacggaaacggcgtggtcaccaaaaatgggggatatgtgagcggcatcgcccaaacaaacgctgaacctgacgggccgacccccgagctcgaagaggaaatgttcaagaaacgcaatctgacaattatggatcttcaccctggctccggaaagaccagaaaatacctgcccgccatcgttcgggaggctattaagcgcagactccggacgctgatcctcgcccctacaagagtggtcgcggccgagatggaagaggctctgaagggccttcccatccgctatcagaccaccgccacaaaaagcgaacataccgggcgggagattgtggacctgatgtgccacgctacatttaccatgagactgctctctcctgttcgcgtgccgaactacaatctgatcattatggatgaagcccatttcacggaccccgccagcatcgctgcgcggggatacatttccacaagagtcggcatgggggaggccgctgccatctttatgaccgccacacctcccggaaccgctgatgccttccctcagtctaacgcgcccatccaggacgaggaacgcgacattccggagcggagctggaactccggcaacgaatggatcacggattttgctgggaagaccgtgtggttcgtgccttctattaaagccggcaacgacatcgccaattgtcttagaaagaacggcaaaaaggtcattcaactgagccgcaagacatttgataccgagtatcagaaaacaaagctcaatgactgggatttcgttgtgaccacagacatctccgagatgggagctaactttaaagccgatcgggtgattgaccccagacggtgcctgaagcccgtcatcctgaccgatgggcctgaacgcgtgatcctcgcgggacccattcctgttacggccgcttctgccgctcagagacggggccgcgtggggagaaatccgcagaaagagaacgaccaatacatcttcacaggacagccccttaataacgatgaagaccacgcccattggaccgaggctaagatgctgctggacaatattaacacccctgaaggcatcattcccgccctcttcgagcctgagcgggaaaagagcgcggccatcgatggggagtatagactgaaaggcgaatcccgcaagacatttgtcgagcttatgcggagaggagacctgcccgtgtggctcgctcacaaagttgccagcgaaggcatcaagtacaccgatcgcaaatggtgcttcgacgggcagcggaataaccagattctggaggagaatatggatgtggaaatctggacaaaggagggagagaagaagaagctgagaccgcgctggctcgacgctcggacgtattctgatcctcttgccctgaaagagtttaaggacttcgccgctggcagaaaatccattgcgctggatctcgtcaccgaaatcgggcgcgtgcccagccacctggcccatagaacacggaacgctcttgacaatctggtcatgctccacacctctgagcatggaggcaaggcctaccgccacgccgtggaggaactgcctgagacaatggaaaccctgctccttctgggcctgatgattctcctgacagggggagctatgctttttctgatctccggcaaagggatcggaaagaccagcattggcctcatctgtgttattgcctcctctgggatgctgtggatggcggagatccccctgcaatggattgccagcgctatcgtgctcgagttctttatgatggtgcttctgattcctgaacccgagaagcagagaacaccgcaggataaccaactggcctatgtcgttatcggaatcctcaccctggctgccattatcgcggccaatgaaatgggccttctggagacaaccaaacgggacctcggcatgtccaaggaacctggggtggtgagccccacgtcttacctggatgtcgacctgcaccccgcttccgcctggacactctacgctgtggccaccacagttattacccctatgcttcgccataccatcgagaacagcacagctaacgtgtctctggccgcgattgccaatcaggctgtcgtgctgatgggactcgacaaaggctggccgatcagcaagatggatctgggggtcccccttctggccctcggatgctattcccaggtgaaccctctgacgctgaccgctgccgttctccttctgatcacacactacgccattatcggccccgggctgcaggcgaaagctaccagagaggcccaaaagcggacagctgccggaattatgaagaatcctaccgtggacggcatcatgacgattgatctcgaccccgtcatctatgattctaaattcgaaaagcagctgggccaggtgatgcttctggttctctgtgccgtgcagctgctgctcatgagaacaagctgggctctttgcgaggccctgaccctggcgaccgggcctatcacaaccctctgggaaggatccccgggcaaattttggaacacaacgattgccgtctctatggctaatatcttccgcgggagctacattgccggagctggcctggccttttccatcatgaaaagcgtggggaccggaaaacggggcacaggctctcaaggggagacccttggagaaaagtggaagaaaaagctgaaccagctctccagaaaagagttcgacctgtataagaaaagcggcattacagaggtggatcgcaccgaagcgaaggaggggctgaaacggggagaaatcacgcatcacgccgtttccagaggctctgctaagctccagtggtttgtcgagcggaatatggtgattcccgaagggcgcgtgatcgaccttggatgtggcagaggcgggtggagctactattgcgccggactgaagaaagtcaccgaggttcggggctacacaaaagggggacctggccatgaggaacccgtgcctatgtccacctacgggtggaacatcgtgaaactgatgtctggaaaggatgtcttctatctgcccccggagaaatgtgacacactgctttgcgatattggcgaaagctcccctagccccaccgtggaggagtctcgcacaatcagagttctgaagatggtggaaccctggctcaagaataaccagttctgtattaaagtcctgaatccttacatgcccaccgtgatcgagcacctggaacggctccaacgcaagcacggcgggatgcttgttagaaaccctctgtcccggaatagcacgcatgagatgtattggatttctaacggaacaggcaatatcgtggcttccgtcaacatggtgagccgcctgctcctgaacagatttaccatgacccaccggagaccgacaatcgaaaaagacgtggatcttggggccggaacgcgccatgtcaatgctgagcccgagacccctaacatggacgttattggcgaacggatcaagagaattaaagaggaacacaattctacatggcactacgacgatgagaacccctataagacctgggcctaccatgggagctatgaagtgaaggcgacaggatccgcctctagcatgatcaatggcgtggtcaaactgctcaccaagccttgggacgtggttcccatggtgacacagatggctatgaccgatacgaccccgttcggccagcaacgcgtctttaaagagaaggtggacacacggacccctagatccatgcccgggacacgccgggttatgggaattaccgccgagtggctgtggagaacgctgggccgcaacaaaaagcctcggctctgcacaagagaagagttcaccaagaaagtgcgcacaaatgctgccatgggggccgtctttaccgaagagaaccagtgggatagcgcgaaggctgccgtggaagacgaggatttctggaaactggttgaccgggagagagaacttcacaagctgggaaaatgtggctcctgcgtgtacaatatgatggggaagcgcgagaaaaagctcggcgaatttggaaaggccaaaggctctagagctatctggtacatgtggctgggggcccggtatcttgagttcgaggctctgggatttctcaacgaagatcattggttcagccgcgaaaattcctactctggcgtcgagggggagggactgcacaagctgggctatatcctcagagacattagcaaaatccccgggggcgccatgtacgcggatgacacggccggatgggacacccggattacagaagatgacctgcataacgaggagaagatcacccagcagatggatcctgaacacagacaacttgctaatgccatttttaaactgacatatcagaacaaggtggtcaaggtgcagcggcccaccccgacaggcaccgttatggacatcatctcccgcaaagatcagagagggtctggacaagtgggcacgtacgggctcaatacattcaccaacatggaggctcagctgattcggcagatggaaggagagggcgtccttagcaaggccgacctggaaaaccctcacctccccgagaaaaagatcacccagtggctggagacaaaaggggtggaacgcctgaagagaatggcgatttccggcgatgactgcgtggttaagcccatcgatgaccggtttgccaatgctctcctggcccttaacgatatgggaaaagtgcgcaaggacattcctcaatggcagccgagcaaaggctggcatgattggcagcaggtccccttctgttctcaccatttccacgagctgatcatgaaggacgggagaaaactcgtggttccttgccggccccaagacgaactgattggacgcgctagaatctcccagggcgccgggtggagccttcgggagaccgcttgtctgggaaaggcctatgcgcagatgtggtctctcatgtactttcaccgcagagatctgcggctggcctccaatgctatctgcagcgccgtgcctgtccattgggtgcccacatctcgcacgacctggtccattcacgcccatcaccaatggatgacaaccgaagacatgctcacagtctggaacagagtgtggatcgaggataatccttggatggaggacaagacccccgttacgacctgggaaaacgtgccgtacctgggcaaacgggaggatcagtggtgtgggagccttattggcctgacatccagagctacctgggcccagaatatccctacagcgattcagcaagtccgcagcctcatcggaaacgaagagttcctggactatatgccctctatgaagcggtttagaaaagaggaagagagcgaaggcgctatctggtga

SEQ ID NO: 20769 - RNA, 9873 nt, synthetic construct
  misc_feature 1..9873: note = derived and/or modified CDS sequence (opt5) from DENV-3__FJ639769__SS-prME
  source 1..9873: mol_type = other RNA
accagcctgtgcctcatgatgatcctgcccgccgctcttgccttccacctgacatcccgggacggcgagcctcggatgattgtggggaagaacgaacgcggaaagtctctcctgtttaagacggcgagcggcatcaatatgtgtacccttattgctatggatctgggggaaatgtgcgacgatacagtgacctacaagtgtccgcacatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacatcattggagtgctggagcagggcaaacggacgcttacccctcagcccatggagctgaagtactcttggaaaacatgggggaaggccaagatcgtcaccgccgaaacacaaaactccagcttcattatcgatggacctaatacccccgagtgcccgtctgcttccagagcgtggaacgtgtgggaagtggaggactatggctttggcgtcttcacaaccaatatctggctcaaactgcgcgaagtttacacgcagctgtgtgaccaccggcttatgagcgccgctgtgaaggatgagagagccgtgcacgccgacatggggtactggattgagtcccagaaaaacggatcttggaagctcgaaaaagctagcctgatcgaggtcaagacatgcacctggcctaagtcccataccctgtggtctaatggcgtgctcgaaagcgatatgattatccccaaatccctggccgggcctattagccagcacaactatcgccccggataccatacacaaaccgcgggcccttggcaccttgggaagctggagctcgactttaattattgcgagggaacgacagttgtgatcaccgaaaactgtggcacacggggcccctctctgagaaccacaaccgtctccgggaaactgatccacgagtggtgctgtcgcagctgcacgcttccgcctctccggtacatgggagaagatggctgttggtatgggatggagattagacccatctctgaaaaggaggagaatatggtgaaatccctggttagcgctggatctggcgaagtggacaacttcaccatgggggtcctgtgcctcgccattctgtttgaggaagtgatgcggggaaagttcggcaagaaacatatgatcgccggcgttttctttacattcgtgcttctgctcagcgggcagattacctggcgcgatatggctcacacactgatcatgattggatccaatgccagcgacagaatgggcatgggggtcacctacctggcgcttatcgctacgtttaagatccagcccttcctggccctcggatttttcctgcggaaactcacatctagagagaacctgcttctgggcgtggggctcgccatggctaccacactgcaactgcctgaagatattgagcagatggccaatggaatcgctcttggcctgatggccctcaagctgattacccagtttgagacctatcagctctggacagcgctgatctcccttacgtgtagcaacaccattttcacactgaccgtggcctggcgcacagctaccctcatcctggccggcgtctccctgcttccggtttgccaatctagctccatgcggaaaacggactggctgcccatgacagtggctgccatgggggtgcctcccctccctctgtttatcttctctctcaaggataccctgaagagacgcagctggccccttaatgaaggagtcatggccgtgggcctggtttccattctggcttctagcctcctgagaaacgacgtgcctatggcggggccccttgtcgccggaggcctgctcatcgcttgttacgtgattaccgggacatccgccgatctgaccgttgagaaagccgctgacgtgacatgggaagaggaagccgagcagacgggagtcagccataacctcatgatcaccgtggacgatgacggcacaatgcggattaaggatgacgagaccgaaaatatcctgacagtccttctgaaaaccgcgctgctcatcgtgtctggcatttttccgtactccatccctgctacgctgcttgtttggcacacctggcagaagcagacacaacgcagcggggtgctgtgggatgtcccctctcctcccgagacccagaaagccgaactcgaggagggagtgtatagaattaagcagcagggcatcttcgggaaaacacaagttggagtgggcgtccagaaggaaggggtgtttcataccatgtggcacgtgacacggggagccgttctgacgtacaacggcaagcgcctcgagccgaattgggcttccgtcaaaaaggacctgattagctatggcgggggatggagactttctgcccagtggcaaaaaggcgaagaggtccaggtgatcgcggtcgaacctgggaagaaccccaaaaatttccagaccatgcctggaacattccagaccaccacaggcgagattggggctatcgccctggattttaagcccggaacgtccggcagccccatcattaaccgggagggcaaggtggttgggctgtacggaaatggcgtggtcaccaaaaacgggggatatgtgtccggcatcgcccaaacaaatgctgaacctgacgggccgacccccgagctcgaagaggaaatgttcaagaaacgcaacctgacaattatggatcttcaccctggcagcggaaagaccagaaaatacctgcccgccatcgttcgggaggctattaagcgcagactccggacgctgatcctcgcccctacaagagtggtcgcggccgagatggaagaggctctgaagggccttcccatccgctatcagaccaccgccacaaaatctgaacataccgggcgggagattgtggacctgatgtgccacgctacatttaccatgagactgctcagccctgttcgcgtgccgaattacaacctgatcattatggatgaagcccatttcacggaccccgcctccatcgctgcgcggggatacatttctacaagagtcggcatgggggaggccgctgccatctttatgaccgccacacctcccggaaccgctgatgccttccctcagagcaatgcgcccatccaggacgaggaacgcgacattccggagcggtcctggaactctggcaatgaatggatcacggattttgctgggaagaccgtgtggttcgtgcctagcattaaagccggcaacgacatcgccaactgtcttagaaagaatggcaaaaaggtcattcaactgtcccgcaagacatttgataccgagtatcagaaaacaaagctcaacgactgggatttcgttgtgaccacagacatctctgagatgggagctaattttaaagccgatcgggtgattgaccccagacggtgcctgaagcccgtcatcctgaccgatgggcctgaacgcgtgatcctcgcgggacccatgcctgttacggccgctagcgccgctcagagacggggccgcgtggggagaaacccgcagaaagagaatgaccaatacattttcacaggacagccccttaacaatgatgaagaccacgcccattggaccgaggctaagatgctgctggacaacatcaatacccctgaaggcattatccccgccctcttcgagcctgagcgggaaaagtccgcggccattgatggggagtatagactgaaaggcgaaagccgcaagacatttgtcgagcttatgcggagaggagacctgcccgtgtggctcgctcacaaagttgcctctgaaggcatcaagtacaccgatcgcaaatggtgcttcgacgggcagcggaacaatcagatcctggaggagaacatggatgtggaaatttggacaaaggagggagagaagaagaagctgagaccgcgctggctcgacgctcggacgtattccgatcctcttgccctgaaagagtttaaggacttcgccgctggcagaaaaagcatcgcgctggatctcgtcaccgaaattgggcgcgtgcccacacacctggcccatagaacccggaatgctcttgacaacctggtcatgctccacacatctgagcatggaggcaaggcctaccgccacgccgtggaggaactgcctgagaccatggaaacgctgctccttctgggcctgatgatcctcctgaccgggggagctatgctttttctgatttccggcaaagggatcggaaagacaagcatcggcctcatttgtgttatcgcctcctctgggatgctgtggatggcggagattcccctgcaatggatcgccagcgctattgtgctcgagttctttatgatggtgcttctgatccctgaacccgagaagcagagaaccccgcaggataatcaactggcctatgtcgttattggaatcctcacactggctgccatcattgcggccaacgaaatgggccttctggagaccacgaaacgggacctcggcatgtccaaggaacctggggtggtgagccccacatcttacctggatgtcgacctgcaccccgcttccgcctggaccctctacgctgtggccacaaccgttatcacccctatgcttcgccatacaattgagaatagcacggctaacgtgtctctggccgcgatcgccaaccaggctgtcgtgctgatgggactcgacaaaggctggccgattagcaagatggatctgggggtcccccttctggccctcggatgctattcccaggtgaatcctctgaccctgacagctgccgttctccttctgatcacccactacgccatcattggccccgggctgcaggcgaaagctacaagagaggcccaaaagcggaccgctgccggaatcatgaagaaccctacggtggacggcattatgacaatcgatctcgaccccgtcatttatgattctaaattcgaaaagcagctgggccaggtgatgcttctggttctctgtgtggtccagctgctgctcatgagaaccagctgggccctttgcgaggctctgaccctggccacagggcctatcaccacactctgggaaggatccccgggcaaattttggaatacgaccatcgcggtgtctatggccaacattttccgcgggagctacctggctggagccggccttgctttttccatcatgaaaagcgtggggacaggaaaacggggcaccggctctcaaggggagacactgggagaaaagtggaagaaaaagctcaatcagctgtccagaaaagagttcgacctgtataagaaaagcggcattaccgaggttgatcgcacggaagccaaggaggggctcaaacggggagaaatcacccatcacgcggtctccagaggctctgccaaacttcagtggtttgtggagcggaacatggtgattcccgaagggcgcgtcatcgacctgggatgtggcagaggcgggtggagctactattgcgctggactgaagaaagttacagaggtgcggggctacaccaaagggggacctggccatgaggaacccgtgcctatgtccacatacgggtggaatattgtcaaactcatgtctggaaaggatgtgttctatctgcccccggagaaatgtgacacccttctgtgcgatatcggcgaaagctcccctagccccacagttgaggagtctcgcaccatcagagtgctcaagatggtcgaaccctggctgaagaacaatcagttctgtattaaagtgctgaacccttacatgcccacggttatcgagcacctcgaacggcttcaacgcaagcacggcgggatgctggtgagaaatcctctgtcccggaacagcacacatgagatgtattggatttctaatggaaccggcaacatcgtcgcctccgtgaatatggtgagccgcctcctgcttaacagatttaccatgacacaccggagaccgacgattgaaaaagacgtcgatctgggggctggaacccgccatgttaacgccgagcccgagacacctaatatggacgtgatcggcgaacggatcaagagaattaaagaggaacacaactctacctggcactacgacgatgagaatccctataagacatgggcttaccatgggagctatgaagtgaaggccaccggatccgcgtctagcatgatcaacggcgtcgtgaaactcctgacaaagccttgggacgttgtgcccatggtcacccagatggccatgacggataccacaccgttcggccagcaacgcgtgtttaaagagaaggttgacacccggacacctagatccatgcccgggacccgccgggtgatgggaattacggctgagtggctgtggagaacactcggccgcaataaaaagcctcggctgtgcaccagagaagagttcacaaagaaagtccgcaccaacgccgctatgggggccgtgtttacggaagagaatcagtgggatagcgccaaggcggctgttgaagacgaggatttctggaaacttgtggaccgggagagagaactgcacaagctcggaaaatgtggctcctgcgtctacaacatgatggggaagcgcgagaaaaagctgggcgaatttggaaaggccaaaggctctagagccatctggtacatgtggcttggggctcggtatctggagttcgaggccctcggatttctgaatgaagatcattggttcagccgcgagaactcctactctggcgtggaaggggagggactgcacaagctcggctatattctgagagacatcagcaaaatccccgggggcgctatgtacgccgatgacaccgcgggatgggacacacggattaccgaagatgaccttcataatgaggagaagatcacacagcagatggatcctgaacacagacaactggccaacgctatttttaaactcacctatcagaataaggtcgtgaaggttcagcggcccacaccgaccggcacggtgatggacatcatttcccgcaaagatcagagagggtctggacaagtcggcacatacgggctgaacaccttcaccaatatggaggcccagcttatccggcagatggaaggagagggcgtgctgagcaaggctgacctcgaaaaccctcatctgcccgagaaaaagatcacacagtggctggagaccaaaggggtggaacgcctcaagagaatggccatttccggcgatgactgcgttgtgaagcccatcgatgaccggtttgcgaacgccctgcttgctctgaatgatatgggaaaagtccgcaaggacattcctcaatggcagccgagcaaaggctggcatgattggcaacaggtgcccttctgttctcaccatttccacgagctcatcatgaaggacgggagaaaactggttgtgccttgccggccccaagacgaacttattggacgcgccagaatctcccagggcgctgggtggagcctgcgggagacagcctgtctcggaaaggcttatgcccagatgtggtctctgatgtactttcaccgcagagatctgcggctcgcgtccaacgccatttgcagcgctgtccctgtgcattgggtccccacgtctcgcaccacatggtccatccacgcccatcaccaatggatgaccacagaagacatgctgaccgtgtggaatagagtttggatcgaggataacccttggatggaggacaagacgcccgtgaccacatgggaaaatgtcccgtaccttggcaaacgggaggatcagtggtgtgggagcctgattggcctcacctccagagccacatgggctcagaacatccctaccgccattcagcaagtgcgcagcctgatcggaaatgaagagttccttgactatatgccctctatgaagcggtttagaaaagaggaagagagcgaaggcgcgatttggtga

SEQ ID NO: 20770 - RNA, 9873 nt, synthetic construct
  misc_feature 1..9873: note = derived and/or modified CDS sequence (opt5) from DENV-3__FJ882577__SS-prME
  source 1..9873: mol_type = other RNA
accagcctgtgcctcatgatgatcctgcccgccgctcttgccttccacctgacatcccgggacggagagcctcggatgattgtggggaagaacgaacgcggaaagtctctcctgtttaagacggcgagcggcatcaatatgtgtacccttattgctatggatctgggggaaatgtgcgacgatacagtcacctacaagtgtccgcacatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacatcattggagtgctggagcagggcaaacggacgcttacccctcagcccatggagctgaagtactcttggaaaacatgggggaaggccaagatcgtcaccgccgaaacacaaaactccagcttcattatcgatggacctaatacccccgagtgcccgtctgcttccagagcgtggaacgtgtgggaagtggaggactatggctttggcgtcttcacaaccaatatctggctcaaactgcgcgaagtttacacgcagctgtgtgaccaccggcttatgagcgccgctgtgaaggatgagagagccgtgcacgccgacatggggtactggattgagtcccagaaaaacggatcttggaagctcgaaaaagctagcctgatcgaggtcaagacatgcacctggcctaagtcccataccctgtggtctaatggcgtgctcgaaagcgatatgattatccccaaatccctggccgggcctattagccagcacaactatcgccccggataccatacacaaaccgcgggcccttggcaccttgggaagctggagctcgactttaattattgcgagggaacgacagttgtgatcaccgaaaactgtggcacacggggcccctctctgagaaccacaaccgtctccgggaaactgatccacgagtggtgctgtcgcagctgcacgcttccgcctctccggtacatgggagaagatggctgttggtatgggatggagattagacccatctctgaaaaggaggagaatatggtgaaatccctggttagcgctggatctggcgaagtggacaacttcaccatgggggtcctgtgcctcgccattctgtttgaggaagtgatgcggggaaagttcggcaagaaacatatgatcgccggcattttctttacattcgttcttctgctcagcgggcagatcacctggcgcgatatggctcacacactgattatgatcggatccaatgccagcgacagaatgggcatgggggtgacctacctggcgcttatcgctacgtttaagattcagcccttcctggccctcggatttttcctgcggaaactcacatctagagagaacctgcttctgggcgtcgggctcgccatggctaccacactgcaactgcctgaagatatcgagcagatggccaatggaattgctcttggcctgatggccctcaagctgatcacccagtttgagacctatcagctctggacagcgctgatttcccttacgtgtagcaacaccatcttcacactgaccgtggcctggcgcacagctaccctcatcctggccggcgtgtccctgcttccggtctgccaatctagctccatgcggaaaacggactggctgcccatgacagttgctgccatgggggtgcctcccctccctctgtttattttctctctcaaggataccctgaagagacgcagctggccccttaatgaaggagtgatggccgtcggcctggtgtccatcctggcttctagcctcctgagaaacgacgttcctatggcggggccccttgtggccggaggcctgctcattgcttgttacgtcatcaccgggacatccgccgatctgaccgtggagaaagccgctgacgttacatgggaagaggaagccgagcagacgggagtgagccataacctcatgattaccgtcgacgatgacggcacaatgcggatcaaggatgacgagaccgaaaatatcctgacagtgcttctgaaaaccgcgctgctcattgtctctggcatctttccgtactccattcctgctacgctgcttgtgtggcacacctggcagaagcagacacaacgcagcggggttctgtgggatgtgccctctcctcccgagacccagaaagccgaactcgaggagggagtctatagaatcaagcagcagggcattttcgggaaaacacaagtgggagttggcgtgcagaaggaaggggtctttcataccatgtggcacgtgacacggggagccgtgctgacgtacaacggcaagcgcctcgagccgaattgggcttccgttaaaaaggacctgatcagctatggcgggggatggagactttctgcccagtggcaaaaaggcgaagaggtccaggtgattgcggtggaacctgggaagaaccccaaaaatttccagaccatgcctggaacattccagaccaccacaggcgagatcggggctatcgccctggattttaagcccggaacgtccggcagccccattatcaaccgggagggcaagattgtcgggctgtacggaaatggcgtggttaccaaaaacgggggatatgtgtccggcatcgcccaaacaaatgctgaacctgacgggccgacccccgagctcgaagaggaaatgttcaagaaacgcaacctgacaattatggatcttcaccctggcagcggaaagaccagaaaatacctgcccgccatcgtccgggaggctatcaagcgcagactccggacgctgattctcgcccctacaagagtggttgcggccgagatggaagaggctctgaagggccttcccatccgctatcagaccaccgccacaaaatctgaacataccgggcgggagattgtggacctgatgtgccacgctacatttaccatgagactgctcagccctgtccgcgtgccgaattacaacctgatcattatggatgaagcccatttcacggaccccgcctccatcgctgcgcggggatacatctctacaagagttggcatgggggaggccgctgccatttttatgaccgccacacctcccggaaccgctgatgccttccctcagagcaatgcgcccatccaggacgaggaacgcgacattccggagcggtcctggaactctggcaatgaatggatcacggattttgctgggaagaccgtgtggttcgtccctagcattaaagccggcaacgacatcgccaactgtcttagaaagaatggcaaaaaggtgattcaactgtcccgcaagacatttgataccgagtatcagaaaacaaagctcaacgactgggatttcgtggtcaccacagacatctctgagatgggagctaattttaaagccgatcgggttatcgaccccagacggtgcctgaagcccgtgattctgaccgatgggcctgaacgcgtgatcctcgcgggacccatgcctgtcacggccgctagcgccgctcagagacggggccgcgtggggagaaacccgcagaaagagaatgaccaatacattttcacaggacagccccttaacaatgatgaagaccacgcccattggaccgaggctaagatgctgctggacaacatcaatacccctgaaggcattatccccgccctcttcgagcctgagcgggaaaagtccgcggccatcgatggggagtatagactgaaaggcgaaagccgcaagacatttgttgagcttatgcggagaggagacctgcccgtgtggctcgctcacaaagtcgcctctgaaggcattaagtacaccgatcgcaaatggtgcttcgacgggcagcggaacaatcagatcctggaggagaacatggatgtggaaatttggacaaaggagggagagaagaagaagctgagaccgcgctggctcgacgctcggacgtattccgatcctcttgccctgaaagagtttaaggacttcgccgctggcagaaaaagcatcgcgctggatctcgttaccgaaattgggcgcgtgcccacacacctggcccatagaacccggaatgctcttgacaacctggtcatgctccacacatctgagcatggaggcaaggcctaccgccacgccgtggaggaactgcctgagaccatggaaacgctgctccttctgggcctgatgatcctcctgaccgggggagctatgctttttctgatctccggcaaagggattggaaagacaagcatcggcctcatttgtgtcatcgcctcctctgggatgctgtggatggcggagattcccctgcaatggatcgccagcgctattgtgctcgagttctttatgatggttcttctgatccctgaacccgagaagcagagaaccccgcaggataatcaactggcctatgtggtgatcggcattctcacactggctgccatcattgcggccaacgaaatgggccttctggagaccacgaaacgggacctcggcatgtccaaggaacctggggtcgttagccccacatcttacctggatgtggacctgcaccccgcttccgcctggaccctctacgctgtggccacaaccgtcatcacccctatgcttcgccatacaattgagaatagcacggctaacgtgtctctggccgcgatcgccaaccaggctgttgtgctgatgggactcgacaaaggctggccgatcagcaagatggatctgggggtcccccttctggccctcggatgctattcccaggtgaatcctctgaccctgacagctgccgtcctccttctgattacccactacgccatcattggccccgggctgcaggcgaaagctacaagagaggcccaaaagcggaccgctgccggaatcatgaagaaccctacggtggacggcattatgacaatcgatctcgaccccgttatctatgattctaaattcgaaaagcagctgggccaggtgatgcttctggtcctctgtgccgtgcagctgctgctcatgagaaccagctgggctctttgcgaggccctgaccctggcgacagggcctattaccacactctgggaaggatccccgggcaaattttggaatacgaccatcgccgtttctatggctaacattttccgcgggagctacctggccggagctggccttgccttttccatcatgaaaagcgtggggacaggaaaacggggcaccggctctcaaggggagacactgggagaaaagtggaagaaaaagctcaatcagctgtccagaaaagagttcgacctgtataagaaaagcggcattaccgaggtcgatcgcacggaagcgaaggaggggctcaaacggggagaaatcacccatcacgccgtgtccagaggctctgctaaacttcagtggtttgtggagcggaacatggttattcccgaagggcgcgtcatcgacctgggatgtggcagaggcgggtggagctactattgcgccggactgaagaaagtgacagaggtgcggggctacaccaaagggggacctggccatgaggaacccgtccctatgtccacatacgggtggaatatcgttaaactcatgtctggaaaggatgtgttctatctgcccccggagaaatgtgacacccttctgtgcgatattggcgaaagctcccctagccccacagtggaggagtctcgcaccatcagagtcctcaagatggtggaaccctggctgaagaacaatcagttctgtattaaagttctgaacccttacatgcccacggtgatcgagcacctcgaacggcttcaacgcaagcacggcgggatgctggtcagaaatcctctgtcccggaacagcacacatgagatgtattggatttctaatggaaccggcaacatcgtggcttccgttaatatggtgagccgcctcctgcttaacagatttaccatgacacaccggagaccgacgatcgaaaaagacgtcgatctgggggccggaacccgccatgtgaacgctgagcccgagacacctaatatggacgtgattggcgaacggatcaagagaattaaagaggaacacaactctacctggcactacgacgatgagaatccctataagacatgggcctaccatgggagctatgaagtcaaggcgaccggatccgcctctagcatgatcaacggcgttgtgaaactcctgacaaagccttgggacgtggtccccatggtgacccagatggctatgacggataccacaccgttcggccagcaacgcgtttttaaagagaaggtggacacccggacacctagatccatgcccgggacccgccgggtcatgggaattacggccgagtggctgtggagaacactcggccgcaataaaaagcctcggctgtgcaccagagaagagttcacaaagaaagtgcgcaccaacgctgccatgggggccgtttttacggaagagaatcagtgggatagcgcgaaggctgccgtggaagacgaggatttctggaaacttgtcgaccgggagagagaactgcacaagctcggaaaatgtggctcctgcgtgtacaacatgatggggaagcgcgagaaaaagctgggcgaatttggaaaggccaaaggctctagagctatctggtacatgtggcttggggcccggtatctggagttcgaggctctcggatttctgaatgaagatcattggttcagccgcgagaactcctactctggcgttgaaggggagggactgcacaagctcggctatatcctgagagacattagcaaaatccccgggggcgccatgtacgcggatgacaccgccggatgggacacacggattaccgaagatgaccttcataatgaggagaagatcacacagcagatggatcctgaacacagacaactggctaacgccatttttaaactcacctatcagaataaggtggtcaaggtgcagcggcccacaccgaccggcacggtcatggacatcatctcccgcaaagatcagagagggtctggacaagtgggcacatacgggctgaacaccttcaccaatatggaggctcagcttattcggcagatggaaggagagggcgttctgagcaaggccgacctcgaaaaccctcatctgcccgagaaaaagatcacacagtggctggagaccaaaggggtggaacgcctcaagagaatggcgatttccggcgatgactgcgtcgtgaagcccatcgatgaccggtttgccaacgctctgcttgccctgaatgatatgggaaaagtgcgcaaggacattcctcaatggcagccgagcaaaggctggcatgattggcagcaggttcccttctgttctcaccatttccacgagctcatcatgaaggacgggagaaaactggtggtcccttgccggccccaagacgaacttattggacgcgctagaatctcccagggcgccgggtggagcctgcgggagacagcttgtctcggaaaggcctatgcgcagatgtggtctctgatgtactttcaccgcagagatctgcggctcgcctccaacgctatctgcagcgccgtgcctgttcattgggtgcccacgtctcgcaccacatggtccattcacgcccatcaccaatggatgaccacagaagacatgctgaccgtctggaatagagtgtggatcgaggataacccttggatggaggacaagacgcccgtcaccacatgggaaaatgtgccgtaccttggcaaacgggaggatcagtggtgtgggagcctgattggcctcacctccagagctacatgggcccagaacatccctaccgcgattcagcaagttcgcagcctgatcggaaatgaagagttccttgactatatgccctctatgaagcggtttagaaaagaggaagagagcgaaggcgctatctggtga

SEQ ID NO: 20771 - RNA, 9873 nt, synthetic construct
  misc_feature 1..9873: note = derived and/or modified CDS sequence (opt5) from DENV-3__FJ850096__SS-prME
  source 1..9873: mol_type = other RNA
accagcctgtgcctgatgatgatcctgcccgccgctcttgccttccacctgacatcccgggacggcgaacctcggatgattgtggggaagaacgaacgcggaaagtctctcctgtttaagacggcgagcggcatcaatatgtgtacccttattgctatggatctgggggagatgtgcgacgatacagtcacctacaaatgtccgcacatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcctcctgcttacctggatcgggctcaattctaagaacacaagcatgtccttttcttgcattgctatcggaatcattaccctctatctgggcgccgtggttcaggctgacatggggtgtgtgatcaattggaaaggaaaggagctgaagtgcggcagcgggattttcgtcacaaacgaggtgcatacgtggaccgaacagtacaaatttcaagccgattcccccaagcggcttgcgacagccatcgctggcgcctgggagaatggagtttgtggcattagaagcaccacacgcatggaaaacctcctgtggaaacagatcgctaatgagctgaactatatcctctgggaaaataacattaagctgaccgtggtcgtgggggacatcattggagttcttgagcagggcaaacggacgctgacccctcagcccatggagctcaagtactcttggaaaacatgggggaaggccaagatcgtgaccgccgaaacacaaaactccagcttcattatcgatggacctaatacccccgagtgcccgtctgcttccagagcgtggaacgtctgggaagtggaggactatggctttggcgtgttcacaaccaatatctggctgaaactgcgcgaagtctacacgcagctttgtgaccaccggctcatgagcgccgctgttaaggatgagagagccgtgcacgccgacatggggtactggattgagtcccagaaaaacggatcttggaagctggaaaaagctagcctgatcgaggtgaagacatgcacctggcctaagtcccataccctctggtctaatggcgtcctggaaagcgatatgattatccccaaatcccttgccgggcctattagccagcacaactatcgccccggataccatacacaaaccgcgggcccttggcacctggggaagctcgagctggactttaattattgcgagggaacgacagtggttatcaccgaaaactgtggcacacggggcccctctctgagaaccacaaccgtgtccgggaaacttatccacgagtggtgctgtcgcagctgcacgctcccgcctctgcggtacatgggagaagatggctgttggtatgggatggagattagacccatctctgaaaaggaggagaatatggtcaaatccctggtgagcgctggatctggcgaagttgacaacttcaccatgggggtgctctgcctggccattctttttgaggaagtcatgcggggaaagttcggcaagaaacatatgatcgccggcgtgttctttacattcgttctgctcctgagcgggcagattacctggcgcgatatggctcacacactgatcatgattggatccaatgccagcgacagaatgggcatgggggtgacctaccttgcgctgatcgctacgtttaagatccagcccttcctcgccctgggatttttcctccggaaactgacatctagagagaaccttctgctcggcgtcgggctggccatggctaccacactgcaacttcctgaagatattgagcagatggccaatggaatcgctctgggcctcatggccctgaagctcattacccagtttgagacctatcagctgtggacagcgcttatctccctgacgtgtagcaacaccattttcacactcaccgtggcctggcgcacagctaccctgatcctggccggcgtgtcccttctgccggtctgccaatctagctccatgcggaaaacggactggctccccatgacagttgctgccatgggggtgcctcccctgcctctctttatcttctctctgaaggatacccttaagagacgcagctggcccctgaatgaaggagtgatggccgtcggcctggtgtccattctcgcttctagcctgcttagaaacgacgttcctatggcggggcccctggtggccggaggcctcctgatcgcttgttacgtcattaccgggacatccgccgatctcaccgtggagaaagccgctgacgttacatgggaagaggaagccgagcagacgggagtgagccataacctgatgatcaccgtcgacgatgacggcacaatgcggattaaggatgacgagaccgaaaatatccttacagtgctgctgaaaaccgcgctcctgatcgtctctggcatttttccgtactccatccctgctacgcttctggtgtggcacacctggcagaagcagacacaacgcagcggggttctctgggatgtgccctctcctcccgagacccagaaagccgaactggaggagggagtctatagaattaagcagcagggcatcttcgggaaaacacaagtgggagttggcgtgcagaaggaaggggtctttcataccatgtggcacgtgacacggggagccgtgctcacgtacaacggcaagcgcctggagccgaattgggcttccgttaaaaaggaccttattagctatggcgggggatggagactgtctgcccagtggcaaaaaggcgaagaggtccaggtgatcgcggtggaacctgggaagaaccccaaaaatttccagaccatgcctggaacattccagaccaccacaggcgagattggggctatcgccctggattttaagcccggaacgtccggcagccccatcattaaccgggagggcaaggtcgtggggctctacggaaatggcgttgtgaccaaaaacgggggatatgtctccggcatcgcccaaacaaatgctgaacctgacgggccgacccccgagctggaagaggaaatgttcaagaaacgcaaccttacaattatggatctgcaccctggcagcggaaagaccagaaaatacctccccgccatcgtgcgggaggctattaagcgcagactgcggacgctcatcctggcccctacaagagttgtggcggccgagatggaagaggctcttaagggcctgcccatccgctatcagaccaccgccacaaaatctgaacataccgggcgggagattgtcgacctgatgtgccacgctacatttaccatgagactcctgagccctgtgcgcgttccgaattacaaccttatcattatggatgaagcccatttcacggaccccgcctccatcgctgcgcggggatacatttctacaagagtgggcatgggggaggccgctgccatctttatgaccgccacacctcccggaaccgctgatgccttccctcagagcaatgcgcccatccaggacgaggaacgcgacattccggagcggtcctggaactctggcaatgaatggatcacggattttaccgggaagacagtctggttcgtgcctagcattaaagctggcaacgacatcgccaactgtctgagaaagaatggcaaaaaggtgattcaactctcccgcaagacctttgatacagagtatcagaaaaccaagctgaacgactgggatttcgtcgttacaaccgacatctctgagatgggagccaattttaaagctgatcgggtgattgaccccagacggtgcctgaagcccgtgatcctcacggatgggcctgaacgcgtcatccttgccggacccatgcctgtgacagcggccagcgctgcccagagacggggccgcgttgggagaaacccgcagaaagagaatgaccaatacattttcaccggacagcccctgaacaatgatgaagaccacgctcattggaccgaggccaagatgctgctcgacaacatcaatacacctgaaggcattatccccgctctgttcgagcctgagcgggaaaagtccgccgcgattgatggggagtatagacttaaaggcgaaagccgcaagacctttgtggagctgatgcggagaggagacctccccgtctggctggcccacaaagtggcttctgaaggcatcaagtacacagatcgcaaatggtgcttcgacgggcagcggaacaatcagatcctggaggagaacatggatgttgaaatttggacgaaggagggagagaagaagaagctcagaccgcgctggcttgacgcccggacctattccgatcctctggctctgaaagagtttaaggacttcgccgccggcagaaaaagcatcgctctcgatctggtgacagaaattgggcgcgtcccctctcaccttgcgcatagaacccggaatgccctggacaacctcgtgatgctgcacacatccgagcatggaggcaaggcttaccgccacgccgtcgaggaactgcctgagaccatggaaacgctccttctgctgggcctcatgatcctgcttaccgggggagccatgctgtttctcattagcggcaaagggatcggaaagacatccatcggcctgatttgtgtgatcgcttctagcgggatgctgtggatggccgagattcccctccaatggatcgcgtccgccattgttcttgagttctttatgatggtgctgctgatccctgaacccgagaagcagagaaccccgcaggataatcaactcgcttatgtggtcattggaatcctgacacttgccgctatcattgccgcgaacgaaatgggcctgctcgagaccacgaaacgggacctgggcatgagcaaggaacctggggttgtgtctcccacatcctacctggatgtggacctccaccccgccagcgcttggaccctttacgccgtcgctacaaccgtgatcacccctatgctgcgccatacaattgaaaattctacggccaacgttagcctggctgccatcgcgaaccaggccgtggtcctcatgggactggacaaaggctggccgatttccaagatggatcttggggtgcccctgctcgctctgggatgctattctcaggtcaatcctctgaccctcacagccgctgtgcttctgctgatcacccactacgccatcattggccccgggctccaggccaaagcgacaagagaggctcaaaagcggaccgccgctggaatcatgaagaaccctacggttgacggcattatgacaatcgatctggaccccgtgatttatgatagcaaattcgagaagcagcttggccaggtcatgctgctcgtgctgtgtgccgttcagctgctccttatgagaacctcctgggccctgtgcgaggctctgaccctcgccacagggcctatcaccacactgtgggaaggatctccgggcaaattttggaatacgaccatcgcggtgagcatggccaacattttccgcgggtcctaccttgctggagccggcctggcttttagcatcatgaagtctgtcgggacaggaaaacggggcaccggctcccaaggggagacactcggagaaaagtggaagaaaaagctgaatcagctgagcagaaaagagttcgacctctataagaaatccggcattaccgaggtggatcgcacggaagccaaggaggggcttaaacggggagaaatcacccatcacgcggtgtctagaggcagcgccaagctgcagtggtttgttgagcggaacatggtcattcccgaagggcgcgtgatcgacctgggatgtggcagaggcgggtggtcctactattgcgctggactcaagaaagtgacagaggtccggggctacaccaaagggggacctggccatgaggaacccgttcctatgtctacatacgggtggaatattgtgaaactgatgagcggaaaggatgtgttctatcttcccccggagaaatgtgacaccctgctctgcgatatcggcgaatccagcccttctcccacagtcgaggagtcccgcaccatcagagtgctgaagatggttgaaccctggctgaagaacaatcagttctgtattaaagtgctcaacccttacatgcccacggtcatcgagcaccttgaacggctgcaacgcaagcacggcgggatgctggtgagaaatcctctcagccggaactctacacatgagatgtattggatttccaatggaaccggcaacatcgttgccagcgtgaatatggtctctcgcctgcttctgaacagatttaccatgacacaccggagaccgacgattgaaaaagacgtggatctcggggctggaacccgccatgtgaacgccgagcccgagacacctaatatggacgtcatcggcgaacggatcaagagaattaaagaggaacacaacagcacctggcactacgacgatgagaatccctataagacatgggcttaccatgggtcctatgaagttaaggccaccggatctgcgagctccatgatcaacggcgtggtgaaactgctgacaaagccttgggacgtcgtgcccatggttacccagatggccatgacggataccacaccgttcggccagcaacgcgtgtttaaagagaaggtcgacacccggacacctagaagcatgcccgggacccgccgggtgatgggaattacggctgagtggctctggagaacactgggccgcaataaaaagcctcggctttgcaccagagaagagttcacaaagaaagttcgcaccaacgccgctatgggggccgtgtttacggaagagaatcagtgggattccgccaaggcggctgtcgaagacgaggatttctggaaactggtggaccgggagagagaactccacaagctgggaaaatgtggctcttgcgtttacaacatgatggggaagcgcgagaagaaacttggcgaatttggaaaagccaaaggcagcagagccatctggtacatgtggctgggggctcggtatctcgagttcgaggccctgggatttctgaatgaagatcattggttctcccgcgagaactcttacagcggcgtggaaggggagggactccacaagctgggctatattcttagagacatctccaaaatccccgggggcgctatgtacgccgatgacaccgcgggatgggacacacggattaccgaagatgacctgcataatgaggagaagatcacacagcagatggatcctgaacacagacaactcgccaacgctatttttaaactgacctatcagaataaggtcgtgaaggtccagcggcccacaccgaccggcacggtgatggacatcatttctcgcaaagatcagagagggagcggacaagttggcacatacgggcttaacaccttcaccaatatggaggcccagctgatccggcagatggaaggagagggcgtgctctccaaggctgacctggaaaaccctcatctgcccgagaaaaagatcacacagtggctcgagaccaaaggggtcgaacgcctgaagagaatggccattagcggcgatgactgcgtggtgaagcccatcgatgaccggtttgcgaacgcccttctggctctcaatgatatgggaaaagttcgcaaggacattcctcaatggcagccgtctaaaggctggcatgattggcaacaggtgcccttctgttcccaccatttccacgagctgatcatgaaggacgggagaaaacttgtcgtgccttgccggccccaagacgaactgattggacgcgccagaatcagccagggcgctgggtggtctctccgggagacagcctgtctgggaaaggcttatgcccagatgtggtccctgatgtactttcaccgcagagatctccggctggcgagcaacgccatttgctctgctgttcctgtgcattgggtccccacgtcccgcaccacatggagcatccacgcccatcaccaatggatgaccacagaagacatgcttaccgtgtggaatagagtctggatcgaggataacccttggatggaggacaagacgcccgtgaccacatgggaaaatgttccgtacctgggcaaacgggaggatcagtggtgtgggtccctcattggcctgaccagcagagccacatgggctcagaacatccctaccgccattcagcaagtgcgctctcttatcggaaatgaagagttcctggactatatgcccagcatgaagcggtttagaaaagaggaagagtccgaaggcgcgatttggtga

SEQ ID NO: 20772 - RNA, 9873 nt, synthetic construct
  misc_feature 1..9873: note = derived and/or modified CDS sequence (opt5) from DENV-3__FJ882578__SS-prME
  source 1..9873: mol_type = other RNA
accagcctgtgcctcatgatgatcctgcccgccgctcttgccttccacctgacatcccgggacggcgagcctcggatgattgtggggaagaacgaacgcggaaagtctctcctgtttaagacggcgagcggcatcaatatgtgtacccttattgctatggatctgggggaaatgtgcgacgatacagtgacctacaagtgtccgcacatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacacgatcggagtgctggagcagggcaaacggattcttacccctcagcccatggagctgaagtactcttggaaaacatgggggaaggccaagatcgtcaccgccgaaacacaaaactccagcttcattatcgatggacctaatacccccgagtgcccgtctgcttccagagcgtggaacgtgtgggaagtggaggactatggctttggcgtcttcacaaccaatatctggctcaaactgcgcgaagtttacacgcagctgtgtgaccaccggcttatgagcgccgctgtgaaggatgagagagccgtgcacgccgacatggggtactggattgagtcccagaaaaacggatcttggaagctcgaaaaagctagcctgatcgaggtcaagacatgcacctggcctaagtcccataccctgtggtctaatggcgtgctcgaaagcgatatgattatccccaaatccctggccgggcctattagccagcacaactatcgccccggataccatacacaaaccgcgggcccttggcaccttgggaagctggagctcgactttaattattgcgagggaacgacagttgtgatcaccgaaaactgtggcacacggggcccctctctgagaaccacaaccgtctccgggaaactgatccacgagtggtgctgtcgcagctgcacgcttccgcctctccggtacatgggagaagatggctgttggtatgggatggagattagacccatctctgaaaaggaggagaatatggtgaaatccctggttagcgctggatctggcgaagtggacaacttcaccatgggggtcctgtgcctcgccattctgtttgaggaagtgatgcggggaaagttcggcaagaaacatatgatcgccggcgttttctttacattcgtgcttctgctcagcgggcagattacctggcgcgatatggctcacacactgatcatgattggatccaatgccagcgacagaatgggcatgggggtcacctacctggcgcttatcgctacgtttaagatccagcccttcctggccctcggatttttcctgcggaaactcacatctagagagaacctgcttctgggcgtggggctcgccatggctaccacactgcaactgcctgaagatattgagcagatggccaatggaatcgctcttggcctgatggccctcaagctgattacccagtttgagacctatcagctctggacagcgctgatctcccttacgtgtagcaacaccattttcacactgaccgtggcctggcgcacagctaccctcatcctggccggcgtctccctgcttccggtttgccaatctagctccatgcggaaaacggactggctgcccatgacagtggctgccatgggggtgcctcccctccctctgtttatcttctctctcaaggataccctgaagagacgcagctggccccttaatgaaggagtcatggccgtgggcctggtttccattctggcttctagcctcctgagaaacgacgtgcctatggcggggccccttgtcgccggaggcctgctcatcgcttgttacgtgattaccgggacatccgccgatctgaccgttgagaaagccgctgacgtgacatgggaagaggaagccgagcagacgggagtcagccataacctcatgatcaccgtggacgatgacggcacaatgcggattaaggatgacgagaccgaaaatatcctgacagtccttctgaaaaccgcgctgctcatcgtgtctggcatttttccgtactccatccctgctacgctgcttgtttggcacacctggcagaagcagacacaacgcagcggggtgctgtgggatgtcccctctcctcccgagacccagaaagccgaactcgaggagggagtgtatagaattaagcagcagggcatcttcgggaaaacacaagttggagtgggcgtccagaaggaaggggtgtttcataccatgtggcacgtgacacggggagccgttctgacgtacaacggcaagcgcctcgagccgaattgggcttccgtcaaaaaggacctgattagctatggcgggggatggagactttctgcccagtggcaaaaaggcgaagaggtccaggtgatcgcggtcgaacctgggaagaaccccaaaaatttccagaccatgcctggaacattccagaccaccacaggcgagattggggctatcgccctggattttaagcccggaacgtccggcagccccatcattaaccgggagggcaaggtggttgggctgtacggaaatggcgtggtcaccaaaaacgggggatatgtgtccggcatcgcccaaacaaatgctgaacctgacgggccgacccccgagctcgaagaggaaatgttcaagaaacgcaacctgacaattatggatcttcaccctggcagcggaaagaccagaaaatacctgcccgccatcgttcgggaggctattaagcgcagactccggacgctgatcctcgcccctacaagagtggtcgcggccgagatggaagaggctctgaagggccttcccatccgctatcagaccaccgccacaaaatctgaacataccgggcgggagattgtggacctgatgtgccacgctacatttaccatgagactgctcagccctgttcgcgtgccgaattacaacctgatcattatggatgaagcccatttcacggaccccgcctccatcgctgcgcggggatacatttctacaagagtcggcatgggggaggccgctgccatctttatgaccgccacacctcccggaaccgctgatgccttccctcagagcaatgcgcccatccaggacgaggaacgcgacattccggagcggtcctggaactctggcaatgaatggatcacggattttgctgggaagaccgtgtggttcgtgcctagcattaaagccggcaacgacatcgccaactgtcttagaaagaatggcaaaaaggtcattcaactgtcccgcaagacatttgataccgagtatcagaaaacaaagctcaacgactgggatttcgttgtgaccacagacatctctgagatgggagctaattttaaagccgatcgggtgattgaccccagacggtgcctgaagcccgtcatcctgaccgatgggcctgaacgcgtgatcctcgcgggacccatgcctgttacggccgctagcgccgctcagagacggggccgcgtggggagaaacccgcagaaagagaatgaccaatacattttcacaggacagccccttaacaatgatgaagaccacgcccattggaccgaggctaagatgctgctggacaacatcaatacccctgaaggcattatccccgccctcttcgagcctgagcgggaaaagtccgcggccattgatggggagtatagactgaaaggcgaaagccgcaagacatttgtcgagcttatgcggagaggagacctgcccgtgtggctcgctcacaaagttgcctctgaaggcatcaagtacaccgatcgcaaatggtgcttcgacgggcagcggaacaatcagatcctggaggagaacatggatgtggaaatttggacaaaggagggagagaagaagaagctgagaccgcgctggctcgacgctcggacgtattccgatcctcttgccctgaaagagtttaaggacttcgccgctggcagaaaaagcatcgcgctggatctcgtcaccgaaattgggcgcgtgcccacacacctggcccatagaacccggaatgctcttgacaacctggtcatgctccacacatctgagcatggaggcaaggcctaccgccacgccgtggaggaactgcctgagaccatggaaacgctgctccttctgggcctgatgatcctcctgaccgggggagctatgctttttctgatttccggcaaagggatcggaaagacaagcatcggcctcatttgtgttatcgcctcctctgggatgctgtggatggcggagattcccctgcaatggatcgccagcgctattgtgctcgagttctttatgatggtgcttctgatccctgaacccgagaagcagagaaccccgcaggataatcaactggcctatgtcgttattggaatcctcacactggctgccatcattgcggccaacgaaatgggccttctggagaccacgaaacgggacctcggcatgtccaaggaacctggggtggtgagccccacatcttacctggatgtcgacctgcaccccgcttccgcctggaccctctacgctgtggccacaaccgttatcacccctatgcttcgccatacaattgagaatagcacggctaacgtgtctctggccgcgatcgccaaccaggctgtcgtgctgatgggactcgacaaaggctggccgattagcaagatggatctgggggtcccccttctggccctcggatgctattcccaggtgaatcctctgaccctgacagctgccgttctccttctgatcacccactacgccatcattggccccgggctgcaggcgaaagctacaagagaggcccaaaagcggaccgctgccggaatcatgaagaaccctacggtggacggcattatgacaatcgatctcgaccccgtcatttatgattctaaattcgaaaagcagctgggccaggtgatgcttctggttctctgtgccgtgcagctgctgctcatgagaaccagctgggctctttgcgaggccctgaccctggcgacagggcctatcaccacactctgggaaggatccccgggcaaattttggaatacgaccatcgccgtctctatggctaacattttccgcgggagctacctggccggagctggccttgccttttccatcatgaaaagcgtggggacaggaaaacggggcaccggctctcaaggggagacactgggagaaaagtggaagaaaaagctcaatcagctgtccagaaaagagttcgacctgtataagaaaagcggcattaccgaggtggatcgcacggaagcgaaggaggggctcaaacggggagaaatcacccatcacgccgtttccagaggctctgctaaacttcagtggtttgtcgagcggaacatggtgattcccgaagggcgcgtgatcgacctgggatgtggcagaggcgggtggagctactattgcgccggactgaagaaagtcacagaggttcggggctacaccaaagggggacctggccatgaggaacccgtgcctatgtccacatacgggtggaatattgtgaaactcatgtctggaaaggatgtcttctatctgcccccggagaaatgtgacacccttctgtgcgatatcggcgaaagctcccctagccccacagtggaggagtctcgcaccatcagagttctcaagatggtggaaccctggctgaagaacaatcagttctgtattaaagtcctgaacccttacatgcccacggtgatcgagcacctcgaacggcttcaacgcaagcacggcgggatgctggttagaaatcctctgtcccggaacagcacacatgagatgtattggatttctaatggaaccggcaacatcgtggcttccgtcaatatggtgagccgcctcctgcttaacagatttaccatgacacaccggagaccgacgattgaaaaagacgtggatctgggggccggaacccgccatgtcaacgctgagcccgagacacctaatatggacgttatcggcgaacggatcaagagaattaaagaggaacacaactctacctggcactacgacgatgagaatccctataagacatgggcctaccatgggagctatgaagtgaaggcgaccggatccgcctctagcatgatcaacggcgtggtcaaactcctgacaaagccttgggacgtggttcccatggtgacccagatggctatgacggataccacaccgttcggccagcaacgcgtctttaaagagaaggtggacacccggacacctagatccatgcccgggacccgccgggttatgggaattacggccgagtggctgtggagaacactcggccgcaataaaaagcctcggctgtgcaccagagaagagttcacaaagaaagtgcgcaccaacgctgccatgggggccgtctttacggaagagaatcagtgggatagcgcgaaggctgccgtggaagacgaggatttctggaaacttgttgaccgggagagagaactgcacaagctcggaaaatgtggctcctgcgtgtacaacatgatggggaagcgcgagaaaaagctgggcgaatttggaaaggccaaaggctctagagctatctggtacatgtggcttggggcccggtatctggagttcgaggctctcggatttctgaatgaagatcattggttcagccgcgagaactcctactctggcgtcgaaggggagggactgcacaagctcggctatattctgagagacatcagcaaaatccccgggggcgccatgtacgcggatgacaccgccggatgggacacacggattaccgaagatgaccttcataatgaggagaagatcacacagcagatggatcctgaacacagacaactggctaacgccatttttaaactcacctatcagaataaggtggtcaaggtgcagcggcccacaccgaccggcacggttatggacatcatttcccgcaaagatcagagagggtctggacaagtgggcacatacgggctgaacaccttcaccaatatggaggctcagcttatccggcagatggaaggagagggcgtcctgagcaaggccgacctcgaaaaccctcatctgcccgagaaaaagatcacacagtggctggagaccaaaggggtggaacgcctcaagagaatggcgatttccggcgatgactgcgtggttaagcccatcgatgaccggtttgccaacgctctgcttgccctgaatgatatgggaaaagtgcgcaaggacattcctcaatggcagccgagcaaaggctggcatgattggcagcaggtccccttctgttctcaccatttccacgagctcatcatgaaggacgggagaaaactggtggttccttgccggccccaagacgaacttattggacgcgctagaatctcccagggcgccgggtggagcctgcgggagacagcttgtctcggaaaggcctatgcgcagatgtggtctctgatgtactttcaccgcagagatctgcggctcgcctccaacgctatttgcagcgccgtgcctgtccattgggtgcccacgtctcgcaccacatggtccatccacgcccatcaccaatggatgaccacagaagacatgctgaccgtctggaatagagtgtggatcgaggataacccttggatggaggacaagacgcccgttaccacatgggaaaatgtgccgtaccttggcaaacgggaggatcagtggtgtgggagcctgattggcctcacctccagagctacatgggcccagaacatccctaccgcgattcagcaagtccgcagcctgatcggaaatgaagagttccttgactatatgccctctatgaagcggtttagaaaagaggaagagagcgaaggcgctatttggtga

SEQ ID NO: 20773 - RNA, 9873 nt, synthetic construct
  misc_feature 1..9873: note = derived and/or modified CDS sequence (opt5) from DENV-3__FJ639770__SS-prME
  source 1..9873: mol_type = other RNA
accagcctgtgcctcatgatgatcctgcccgccgctcttgccttccacctgacgtccagagacggcgaacctcggatgattgtggggaagaacgaacgcggaaagtctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacagacctggatgagcgccgagggcgcttggcggcaggtcgaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggctagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacgtgatcggagtcctggagcagggcaaacggacgcttaccctgcagcctatggagctcaagtactcttggaaaacatgggggaaggccaagattgtgaccgccgaaacacaaaactccagcttcatcattgatggacccaatacccctgagtgcccctctgcttccagagcgtggaacgtgtgggaagtcgaggactatggctttggcgttttcacaaccaatatctggctgaaactgcgcgaagtgtacacgcagctttgtgaccaccggctcatgagcgccgctgtgaaggatgagagagccgtccacgccgacatggggtactggatcgagtcccagaaaaacggatcttggaagctggaaaaagctagcctgattgaggtgaagacatgcacctggccgaagtcccataccctctggtctaatggcgttctggaaagcgatatgatcattcctaaatcccttgccgggcccatcagccagcacaactatcgccctggataccatacacaaaccgcgggcccctggcacctggggaagctcgagctggactttaattattgcgagggaacgacagtggtcattaccgaaaactgtggcacacggggcccttctctgagaaccacaaccgtgtccgggaaacttatccacgagtggtgctgtcgcagctgcacgctgcccccgctgcggtacatgggagaagatggctgttggtatgggatggagatcagacctatttctgaaaaggaggagaatatggttaaatccctggtgagcgctggatctggcgaagtcgacaacttcaccatgggggtgctctgcctggccatcctttttgaggaagttatgcggggaaagttcggcaagaaacatatgattgccggcgtgttctttacattcgtcctgctcctgagcgggcagatcacctggcgcgatatggctcacacactgattatgatcggatccaatgccagcgacagaatgggcatgggggtgacctaccttgcgctgattgctacgtttaagatccagcccttcctcgccctgggatttttcctccggaaactgacatctagagagaaccttctgctcggcgtggggctggccatggctaccacactgcaacttcccgaagatatcgagcagatggccaatggaattgctctgggcctcatggccctgaagctcatcacccagtttgagacctatcagctgtggacagcgcttatttccctgacgtgtagcaacaccatcttcacactcaccgtcgcctggcgcacagctaccctgattctggccggcgtttcccttctgcctgtgtgccaatctagctccatgcggaaaacggactggctcccgatgacagtggctgccatgggggtgccccctctgcccctctttatcttctctctgaaggatacccttaagagacgcagctggcctctgaatgaaggagtgatggccgttggcctggtgtccatcctcgcttctagcctgcttagaaacgacgtccccatggcggggcctctggtggccggaggcctcctgattgcttgttacgttatcaccgggacatccgccgatctcaccgtggagaaagccgctgacgtcacatgggaagaggaagccgagcagacgggagtgagccataacctgatgattaccgtcgacgatgacggcacaatgcggatcaaggatgacgagaccgaaaatattcttacagtgctgctgaaaaccgcgctcctgatcgtttctggcatctttccctactccattccggctacgcttctggtgtggcacacctggcagaagcagacacaacgcagcggggtcctctgggatgtgccttctccccctgagacccagaaagccgaactggaggagggagtttatagaatcaagcagcagggcattttcgggaaaacacaagtgggagtcggcgtgcagaaggaaggggtgtttcataccatgtggcacgttacacggggagccgtcctcacgtacaacggcaagcgcctggagcccaattgggcttccgtgaaaaaggaccttatcagctatggcgggggatggagactgtctgcccagtggcaaaaaggcgaagaggtgcaggtcattgcggtggaaccggggaagaaccctaaaaatttccagaccatgcccggaacattccagaccaccacaggcgagatcggggctattgccctggattttaagcctggaacgtccggcagccccatcatcaaccgggagggcaaggttgtggggctctacggaaatggcgtcgtgaccaaaaacgggggatatgtttccggcattgcccaaacaaatgctgaacccgacgggcctaccccggagctggaagaggaaatgttcaagaaacgcaaccttacaatcatggatctgcaccccggcagcggaaagaccagaaaatacctccctgccattgtgcgggaggctatcaagcgcagactgcggacgctcattctggcccccacaagagtcgtggcggccgagatggaagaggctcttaagggcctgcctatccgctatcagaccaccgccacaaaatctgaacataccgggcgggagatcgttgacctgatgtgccacgctacatttaccatgagactcctgagccccgtgcgcgtccctaattacaaccttattatcatggatgaagcccatttcacggacccggcctccattgctgcgcggggatacatctctacaagagtgggcatgggggaggccgctgccatttttatgaccgccacaccccctggaaccgctgatgccttcccccagagcaatgcgcctatccaggacgaggaacgcgacatccccgagcggtcctggaactctggcaatgaatggattacggattttgctgggaagaccgtgtggttcgtcccgagcatcaaagccggcaacgacattgccaactgtctgagaaagaatggcaaaaaggttatccaactctcccgcaagacatttgataccgagtatcagaaaacaaagctgaacgactgggatttcgtggtgaccacagacatttctgagatgggagctaattttaaagccgatcgggtcatcgaccctagacggtgcctgaagcccgtgattctcaccgatgggcccgaacgcgttatccttgcgggacctatgcccgtgacggccgctagcgccgctcagagacggggccgcgtcgggagaaaccctcagaaagagaatgaccaatacatcttcacaggacagccgctgaacaatgatgaagaccacgcccattggaccgaggctaagatgctgctcgacaacattaatacccccgaaggcatcattcctgccctgttcgagcccgagcgggaaaagtccgcggccatcgatggggagtatagacttaaaggcgaaagccgcaagacatttgtggagctgatgcggagaggagacctccctgtttggctggctcacaaagtggcctctgaaggcattaagtacaccgatcgcaaatggtgcttcgacgggcagcggaacaatcagatcctggaggagaacatggatgtcgaaatctggacaaaggagggagagaagaagaagctcagaccccgctggcttgacgctcggacgtattccgatccgctggccctgaaagagtttaaggacttcgccgctggcagaaaaagcattgcgctcgatctggtgaccgaaatcgggcgcgtcccttctcaccttgcccatagaacacggaatgctctggacaacctcgtgatgctgcacacctccgagcatggaggcaaggcctaccgccacgccgttgaggaactgcccgagacaatggaaaccctccttctgctgggcctcatgattctgcttacagggggagctatgctgtttctcatcagcggcaaagggattggaaagacctccatcggcctgatctgtgtgattgcctctagcgggatgctgtggatggcggagatccctctccaatggattgcctccgctatcgtgcttgagttctttatgatggtcctgctgattcccgaacctgagaagcagagaacaccccaggataatcaactcgcctatgttgtgatcggcattctcacccttgctgccatcatcgcggccaacgaaatgggactgctcgagacaaccaaacgggacctgggcatgagcaaggaaccgggggtggtctctcctacgtcctacctggatgtggacctccaccccgctagcgcctggacactttacgctgttgccaccacagtgattacccccatgctgcgccataccatcgaaaattctacagctaacgtcagcctggccgcgattgccaaccaggctgtggtcctcatgggactggacaaaggctggcctatctccaagatggatcttggggtgccgctgctcgccctgggatgctattctcaggttaatcccctgacgctcaccgctgccgtgcttctgctgattacacactacgccatcatcggccctgggctccaggcgaaagctaccagagaggcccaaaagcggacagctgccggaattatgaagaaccccaccgtcgacggcatcatgacgattgatctggaccctgtgatctatgatagcaaattcgagaagcagcttggccaggttatgctgctcgtgctgtgtgccgtccagctgctccttatgagaacatcctgggctctgtgcgaggccctgaccctcgcgaccgggcccattacaaccctgtgggaaggatctcctggcaaattttggaatacaacgatcgccgtgagcatggctaacatcttccgcgggtcctaccttgccggagctggcctggcctttagcattatgaagtctgtggggaccggaaaacggggcacaggctcccaaggggagaccctcggagaaaagtggaagaaaaagctgaatcagctgagcagaaaagagttcgacctctataagaaatccggcatcacagaggttgatcgcaccgaagcgaaggaggggcttaaacggggagaaattacgcatcacgccgtctctagaggcagcgctaagctgcagtggtttgtggagcggaacatggtgatcccggaagggcgcgtcattgacctgggatgtggcagaggcgggtggtcctactattgcgccggactcaagaaagttaccgaggtgcggggctacacaaaagggggacccggccatgaggaacctgtgcccatgtctacctacgggtggaatatcgtcaaactgatgagcggaaaggatgtgttctatcttcctcccgagaaatgtgacacactgctctgcgatattggcgaatccagcccgtctcctaccgttgaggagtcccgcacaatcagagtgctgaagatggtcgaaccctggctgaagaacaatcagttctgtatcaaagtgctcaacccctacatgcctaccgttgtggagcaccttgaacggctgcaacgcaagcacggcgggatgctggtcagaaatcccctcagccggaactctacgcatgagatgtattggatttccaatggaacaggcaacatcgtggctagcgtgaatatggtctctcgcctgcttctgaacagatttaccatgacccaccggagacctacaattgaaaaagacgttgatctcggggccggaacgcgccatgtgaacgctgagccggagacccccaatatggacgtgatcggcgaacggattaagagaatcaaagaggaacacaacagcacatggcactacgacgatgagaatccttataagacctgggcctaccatgggtcctatgaagtcaaggcgacaggatctgccagctccatgatcaacggcgtggttaaactgctgaccaagccctgggacgtggtccctatggtgacacagatggctatgaccgatacgacccccttcggccagcaacgcgtttttaaagagaaggtggacacacggaccccgagaagcatgcctgggacacgccgggtcatgggaattaccgccgagtggctctggagaacgctgggccgcaataaaaagccccggctttgcacaagagaagagttcaccaagaaagtgcgcacaaacgctgccatgggggccgtttttaccgaagagaatcagtgggattccgcgaaggctgccgtggaagacgaggatttctggaaactggtcgaccgggagagagaactccacaagctgggaaaatgtggctcttgcgtgtacaacatgatggggaagcgcgagaagaaacttggcgaatttggaaaagccaaaggcagcagagctatctggtacatgtggctgggggcccggtatctcgagttcgaggctctgggatttctgaatgaagatcattggttctcccgcgagaactcttacagcggcgtcgaaggggagggactccacaagctgggctatattcttagagacatctccaaaattcctgggggcgccatgtacgcggatgacacggccggatgggacacccggatcacagaagatgacctgcataatgaggagaagatcacccagcagatggatcccgaacacagacaactcgctaacgccatttttaaactgacatatcagaataaggtggttaaggtgcagcggcctacccccacaggcaccgtcatggacatcatttctcgcaaagatcagagagggagcggacaagtgggcacgtacgggcttaacacattcaccaatatggaggctcagctgatccggcagatggaaggagagggcgtgctctccaaggccgacctggaaaacccgcgcctgcctgagaaaaagattacccagtggctcgagacaaaaggggttgaaagactgaagcggatggcgatcagcggcgatgactgcgtggtcaagcccatcgatgaccgctttgccaacgcccttctggccctcaatgatatgggaaaagtgagaaaggacattccccaatggcagccttctaaaggctggcacgattggcagcaggttccgttctgttcccatcacttccatgagctgatcatgaaggacgggcggaaacttgtggtcccctgccgccctcaagacgaactgattggacgggctcggatcagccagggcgccgggtggtctctccgcgagaccgcttgtctgggaaaggcctatgcgcagatgtggtccctgatgtactttcacagacgggatctccgcctggccagcaacgctatttgctctgccgtgcccgtccactgggtgcctacatccagaacgacctggagcatccatgcccaccatcaatggatgacaaccgaagacatgcttacagtttggaatcgggtgtggattgaggataacccctggatggaggacaagacccctgtcacgacctgggaaaatgtgccctacctgggcaaaagagaggatcagtggtgtgggtccctcatcggcctgacaagccgcgctacctgggcccagaacatcccgacagcgattcagcaagttcggtctcttatcggaaatgaagagttcctggactatatgcctagcatgaagagatttcgcaaagaggaagagtccgaaggcgctatttggtga

SEQ ID NO: 20774 - RNA, 9873 nt, synthetic construct
  misc_feature 1..9873: note = derived and/or modified CDS sequence (opt5) from DENV-3__FJ639771__SS-prME
  source 1..9873: mol_type = other RNA
accagcctgtgcctcatgatgatcctgcccgccgctcttgccttccacctgacgtcccgggacggagaacctcggatgattgtggggaagaacgaacgcggaaagtctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggctagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgcgggaaaataacattaagctcaccgtcgtggttggggacgtgatcggagtcctggagcagggcaaaagaacgcttacccctcagcccatggagctgaagtactcttggaaaacatgggggaaggccaagattgtgaccgccgaaacacaaaactccagcttcatcattgatggacctaatacccccgagtgcccgtctgcttcccgcgcgtggaacgtgtgggaagtcgaggactatggctttggcgttttcacaaccaatatctggctcaaactgcgggaagtgtacacgcagctgtgtgaccacagacttatgagcgccgctgtgaaggatgagcgcgccgtccacgccgacatggggtactggatcgagtcccagaaaaacggatcttggaagctcgaaaaagctagcctgattgaggtgaagacatgcacctggcctaagtcccataccctgtggtctaatggcgttctcgaaagcgatatgatcattcccaaatccctggccgggcctatcagccagcacaactatcggcccggataccatacacaaaccgcgggcccttggcaccttgggaagctggagctcgactttaattattgcgagggaacgacagtggtcattaccgaaaactgtggcacaagaggcccctctctgcgcaccacaaccgtgtccgggaaactgatccacgagtggtgctgtcggagctgcacgcttccgcctctcagatacatgggagaagatggctgttggtatgggatggagatccggcccatttctgaaaaggaggagaatatggttaaatccctggtgagcgctggatctggcgaagtcgacaacttcaccatgggggtgctgtgcctcgccatcctgtttgaggaagttatgcgcggaaagttcggcaagaaacatatgattgccggcgtgttctttacattcgtccttctgctcagcgggcagatcacctggagagatatggctcacacactgattatgatcggatccaatgccagcgaccggatgggcatgggggtgacctacctggcgcttattgctacgtttaagatccagcccttcctggccctcggatttttcctgagaaaactcacatctcgcgagaacctgcttctgggcgtggggctcgccatggctaccacactgcaactgcctgaagatatcgagcagatggccaatggaattgctcttggcctgatggccctcaagctgatcacccagtttgagacctatcagctctggacagcgctgatttcccttacgtgtagcaacaccatcttcacactgaccgtcgcctggcggacagctaccctcattctggccggcgtttccctgcttccggtgtgccaatctagctccatgagaaaaacggactggctgcccatgacagtggctgccatgggggtccctcccctccctctgtttatcttctctctcaaggataccctgaagcgcagaagctggccccttaatgaaggagtgatggccgttggcctggtgtccatcctggcttctagcctcctgcggaacgacgtccctatggcggggccccttgtggccggaggcctgctcattgcttgttacgttatcaccgggacatccgccgatctgaccgtggagaaagccgctgacgtcacatgggaagaggaagccgagcagacgggagtgagccataacctcatgattaccgtcgacgatgacggcacaatgcgcatcaaggatgacgagaccgaaaatattctgacagtgcttctgaaaaccgcgctgctcatcgtttctggcatctttccgtactccattcctgctacgctgcttgtgtggcacacctggcagaagcagacacaaagaagcggggtcctgtgggatgtgccctctcctcccgagacccagaaagccgaactcgaggagggagtttatcggatcaagcagcagggcattttcgggaaaacacaagtgggagtcggcgtgcagaaggaaggggtgtttcataccatgtggcacgttacacgcggagccgtcctgacgtacaacggcaagagactcgagccgaattgggcttccgtgaaaaaggacctgatcagctatggcgggggatggcggctttctgcccagtggcaaaaaggcgaagaggtgcaggtcattgcggtggaacctgggaagaaccccaaaaatttccagaccatgcctggaacattccagaccaccacaggcgagatcggggctattgccctggattttaagcccggaacgtccggcagccccatcatcaaccgcgagggcaaggttgtggggctgtacggaaatggcgtcgtgaccaaaaacgggggatatgtttccggcattgcccaaacaaatgctgaacctgacgggccgacccccgagctcgaagaggaaatgttcaagaaaagaaacctgacaatcatggatcttcaccctggcagcggaaagacccggaaatacctgcccgccattgtgcgcgaggctatcaagagacggctcagaacgctgattctcgcccctacacgcgtcgtggcggccgagatggaagaggctctgaagggccttcccatccggtatcagaccaccgccacaaaatctgaacataccgggagagagatcgttgacctgatgtgccacgctacatttaccatgcgcctgctcagccctgtgcgggtcccgaattacaacctgattatcatggatgaagcccatttcacggaccccgcctccattgctgcgagaggatacatctctacacgcgtgggcatgggggaggccgctgccatttttatgaccgccacacctcccggaaccgctgatgccttccctcagagcaatgcgcccatccaggacgaggaacgggacatcccggagagatcctggaactctggcaatgaatggattacggattttgctgggaagaccgtgtggttcgtccctagcatcaaagccggcaacgacattgccaactgtcttcgcaagaatggcaaaaaggttatccaactgtcccggaagacatttgataccgagtatcagaaaacaaagctcaacgactgggatttcgtggtgaccacagacatttctgagatgggagctaattttaaagccgatagagtcatcgacccccggcgctgcctgaagcccgtgattctgaccgatgggcctgaaagagttatcctcgcgggacccatgcctgtgacggccgctagcgccgctcagcggcgcggcagagtcgggcggaacccgcagaaagagaatgaccaatacatcttcacaggacagccccttaacaatgatgaagaccacgcccattggaccgaggctaagatgctgctggacaacattaatacccctgaaggcatcattcccgccctcttcgagcctgagagagaaaagtccgcggccatcgatggggagtatcgcctgaaaggcgaaagccggaagacatttgtggagcttatgagacgcggagacctgcccgtttggctcgctcacaaagtggcctctgaaggcattaagtacaccgatcggaaatggtgcttcgacgggcagagaaacaatcagatcctggaggagaacatggatgtcgaaatctggacaaaggagggagagaagaagaagctgcgcccgcggtggctcgacgctagaacgtattccgatcctcttgccctgaaagagtttaaggacttcgccgctggccgcaaaagcattgcgctggatctcgtgaccgaaatcgggagagtcccctctcacctggcccatcggacacgcaatgctcttgacaacctggtgatgctccacacctccgagcatggaggcaaggcctacagacacgccgttgaggaactgcctgagacaatggaaaccctgctccttctgggcctgatgattctcctgacagggggagctatgctttttctgatcagcggcaaagggattggaaagacctccatcggcctcatctgtgtgattgcctctagcgggctgctgtggatggcggagatccccctccaatggattgcctccgctatcgtgcttgagttctttatgatggtcctgctgattcctgaacccgagaagcagcggacaccgcaggataatcaactcgcctatgttgtgatcggcattctgacccttgctgccatcatcgcggccaacgaaatgggcctgctcgagacaaccaaacgcgacctgggcatgagcaaggaacctggggtggtctctcccacgtcctacctggatgtggacctccaccccgctagcgcctggacactttacgctgttgccaccacagtgattacccctatgctgagacataccatcgaaaattctacagctaacgtcagcctggccgcgattgccaaccaggctgtggtcctcatgggactggacaaaggctggccgatctccaagatggatcttggggtgcccctgctcgccctgggatgctattctcaggttaatcctctgacgctcaccgctgccgtgcttctgctgattacacactacgccatcatcggccccgggctccaggcgaaagctacccgggaggcccaaaagagaacagctgccggaattatgaagaaccctaccgtcgacggcatcatgacgattgatctggaccccgtgatctatgatagcaaattcgagaagcagcttggccaggttatgctgctcgtgctgtgtgccgtccagctgctccttatgcgcacatcctgggctctgtgcgaggccctgaccctcgcgaccgggcctattacaaccctgtgggaaggatctccgggcaaattttggaatacaacgatcgccgtgagcatggctaacatcttccgggggtcctaccttgccggagctggcctggcctttagcattatgaagtctgtggggaccggaaaaagaggcacaggctcccaaggggagaccctcggagaaaagtggaagaaaaagctgaatcagctgagccgcaaagagttcgacctctataagaaatccggcatcacagaggttgatcggaccgaagcgaaggaggggcttaaaagaggagaaattacgcatcacgccgtctctcggggcagcgctaagctgcagtggtttgtggagcgcaacatggtgatccccgaagggagagtcattgacctgggatgtggccggggcgggtggtcctactattgcgccggactcaagaaagttaccgaggtgcgcggctacacaaaagggggacctggccatgaggaacccgtgcctatgtctacctacgggtggaatatcgtcaaactgatgagcggaaaggatgtgttctatcttcccccggagaaatgtgacacactgctctgcgatattggcgaatccagcccttctcccaccgttgaggagtccagaacaatccgggtgctgaagatggtcgaaccctggctgaagaacaatcagttctgtatcaaagtgctcaacccttacatgcccaccgttgtggagcaccttgaacgcctgcaaagaaagcacggcgggatgctggtccggaatcctctcagccgcaactctacgcatgagatgtattggatttccaatggaacaggcaacatcgtggctagcgtgaatatggtctctagactgcttctgaaccggtttaccatgacccacagacgcccgacaattgaaaaagacgttgatctcggggccggaacgcggcatgtgaacgctgagcccgagacccctaatatggacgtgatcggcgaaagaattaagcgcatcaaagaggaacacaacagcacatggcactacgacgatgagaatccctataagacctgggcctaccatgggtcctatgaagtcaaggcgacaggatctgccagctccatgatcaacggcgtggttaaactgctgaccaagccttgggacgtggtccccatggtgacacagatggctatgaccgatacgaccccgttcggccagcaacgggtttttaaagagaaggtggacacaagaacccctcgcagcatgcccgggacacggagagtcatgggaattaccgccgagtggctctggcgcacgctgggccggaataaaaagcctagactttgcacacgcgaagagttcaccaagaaagtgcggacaaacgctgccatgggggccgtttttaccgaagagaatcagtgggattccgcgaaggctgccgtggaagacgaggatttctggaaactggtcgacagagagcgcgaactccacaagctgggaaaatgtggctcttgcgtgtacaacatgatggggaagagagagaagaaacttggcgaatttggaaaagccaaaggcagccgggctatctggtacatgtggctgggggcccgctatctcgagttcgaggctctgggatttctgaatgaagatcattggttctccagagagaactcttacagcggcgtcgaaggggagggactccacaagctgggctatattcttcgggacatctccaaaattcccgggggcgccatgtacgcggatgacacggccggatgggacaccagaatcacagaagatgacctgcataatgaggagaagatcacccagcagatggatcctgaacaccggcaactcgctaacgccatttttaaactgacatatcagaataaggtggttaaggtgcagcgccccaccccgacaggcaccgtcatggacatcatttctagaaaagatcagcgggggagcggacaagtgggcacgtacgggcttaacacattcaccaatatggaggctcagctgatccgccagatggaaggagagggcgtgctctccaaggccgacctggaaaaccctagactgcccgagaaaaagattacccagtggctcgagacaaaaggggttgaacggctgaagcgcatggcgatcagcggcgatgactgcgtggtcaagcccatcgatgacagatttgccaacgcccttctggccctcaatgatatgggaaaagtgcggaaggacattcctcaatggcagccgtctaaaggctggcacgattggcagcaggttcccttctgttcccatcacttccatgagctgatcatgaaggacgggcgcaaacttgtggtcccttgcagaccccaagacgaactgattggacgggctcgcatcagccagggcgccgggtggtctctcagagagaccgcttgtctgggaaaggcctatgcgcagatgtggtccctgatgtactttcaccggcgcgatctcagactggccagcaacgctatttgctctgccgtgcctgtccactgggtgcccacatcccggacgacctggagcatccatgcccaccatcaatggatgacaaccgaagacatgcttacagtttggaatagagtgtggattgaggataacccttggatggaggacaagacccccgtcacgacctgggaaaatgtgccgtacctgggcaaacgcgaggatcagtggtgtgggtccctcatcggcctgacaagccgggctacctgggcccagaacatccctacagcgattcagcaagttagatctcttatcggaaatgaagagttcctggactatatgcccagcatgaagcgctttcggaaagaggaagagtccgaaggcgctatttggtga

SEQ ID NO: 20775 - RNA, 9873 nt, synthetic construct
  misc_feature 1..9873: note = derived and/or modified CDS sequence (opt5) from DENV-3__FJ639772__SS-prME
  source 1..9873: mol_type = other RNA
accagcctgtgcctcatgatgatcctgcccgccgctcttgccttccacctgacgtcccgggacggcgaacctcggatgattgtggggaagaacgaacgcggaaaatctctcctgtttaagacggcgagcggcatcaatatgtgtacccttattgctatggatctgggggagatgtgcgacgatacagtgacctacaaatgtccgcatatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgccccctgtaaaattcctttcagcaccgaggacggccaagggaaggcgcataacggaagactgatcacagctaatcccgttgtgaccaaaaaggaggaacccgtcaacattgaggccgaacctccgttcggcgagtccaatatcgtgattgggatcggcgataacgccctgaaaatcaattggtataagaagggatctagcattggcaaaatgtttgaagctacggccagaggggctagacgcatggccatccttggagacacagcgtgggatttcggctccgtcgggggagttctcaacagcctgggcaagatggtccaccagatttttgggtctgcctacaccgctctgttctccggcgtgagctgggtgatgaaaatcggaattggcgtcctcctgacctggatcgggcttaattctaagaacacaagcatgtccttttcttgcattgccatcggaatcattaccctgtatctcggcgctgtggttcaggccgacatggggtgtgtgatcaattggaaaggaaaggagctgaagtgcggcagcgggattttcgtcacaaacgaggtgcatacgtggaccgaacagtacaaatttcaagcggattcccccaagcggctggccacagctatcgccggcgcttgggagaatggagtttgtggcattagaagcaccacacgcatggaaaaccttctctggaaacagatcgccaatgagctgaactatatcctgtgggaaaataacattaagctcaccgtggtcgtgggggacatcattggagttctggagcagggcaaacggacgcttacccctcagcccatggagctgaagtactcttggaaaacatgggggaaggccaagatcgtgaccgctgaaacacaaaactccagcttcattatcgatggacctaatacccccgagtgcccgtctgcgtccagagcctggaacgtctgggaagtggaggactatggctttggcgtgttcacaaccaatatctggctcaaactgcgcgaagtctacacgcagctgtgtgaccaccggcttatgagcgctgccgttaaggatgagagagccgtgcacgctgacatggggtactggattgagtcccagaaaaacggatcttggaagctcgaaaaagccagcctgatcgaggtgaagacatgcacctggcctaagtcccataccctgtggtctaatggcgtcctcgaaagcgatatgattatccccaaatccctggcggggcctattagccagcacaactatcgccccggataccatacacaaaccgctggcccttggcaccttgggaagctggagctcgactttaattattgcgagggaacgacagtggttatcaccgaaaactgtggcacacggggcccctctctgagaaccacaaccgtgtccgggaaactgatccacgagtggtgctgtcgcagctgcacgcttccgcctctccggtacatgggagaagatggctgttggtatgggatggagattagacccatctctgaaaaggaggagaatatggtcaaatccctggtgagcgccggatctggcgaagttgacaacttcaccatgggggtgctgtgcctcgccattctgtttgaggaagtcatgcggggaaagttcggcaagaaacatatgatcgctggcgtgttctttacattcgttcttctgctcagcgggcagattacctggcgcgatatggcccacacactgatcatgattggatccaatgcgagcgacagaatgggcatgggggtgacctacctggctcttatcgccacgtttaagatccagcccttcctggccctcggatttttcctgcggaaactcacatctagagagaacctgcttctgggcgtcgggctcgctatggccaccacactgcaactgcctgaagatattgagcagatggctaatggaatcgcccttggcctgatggcgctcaagctgattacccagtttgagacctatcagctctggacagccctgatctcccttacgtgtagcaacaccattttcacactgaccgtggcttggcgcacagccaccctcatcctggctggcgtgtccctgcttccggtctgccaatctagctccatgcggaaaacggactggatccccatgacagttgccgccatgggggtgcctcccctgcctctctttattttctctctgaaggataccctcaagagacgcagctggcccctgaatgaaggagtgatggctgtcggccttgtgtccatcctggcgtctagcctgctcagaaacgacgttcctatggccgggcccctggtggctggaggccttctgattgcctgttacgtcatcaccgggacatccgccgatctcaccgtggagaaagctgccgacgttacatgggaagaggaagcggagcagacgggagtgagccataacctgatgattaccgtcgacgatgacggcacaatgcggatcaaggatgacgagaccgaaaatatcctcacagtgctgcttaaaaccgctctgctgattgtctctggcatctttccgtactccattcctgccacgctcctggtgtggcacacctggcagaagcagacacaacgcagcggggttctttgggatgtgccctctcctcccgagacccagaaagccgaactggaggagggagtctatagaatcaagcagcagggcattttcgggaaaacacaagtgggagttggcgtgcagaaggaaggggtctttcataccatgtggcacgtgacacggggagctgtgctcacgtacaacggcaagcgcctggagccgaattgggcctccgttaaaaaggacctcatcagctatggcgggggatggagactgtctgcgcagtggcaaaaaggcgaagaggtccaggtgattgctgtggaacctgggaagaaccccaaaaatttccagaccatgcctggaacattccagaccaccacaggcgagatcggggccatcgcccttgattttaagcccggaacgtccggcagccccattatcaaccgggagggcaagattgtcgggctgtacggaaatggcgtggttaccaaaaacgggggatatgtgtccggcatcgctcaaacaaatgccgaacctgacgggccgacccccgagctggaagaggaaatgttcaagaaacgcaacctcacaattatggatctgcaccctggcagcggaaagaccagaaaataccttcccgctatcgtccgggaggccatcaagcgcagactgcggacgctcattctggcgcctacaagagtggttgccgctgagatggaagaggccctcaagggcctgcccatccgctatcagacctctgctaccaaaagcgaacatacagggcgggagattgtggaccttatgtgccacgccacctttacaatgagactgctgtcccctgtccgcgtgccgaattacaacctcatcattatggatgaagcccatttcaccgaccccgcttctatcgcggcccggggatacatcagcacgagagttggcatgggggaggctgccgccatttttatgacagctacccctcccggaacagccgatgcgttccctcagtccaatgctcccatccaggacgaggaacgcgacattccggagcggtcttggaacagcggcaatgaatggatcaccgattttgccgggaagacggtgtggttcgtcccttccattaaagccggcaacgacatcgctaactgtctgagaaagaatggcaaaaaggtgattcaactttctcgcaagacctttgatacagagtatcagaaaaccaagctgaacgactgggatttcgtggtcacaaccgacatcagcgagatgggagccaattttaaagcggatcgggttatcgaccccagacggtgcctcaagcccgtgattctgacagatgggcctgaacgcgtgatcctggccggacccatgcctgtcaccgctgcctccgctgcccagagacggggccgcgtggggagaaacccgcagaaagagaatgaccaatacattttcacgggacagcccctcaacaatgatgaagaccacgctcattggacagaggccaagatgcttctggacaacatcaatacccctgaaggcattatccccgcgctgttcgagcctgagcgggaaaagagcgccgctatcgatggggagtatagactcaaaggcgaatctcgcaagacctttgttgagctgatgcggagaggagaccttcccgtgtggctggcccacaaagtcgcttccgaaggcattaagtacacagatcgcaaatggtgcttcgacgggcagcggaacaatcagatcctcgaggagaacatggatgtggaaatttggaccaaggagggagagaagaagaagctgagaccgcgctggctggacgcccggacatatagcgatcctctcgcccttaaagagtttaaggacttcgctgcgggcagaaaatctatcgccctggatctggttacggaaattgggcgcgtgcccacccacctcgctcatagaacacggaatgccctggacaaccttgtcatgctgcacacctccgagcatggaggcaaggcctaccgccacgctgtggaggaactccctgagacaatggaaaccctgctgctccttggcctgatgatcctgctcacagggggagccatgctgtttcttatcagcggcaaagggattggaaagacctccatcggcctgatttgtgtcatcgcgtctagcgggatgctctggatggccgagattcccctgcaatggatcgcttccgccattgtgctggagttctttatgatggttctccttatccctgaacccgagaagcagagaacaccgcaggataatcaactggcttatgtggtgatcggcattctcaccctcgccgcgatcattgccgctaacgaaatgggactgcttgagacaaccaaacgggacctgggcatgagcaaggaacctggggtcgtttctcccacgtcctacctcgatgtggacctgcaccccgccagcgcttggacactgtacgccgtggctaccacagtcatcacccctatgctccgccataccattgaaaattctacagccaacgtgagccttgcggccatcgctaaccaggccgttgtgctgatgggactggacaaaggctggccgatctccaagatggatctcggggtccccctgcttgctctgggatgctattctcaggtgaatcctctcacgctgaccgccgccgtcctgctccttattacacactacgcgatcattggccccgggctgcaggctaaagccaccagagaggctcaaaagcggacagccgccggaatcatgaagaaccctaccgtggacggcattatgacgatcgatctggaccccgttatctatgatagcaaattcgagaagcagctcggccaggtgatgctgcttgtcctgtgtgctgtgcagctcctgctgatgagaacatcctgggccctctgcgaggcgcttaccctggccaccgggcctattacaaccctgtgggaaggatctccgggcaaattttggaatacaacgatcgctgttagcatggccaacattttccgcgggtcctacctcgctggagccggcctggcgtttagcatcatgaagtctgtggggaccggaaaacggggcacaggctcccaaggggagacccttggagaaaagtggaagaaaaagctgaatcagctcagcagaaaagagttcgacctgtataagaaatccggcattacagaggtcgatcgcaccgaagccaaggaggggctgaaacggggagaaatcacgcatcacgctgtgtctagaggcagcgccaagctccagtggtttgtggagcggaacatggttattcccgaagggcgcgtcatcgaccttggatgtggcagaggcgggtggtcctactattgcgctggactgaagaaagtgaccgaggtgcggggctacacaaaagggggacctggccatgaggaacccgtccctatgtctacctacgggtggaatatcgttaaactgatgagcggaaaggatgtgttctatctgcccccggagaaatgtgacacactgctttgcgatattggcgaatccagcccttctcccaccgtggaggagtcccgcacaatcagagtcctgaagatggtggaaccctggctcaagaacaatcagttctgtattaaagttctgaacccttacatgcccaccgtgatcgagcacctggaacggctccaacgcaagcacggcgggatgcttgtcagaaatcctctgagccggaactctacgcatgagatgtattggatttccaatggaacaggcaacatcgtggccagcgttaatatggtgtctcgcctgctcctgaacagatttaccatgacccaccggagaccgacaatcgaaaaagacgtcgatcttggggctggaacgcgccatgtgaacgccgagcccgagacccctaatatggacgtgattggcgaacggatcaagagaattaaagaggaacacaacagcacatggcactacgacgatgagaatccctataagacctgggcgtaccatgggtcctatgaagtcaaggccacaggatctgctagctccatgatcaacggcgttgtgaaactgctcaccaagccttgggacgtggtccccatggtgacacagatggccatgaccgatacgaccccgttcggccagcaacgcgtttttaaagagaaggtggacacacggacccctagaagcatgcccgggacacgccgggtcatgggaattaccgctgagtggctgtggagaacgctgggccgcaataaaaagcctcggctctgcacaagagaagagttcaccaagaaagtgcgcacaaacgccgccatgggggcggtttttaccgaagagaatcagtgggattccgctaaggccgccgtggaagacgaggatttctggaaactggtcgaccgggagagagaacttcacaagctgggaaaatgtggctcttgcgtgtacaacatgatggggaagcgcgagaaaaagctcggcgaatttggaaaggctaaaggcagcagagccatctggtacatgtggctgggggctcggtatcttgagttcgaggccctgggatttctcaatgaagatcattggttctcccgcgagaactcttacagcggcgttgaaggggagggactgcacaagctgggctatatcctcagagacatttccaaaatccccgggggcgcgatgtacgccgatgacacggctggatgggacacccggattacagaagatgacctgcataatgaggagaagatcacccagcagatggatcctgaacacagacaacttgccaacgctatttttaaactgacatatcagaataaggtggtcaaggtgcagcggcccaccccgacaggcaccgtcatggacatcatctctcgcaaagatcagagagggagcggacaagtgggcacgtacgggctcaacacattcaccaatatggaggcccagctgattcggcagatggaaggagagggcgttctttccaaggcggacctggaaaaccctcacctccccgagaaaaagatcacccagtggctggagacaaaaggggtggaacgcctgaagagaatggccattagcggcgatgactgcgtcgtgaagcccatcgatgaccggtttgctaacgccctcctggctcttaatgatatgggaaaagtgcgcaaggacattcctcaatggcagccgtctaaaggctggcatgattggcagcaggttcccttctgttcccaccatttccacgagctgatcatgaaggacgggagaaaactcgtggtcccttgccggccccaagacgaactgattggacgcgccagaatcagccagggcgctgggtggtctcttcgggagaccgcctgtctgggaaaggcgtatgcccagatgtggtccctcatgtactttcaccgcagagatctgcggctggctagcaacgccatctgctctgccgtgcctgttcattgggtgcccacatcccgcacgacctggagcattcacgctcatcaccaatggatgacaaccgaagacatgctcacagtctggaatagagtgtggatcgaggataacccttggatggaggacaagacccccgtcacgacctgggaaaatgtgccgtacctgggcaaacgggaggatcagtggtgtgggtcccttattggcctgacaagcagagccacctgggcgcagaacatccctacagctattcagcaagttcgctctctcatcggaaatgaagagttcctggactatatgcccagcatgaagcggtttagaaaagaggaagagtccgaaggcgccatctggtga

SEQ ID NO: 20776 - RNA, 9873 nt, synthetic construct
  misc_feature 1..9873: note = derived and/or modified CDS sequence (opt5) from DENV-3__FJ639774__SS-prME
  source 1..9873: mol_type = other RNA
acaagcctgtgcctcatgatgatcctgcccgccgctcttgccttccacctgacatccagagacggagagcctcggatgattgtggggaagaatgaaagaggaaaatctctcctgtttaagacggcgagcggcatcaatatgtgtacccttattgctatggatctgggggagatgtgcgacgatacagtgacctacaaatgtccgcacatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacagacctggatgagcgccgagggcgcttggcggcaagtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcaccacaaccgaaacgcctacatggaatcggaaagagcttctggtgacctttaagaacgcccacgctaaaaagcaagaagtcgtggttctcgggtctcaggagggagcgatgcacacagccctgaccggcgctaccgaaatccaaaattccgggggcacaagcattttcgccggacatctgaagtgtcgcctcaaaatggacaagctggagcttaaaggcatgtcttacgccatgtgcacgaacacctttgtgctgaagaaagaggtctccgaaacacagcacgggaccatcctcatcaaggtggagtacaagggagaagatgttccctgtaaaattcctttcagcacagaggacggccaagggaaggctcataacggaagactgatcaccgccaatcccgtggtcacgaaaaaggaggaacccgtgaacattgaggcggaacctccgttcggcgagtccaatatcgtgattgggatcggcgataacgctctgaaaatcaattggtataagaagggatctagcattggcaaaatgtttgaagccacagccagaggggctagacgcatggccatccttggagacaccgcttgggatttcggctccgttgggggagtcctcaacagcctgggcaagatggtgcaccagatttttgggtctgcctacaccgcgctgttctccggcgtgagctgggtcatgaaaatcggaattggcgtgctcctgacatggatcgggcttaattctaagaacaccagcatgtccttttcttgcattgccatcggaatcattacactgtatctcggcgctgttgtgcaggccgacatggggtgtgtcatcaattggaaaggaaaggagctgaagtgcggcagcgggattttcgtgacgaacgaggttcatacctggacagaacagtacaaatttcaagctgattcccccaagcggctggccaccgcgatcgccggcgcttgggagaatggagtgtgtggcattagaagcacaacccgcatggaaaaccttctctggaaacagatcgccaatgagctgaactatatcctgtgggaaaataacattaagctcacggtcgtggttggggacatcattggagtgctggagcagggcaaacggacccttacacctcagcccatggagctgaagtactcttggaaaacctgggggaaggctaagatcgtcacagccgaaacccaaaactccagcttcattatcgatggacctaatacacccgagtgcccgaacgcctctagagcttggaatgtgtgggaagtggaggactatggctttggcgtcttcaccacgaacatctggctcaaactgcgcgaagtttacacacagctgtgtgaccaccggcttatgtccgcggccgtgaaggatgagagagctgtgcacgccgacatggggtactggattgagagccagaaaaatggatcctggaagctcgaaaaagcctctctgatcgaggtcaagacctgcacctggcctaagagccatacactgtggtccaacggcgtgctcgaatctgatatgattatccccaaaagcctggctgggcctatttcccagcacaattatcgccccggataccatacccaaacggccggcccttggcaccttgggaagctggagctcgactttaactattgcgagggaacaaccgttgtgatcacagaaaattgtggcacccggggccccagcctgagaacaaccacggtctctgggaaactgatccacgagtggtgctgtcgctcctgcacccttccgcctctccggtacatgggagaagatggctgttggtatgggatggagattagacccatcagcgaaaaggaggagaacatggtgaaatctctggtttccgcgggaagcggcgaagtggacaatttcacaatgggggtcctgtgcctcgctattctgtttgaggaagtgatgcggggaaagttcggcaagaaacatatgatcgccggcgttttctttaccttcgtgcttctgctctctgggcagattacatggcgcgatatggcccacaccctgatcatgattggaagcaacgcttccgacagaatgggcatgggggtcacgtacctggcccttatcgcgacatttaagatccagcccttcctggctctcggatttttcctgcggaaactcaccagcagagagaatctgcttctgggcgtggggctcgccatggccacaaccctgcaactgcctgaagatattgagcagatggctaacggaatcgcccttggcctgatggctctcaagctgattacccagtttgagacatatcagctctggacggccctgatctctcttacctgttccaatacaattttcaccctgacagtggcgtggcgcaccgccacgctcatcctggctggcgtcagcctgcttccggtttgccaatcctctagcatgcggaaaacagactggctgcccatgaccgtggccgctatgggggtgcctcccctccctctgtttatcttctccctcaaggataccctgaagagacgctcttggccccttaacgaaggagtcatggccgtgggcctggttagcattctggcctcctctctcctgagaaacgacgtgcctatggctgggccccttgtcgcgggaggcctgctcatcgcctgttacgtgattacagggaccagcgctgatctgacagttgagaaagccgccgacgtgacgtgggaagaggaagctgagcagaccggagtctcccataatctcatgatcacagtggacgatgacggcaccatgcggattaaggatgacgagacagaaaacatcctgaccgtccttctgaaaacggccctgctcatcgtgagcggcatttttccgtactctatccctgcgaccctgcttgtttggcacacatggcagaagcagacccaacgctccggggtgctgtgggatgtccccagccctcccgagacacagaaagctgaactcgaggagggagtgtatagaattaagcagcagggcatcttcgggaaaacccaagttggagtgggcgtccagaaggaaggggtgtttcatacaatgtggcacgtgacgcggggagccgttctgacctacaatggcaagcgcctcgagccgaactgggcctctgtcaaaaaggacctgatttcctatggcgggggatggagacttagcgctcagtggcaaaaaggcgaagaggtccaggtgatcgccgtcgaacctgggaagaatcccaaaaacttccagacaatgcctggaaccttccagaccacaacgggcgagattggggcgatcgctctggattttaagcccggaacctctggctcccccatcattaatcgggagggcaaggtggttgggctgtacggaaacggcgtggtcaccaagaatgggggatatgtgagcggcatcgcccaaaccaacgccgaacctgacgggccgacacccgagctcgaagaggaaatgttcaagaaacgcaatctgaccattatggatcttcaccctggctccggaaagacgagaaaatacctgcccgctatcgttcgggaggccattaagcgcagactccggacactgatcctcgctcctaccagagtggtcgccgcggagatggaagaggccctgaagggccttcccatccgctatcagaccacagctaccaaaagcgaacatacagggcgggagattgtggacctgatgtgccacgccacctttacgatgagactgctctctcctgttcgcgtgccgaactacaatctgatcattatggatgaagctcatttcacagaccccgccagcatcgccgctcggggatacatttccaccagagtcggcatgggggaggcggccgctatctttatgacagccacccctcccggaacggccgatgctttccctcagtctaacgcccccatccaggacgaggaacgcgacattccggagcggagctggaactccggcaacgaatggatcaccgattttgcggggaagacagtgtggttcgtgccttctattaaagctggcaacgacatcgccaattgtcttagaaagaacggcaaaaaggtcattcaactgagccgcaagacctttgatacagagtatcagaaaaccaagctcaatgactgggatttcgttgtgacaaccgacatctccgagatgggagccaactttaaagctgatcgggtgattgaccccagacggtgcctgaagcccgtcatcctgacggatgggcctgaacgcgtgatcctcgccggacccatgcctgttacagcggcctctgctgcccagagacggggccgcgtggggagaaatccgcagaaagagaacgaccaatacattttcaccggacagccccttaataacgatgaagaccacgctcattggaccgaggccaagatgctgctggacaatatcaacacacctgaaggcattatccccgctctcttcgagcctgagcgggaaaagagcgccgcgattgatggggagtatagactgaaaggcgaatcccgcaagacctttgtcgagcttatgcggagaggagacctgcccgtgtggctcgcccacaaagttgctagcgaaggcatcaagtacacagatcgcaaatggtgcttcgacgggcagcggaataaccagatcctggaggagaatatggatgtggaaatttggacgaaggagggagaacgcaagaaactgcgcccgcggtggctcgacgccagaacctattctgatcctcttgctctgaaagagtttaaagacttcgccgccggccgcaagtccatcgctctggatctcgtcacagaaattgggagagtgcccacccacctggcgcatcggacacgcaacgcccttgacaatctggtcatgctccacaccagcgagcatggaggcaaggcttacagacacgccgtggaggaactgcctgagacgatggaaaccctgctccttctgggcctgatgatcctcctgacagggggagccatgctttttctgatttctggcaaggggatcggaaaaacctccatcggcctcatttgtgttatcgctagctccgggatgctgtggatggccgagattcccctgcaatggatcgcgtctgccattgtgctcgagttctttatgatggtgcttctgatccctgaacccgagaagcagcggacaccgcaggataaccaactggcttatgtcgttattggaatcctcaccctggccgctatcattgccgcgaatgaaatgggccttctggagacgacaaagcgcgacctcggcatgagcaaagaacctggggtggtgtcccccaccagctacctggatgtcgacctgcaccccgcctctgcttggacactctacgccgtggctaccaccgttatcacacctatgcttagacatacgattgagaactccaccgccaacgtgagcctggctgccatcgcgaatcaggccgtcgtgctgatgggactcgacaagggctggccgatttctaaaatggatctgggggtcccccttctggctctcggatgctatagccaggtgaaccctctgacactgaccgccgctgttctccttctgatcacacactacgccatcattggccccgggctgcaggccaaggcgacccgggaggctcagaaacggacggccgctggaatcatgaagaatcctacagtggacggcattatgaccatcgatctcgaccccgtcatttatgattccaagttcgaaaaacagctgggccaggtgatgcttctggttctctgtgccgtgcagctgctgctcatgcgcacctcttgggccctttgcgaggctctgacactggccaccgggcctatcacaacgctctgggaaggaagcccgggcaagttttggaacaccacaatcgcggtctccatggccaatattttccgggggtcttacctggctggagccggccttgcttttagcatcatgaaatccgtggggaccggaaagagaggcacaggcagccaaggggagaccctgggagaaaaatggaagaagaaactcaaccagctgtctcgcaaggagttcgacctgtataaaaagtccggcattacggaggtggatcggaccgaagccaaagaggggctcaagagaggagaaatcacacatcacgcggttagccggggctccgccaaacttcagtggtttgtcgagcgcaatatggtgattcccgaagggagagtgatcgacctgggatgtggccggggcgggtggtcttactattgcgctggactgaagaaggtcaccgaggttcgcggctacacaaaagggggacctggccatgaggaacccgtgcctatgagcacctacgggtggaacattgtgaagctcatgtccggaaaagatgtcttctatctgcccccggagaagtgtgacacacttctgtgcgatatcggcgaatctagcccttcccccaccgtggaggagagcagaacgatccgggttctcaaaatggtggaaccctggctgaagaataaccagttctgtattaaggtcctgaatccttacatgcccgccgtgatcgagcacctcgaacgccttcaaagaaaacacggcgggatgctggttcggaaccctctgtctcgcaattccacacatgagatgtattggattagcaacggaaccggcaatatcgtggcttctgtcaacatggtgtccagactcctgcttaaccggtttaccatgacacacagacgcccgacgattgaaaaggacgtggatctgggggccggaacccggcatgtcaatgctgagcccgagacacctaacatggacgttatcggcgaaagaatcaaacgcattaaggaggaacacaatagcacctggcactacgacgatgagaacccctataaaacatgggcctaccatgggtcttatgaagtgaaggcgaccggaagcgcctcctctatgatcaatggcgtggtcaagctcctgacaaaaccttgggacgtggttcccatggtgacccagatggctatgacggataccacaccgttcggccagcaacgggtctttaaggagaaagtggacaccagaacacctcgcagcatgcccgggacccggagagttatgggaattacggccgagtggctgtggcgcacactcggccggaacaagaaacctagactgtgcacccgcgaagagttcacaaagaaggtgcggaccaatgctgccatgggggccgtctttacggaagagaaccagtgggattccgcgaaagctgccgtggaagacgaggatttctggaaacttgttgacagagagcgcgaactgcacaaactcggaaagtgtggcagctgcgtgtacaatatgatggggaaaagagagaagaaactgggcgaatttggaaaggccaagggctcccgggctatctggtacatgtggcttggggcccgctatctggagttcgaggctctcggatttctgaacgaagatcattggttctctagagagaatagctactccggcgtcgaaggggagggactgcacaaactcggctatattctgcgggacatctctaagatccccgggggcgccatgtacgcggatgacaccgccggatgggacacaagaattaccgaagatgaccttcataacgaggagaaaatcacacagcagatggatcctgaacaccggcaactggctaatgccatttttaagctcacctatcagaacaaagtggtcaaggtgcagcgccccacaccgaccggcacggttatggacatcattagcagaaaggatcagcgggggtccggacaagtgggcacatacgggctgaataccttcaccaacatggaggctcagcttatccgccagatggaaggagagggcgtcctgtctaaagccgacctcgaaaaccctcatctgcccgagaagaaaatcacacagtggctggagaccaagggggtggaaagactcaaacggatggcgattagcggcgatgactgcgtggttaagcccatcgatgaccgctttgccaatgctctgcttgccctgaacgatatgggaaaggtgagaaaagacattcctcaatggcagccgtccaagggctggcatgattggcagcaggtccccttctgtagccaccatttccacgagctcatcatgaaagacgggcggaagctggtggttccttgccgcccccaagacgaacttattggcagagctcggatctctcagggcgccgggtggtccctgcgcgagacagcttgtctcggaaaagcctatgcgcagatgtggagcctgatgtactttcacagacgggatctgcgcctcgcctctaatgctatttgctccgccgtgcctgtccattgggtgcccacgagcagaaccacatggtctatccacgcccatcaccaatggatgaccacagaagacatgctgaccgtctggaaccgggtgtggatcgaggataatccttggatggaggacaagacgcccgttaccacatgggaaaacgtgccgtaccttggcaagagagaggatcagtggtgtgggtccctgattggcctcaccagccgcgctacatgggcccagaatatccctaccgcgattcagcaagtccggtccctgatcggaaacgaagagttccttgactatatgcccagcatgaaaagatttcgcaaggaggaagagtctgaaggcgctatttggtga

SEQ ID NO: 20777 - RNA, 9873 nt, synthetic construct
  misc_feature 1..9873: note = derived and/or modified CDS sequence (opt5) from DENV-3__FJ639775__SS-prME
  source 1..9873: mol_type = other RNA
accagcctgtgcctcatgatgatcctgcccgccgctcttgccttccacctgacgtcccgggacggcgaacctcggatgattgtggggaagaacgaacgcggaaagtctctcctgtttaagacggcgagcggcatcaatatgtgtacccttattgctatggatctgggggagatgtgcgacgatacagtgacctacaaatgtccgcacatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacatcattggagtgctggagcagggcaaacggacgcttacccctcagcccatggagctgaagtactcttggaaaacatgggggaaggccaagatcgtcaccgccgaaacacaaaactccagcttcattatcgatggacctaatacccccgagtgcccgtctgcttccagagcgtggaacgtgtgggaagtggaggactatggctttggcgtcttcacaaccaatatctggctcaaactgcgcgaagtttacacgcagctgtgtgaccaccggcttatgagcgccgctgtgaaggatgagagagccgtgcacgccgacatggggtactggattgagtcccagaaaaacggatcttggaagctcgaaaaagctagcctgatcgaggtcaagacatgcacctggcctaagtcccataccctgtggtctaatggcgtgctcgaaagcgatatgattatccccaaatccctggccgggcctattagccagcacaactatcgccccggataccatacacaaaccgcgggcccttggcaccttgggaagctggagctcgactttaattattgcgagggaacgacagttgtgatcaccgaaaactgtggcacacggggcccctctctgagaaccacaaccgtctccgggaaactgatccacgagtggtgctgtcgcagctgcacgcttccgcctctccggtacatgggagaagatggctgttggtatgggatggagattagacccatctctgaaaaggaggagaatatggtgaaatccctggttagcgctggatctggcgaagtggacaacttcaccatgggggtcctgtgcctcgccattctgtttgaggaagtgatgcggggaaagttcggcaagaaacatatgatcgccggcgttttctttacattcgtgcttctgctcagcgggcagattacctggcgcgatatggctcacacactgatcatgattggatccaatgccagcgacagaatgggcatgggggtcacctacctggcgcttatcgctacgtttaagatccagcccttcctggccctcggatttttcctgcggaaactcacatctagagagaacctgcttctgggcgtggggctcgccatggctaccacactgcaactgcctgaagatattgagcagatggccaatggaatcgctcttggcctgatggccctcaagctgattacccagtttgagacctatcagctctggacagcgctgatctcccttacgtgtagcaacaccattttcacactgaccgtggcctggcgcacagctaccctcatcctggccggcgtctccctgcttccggtttgccaatctagctccatgcggaaaacggactggctgcccatgacagtggctgccatgggggtgcctcccctccctctgtttatcttctctctcaaggataccctgaagagacgcagctggccccttaatgaaggagtcatggccgtgggcctggtttccattctggcttctagcctcctgagaaacgacgtgcctatggcggggccccttgtcgccggaggcctgctcatcgcttgttacgtgattaccgggacatccgccgatctgaccgttgagaaagccgctgacgtgacatgggaagaggaagccgagcagacgggagtcagccataacctcatgatcaccgtggacgatgacggcacaatgcggattaaggatgacgagaccgaaaatatcctgacagtccttctgaaaaccgcgctgctcatcgtgtctggcatttttccgtactccatccctgctacgctgcttgtttggcacacctggcagaagcagacacaacgcagcggggtgctgtgggatgtcccctctcctcccgagacccagaaagccgaactcgaggagggagtgtatagaattaagcagcagggcatcttcgggaaaacacaagttggagtgggcgtccagaaggaaggggtgtttcataccatgtggcacgtgacacggggagccgttctgacgtacaacggcaagcgcctcgagccgaattgggcttccgtcaaaaaggacctgattagctatggcgggggatggagactttctgcccagtggcaaaaaggcgaagaggtccaggtgatcgcggtcgaacctgggaagaaccccaaaaatttccagaccatgcctggaacattccagaccaccacaggcgagattggggctatcgccctggattttaagcccggaacgtccggcagccccatcattaaccgggagggcaaggtggttgggctgtacggaaatggcgtggtcaccaaaaacgggggatatgtgtccggcatcgcccaaacaaatgctgaacctgacgggccgacccccgagctcgaagaggaaatgttcaagaaacgcaacctgacaattatggatcttcaccctggcagcggaaagaccagaaaatacctgcccgccatcgttcgggaggctattaagcgcagactccggacgctgatcctcgcccctacaagagtggtcgcggccgagatggaagaggctctgaagggccttcccatccgctatcagaccaccgccacaaaatctgaacataccgggcgggagattgtggacctgatgtgccacgctacatttaccatgagactgctcagccctgttcgcgtgccgaattacaacctgatcattatggatgaagcccatttcacggaccccgcctccatcgctgcgcggggatacatttctacaagagtcggcatgggggaggccgctgccatctttatgaccgccacacctcccggaaccgctgatgccttccctcagagcaatgcgcccatccaggacgaggaacgcgacattccggagcggtcctggaactctggcaatgaatggatcacggattttgctgggaagaccgtgtggttcgtgcctagcattaaagccggcaacgacatcgccaactgtcttagaaagaatggcaaaaaggtcattcaactgtcccgcaagacatttgataccgagtatcagaaaacaaagctcaacgactgggatttcgttgtgaccacagacatctctgagatgggagctaattttaaagccgatcgggtgattgaccccagacggtgcctgaagcccgtcatcctgaccgatgggcctgaacgcgtgatcctcgcgggacccatgcctgttacggccgctagcgccgctcagagacggggccgcgtggggagaaacccgcagaaagagaatgaccaatacattttcacaggacagccccttaacaatgatgaagaccacgcccattggaccgaggctaagatgctgctggacaacatcaatacccctgaaggcattatccccgccctcttcgagcctgagcgggaaaagtccgcggccattgatggggagtatagactgaaaggcgaaagccgcaagacatttgtcgagcttatgcggagaggagacctgcccgtgtggctcgctcacaaagttgcctctgaaggcatcaagtacaccgatcgcaaatggtgcttcgacgggcagcggaacaatcagatcctggaggagaacatggatgtggaaatttggacaaaggagggagagaagaagaagctgagaccgcgctggctcgacgctcggacgtattccgatcctcttgccctgaaagagtttaaggacttcgccgctggcagaaaaagcatcgcgctggatctcgtcaccgaaattgggcgcgtgccctctcacctggcccatagaacacggaatgctcttgacaacctggtcatgctccacacctccgagcatggaggcaaggcctaccgccacgccgtggaggaactgcctgagacaatggaaaccctgctccttctgggcctgatgatcctcctgacagggggagctatgctttttctgattagcggcaaagggatcggaaagacctccatcggcctcatttgtgttatcgcctctagcgggatgctgtggatggcggagattcccctgcaatggatcgcctccgctattgtgctcgagttctttatgatggtgcttctgatccctgaacccgagaagcagagaacaccgcaggataatcaactggcctatgtcgttattggaatcctcaccctggctgccatcattgcggccaacgaaatgggccttctggagacaaccaaacgggacctcggcatgagcaaggaacctggggtggtgtctcccacgtcctacctggatgtcgacctgcaccccgctagcgcctggacactctacgctgtggccaccacagttatcacccctatgcttcgccataccattgaaaattctacagctaacgtgagcctggccgcgatcgccaaccaggctgtcgtgctgatgggactcgacaaaggctggccgatttccaagatggatctgggggtcccccttctggccctcggatgctattctcaggtgaatcctctgacgctgaccgctgccgttctccttctgatcacacactacgccatcattggccccgggctgcaggcgaaagctaccagagaggcccaaaagcggacagctgccggaatcatgaagaaccctaccgtggacggcattatgacgatcgatctcgaccccgtcatttatgatagcaaattcgagaagcagctgggccaggtgatgcttctggttctctgtgccgtgcagctgctgctcatgagaacatcctgggctctttgcgaggccctgaccctggcgaccgggcctatcacaaccctctgggaaggatctccgggcaaattttggaatacaacgatcgccgtcagcatggctaacattttccgcgggtcctacctggccggagctggccttgcctttagcatcatgaagtctgtggggaccggaaaacggggcacaggctcccaaggggagaccctgggagaaaagtggaagaaaaagctcaatcagctgagcagaaaagagttcgacctgtataagaaatccggcattacagaggtggatcgcaccgaagcgaaggaggggctcaaacggggagaaatcacgcatcacgccgtttctagaggcagcgctaaacttcagtggtttgtcgagcggaacatggtgattcccgaagggcgcgtgatcgacctgggatgtggcagaggcgggtggtcctactattgcgccggactgaagaaagtcaccgaggttcggggctacacaaaagggggacctggccatgaggaacccgtgcctatgtctacctacgggtggaatattgtgaaactcatgagcggaaaggatgtcttctatctgcccccggagaaatgtgacacacttctgtgcgatatcggcgaatccagcccttctcccaccgtggaggagtcccgcacaatcagagttctcaagatggtggaaccctggctgaagaacaatcagttctgtattaaagtcctgaacccttacatgcccaccgtgatcgagcacctcgaacggcttcaacgcaagcacggcgggatgctggttagaaatcctctgagccggaactctacgcatgagatgtattggatttccaatggaacaggcaacatcgtggctagcgtcaatatggtgtctcgcctcctgcttaacagatttaccatgacccaccggagaccgacaattgaaaaagacgtggatctgggggccggaacgcgccatgtcaacgctgagcccgagacccctaatatggacgttatcggcgaacggatcaagagaattaaagaggaacacaacagcacatggcactacgacgatgagaatccctataagacctgggcctaccatgggtcctatgaagtgaaggcgacaggatctgccagctccatgatcaacggcgtggtcaaactcctgaccaagccttgggacgtggttcccatggtgacacagatggctatgaccgatacgaccccgttcggccagcaacgcgtctttaaagagaaggtggacacacggacccctagaagcatgcccgggacacgccgggccatgggaattaccgctgagtggctgtggagaacgctcggccgcaataaaaagcctcggctgtgcacaagagaagagttcaccaagaaagttcgcacaaacgccgccatgggggcggtgtttaccgaagagaatcagtgggattccgctaaggccgccgtcgaagacgaggatttctggaaacttgtggaccgggagagagaactgcacaagctcggaaaatgtggctcttgcgtttacaacatgatggggaagcgcgagaaaaagctgggcgaatttggaaaggctaaaggcagcagagccatctggtacatgtggcttggggctcggtatctggagttcgaggccctcggatttctgaatgaagatcattggttctcccgcgagaactcttacagcggcgtggaaggggagggactgcacaagctcggctatattctgagagacatctccaaaatccccgggggcgcgatgtacgccgatgacacggctggatgggacacccggattacagaagatgaccttcataatgaggagaagatcacccagcagatggatcctgaacacagacaactggccaacgctatttttaaactcacatatcagaataaggtcgtgaaggtccagcggcccaccccgacaggcaccgtgatggacatcatttctcgcaaagatcagagagggagcggacaagttggcacgtacgggctgaacacattcaccaatatggaggcccagcttatccggcagatggaaggagagggcgtgctgtccaaggcggacctcgaaaaccctcatctgcccgagaaaaagatcacccagtggctggagacaaaaggggtcgaacgcctcaagagaatggccattagcggcgatgactgcgtggtgaagcccatcgatgaccggtttgctaacgccctgcttgctctgaatgatatgggaaaagttcgcaaggacattcctcaatggcagccgtctaaaggctggcatgattggcaacaggtgcccttctgttcccaccatttccacgagctcatcatgaaggacgggagaaaactggtcgtgccttgccggccccaagacgaacttattggacgcgccagaatcagccagggcgctgggtggtctctgcgggagaccgcctgtctcggaaaggcgtatgcccagatgtggtccctgatgtactttcaccgcagagatctgcggctcgctagcaacgccatttgctctgccgttcctgtgcattgggtccccacatcccgcacgacctggagcatccacgctcatcaccaatggatgacaaccgaagacatgctgacagtgtggaatagagtctggatcgaggataacccttggatggaggacaagacccccgtgacgacctgggaaaatgttccgtaccttggcaaacgggaggatcagtggtgtgggtccctgattggcctcacaagcagagccacctgggcgcagaacatccctacagctattcagcaagtgcgctctctgatcggaaatgaagagttccttgactatatgcccagcatgaagcggtttagaaaagaggaagagtccgaaggcgccatttggtga

SEQ ID NO: 20778 - RNA, 9873 nt, synthetic construct
  misc_feature 1..9873: note = derived and/or modified CDS sequence (opt5) from DENV-3__FJ639777__SS-prME
  source 1..9873: mol_type = other RNA
accagcctgtgcctcatgatgacgctgcccgccgctcttgccttccacctgacgtcccgggacggcgaacctcggatgatcgtggggaagaatgaacgcggaaagtctctcctgtttaagaccgcgagcggcattaatatgtgtacacttatcgctatggatctgggggaaatgtgcgacgataccgtgacatacaagtgtccgcacattaccgaagttgagcccgaagacatcgattgctggtgtaacctcacatccacctgggtgacgtatggaacctgcaatcaggccggcgagcacagacgggacaagcgctctgtggccctggctcctcatgtcgggatgggactggatacaagaacccagacatggatgagcgccgagggcgcttggagacaggtggaaaaggttgagacctgggccctccgccaccccggcttcacgattctggcgctttttctggcccattacatcgggacatccctcacccagaaggtggtcatcttcattctgcttatgctggtgacaccttctatgaccatgagatgtgttggagtgggcaaccgggactttgtcgaagggctcagcggagctacctgggtggatgtggtcctggagcacggcgggtgcgttacaacgatggccaagaataaacccaccctggacatcgagctccagaagacagaagctacccaactggccacacttcgcaaactgtgtattgagggaaagatcaccaacattacgacagattccagatgccctacccagggcgaagcggtgctcccggaggaacaggaccagaattatgtgtgtaaacacacctacgtcgatcggggctgggggaacggatgcggcctgttcgggaagggaagccttgtgacatgcgccaagtttcaatgtctggagcccatcgagggcaaagttgtgcagtatgaaaatctcaagtacaccgtcattatcacagtgcatacgggggaccagcaccaggttggaaacgagacccaaggcgtgacagctgaaatcacccctcaggcctctacaaccgaggctattctgcccgaatatggcacgctggggctcgagtgctcccctcgcaccggactggacttcaatgagatgatccttctgacaatgaaaaacaaggcctggatggtccatagacagtggtttttcgatctccccctgccgtggaccagcggcgccacaaccgaaacgcctacatggaatcggaaagagcttctggtgacctttaagaacgctcacgcgaaaaagcaagaagtcgtggttctcgggtctcaggagggagccatgcacacagctctgaccggcgccaccgaaattcaaaattccgggggcacaagcatcttcgccggacatctgaagtgtcgcctcaaaatggacaagctggagcttaaaggcatgtcttacgctatgtgcacgaacacctttgtgctgaagaaagaggtctccgaaacacagcacgggaccattctcatcaaggtggagtacaagggagaagatgttccctgtaaaatccctttcagcacagaggacggccaagggaaggcccataacggaagactgattaccgcgaatcccgtggtcacgaaaaaggaggaacccgtgaacatcgaggctgaacctccgttcggcgagtccaatattgtgatcgggattggcgataacgccctgaaaatcaattggtataagaagggatctagcatcggcaaaatgtttgaagccacagctagaggggccagacgcatggctattcttggagacaccgcctgggatttcggctccgttgggggagtcctcaacagcctgggcaagatggtgcaccagatctttgggtctgcgtacaccgccctgttctccggcgtgagctgggtcatgaaaattggaatcggcgtgctcctgacatggattgggcttaattctaagaacaccagcatgtccttttcttgcatcgctattggaatcatcacactgtatctcggcgccgttgtgcaggctgacatggggtgtgtcattaattggaaaggaaaggagctgaagtgcggcagcgggatcttcgtgacgaacgaggttcatacctggacagaacagtacaaatttcaagccgattcccccaagcggctggcgaccgccattgctggcgcctgggagaatggagtgtgtggcatcagaagcacaacccgcatggaaaaccttctctggaaacagattgctaatgagctgaactatatcctgtgggaaaataacatcaagctcacggtcgtggttggggacattatcggagtgctggagcagggcaaacggacccttacacctcagcccatggagctgaagtactcttggaaaacctgggggaaggccaagattgtcgccgctgaaacacaaaactccagcttcatcattgatggacctaatacccccgagtgcccgtctgcgtccagagcctggaacgtgtgggaagtggaggactatggctttggcgtcttcacaaccaatatctggctcaaactgcgcgaagtttacacgcagctgtgtgaccaccggcttatgagcgctgccgtgaaggatgagagagccgtgcacgctgacatggggtactggatcgagtcccagaaaaacggatcttggaagctcgaaaaagccagcctgattgaggtcaagacatgcacctggcctaagtcccataccctgtggtctaatggcgtgctcgaaagcgatatgatcattcccaaatccctggcggggcctatcagccagcacaactatcgccccggataccatacacaaaccgctggcccttggcaccttgggaagctggagctcgactttaattattgcgagggaacgacagttgtgattaccgaaaactgtggcacacggggcccctctctgagaaccacaaccgtctccgggaaactgatccacgagtggtgctgtcgcagctgcacgcttccgcctctccggtacatgggagaagatggctgttggtatgggatggagatcagacccatttctgaaaaggaggagaatatggtgaaatccctggttagcgccggatctggcgaagtggacaacttcaccatgggggtcctgtgcctcgccatcctgtttgaggaagtgatgcggggaaaacttggcaagaaacatatgattgctggcgttttcttcacatttgtgctgctcctgagcgggcagatcacctggcgcgatatggcccacacactgattatgatcggatccaatgcgagcgacagaatgggcatgggggtcacctaccttgctctgattgccacgttcaagatccagccctttctcgccctgggattctttctccggaaactgacatctagagagaaccttctgctcggcgtggggctggctatggccaccacactgcaacttcctgaagatatcgagcagatggctaatggaattgccctgggcctcatggcgctgaagctcatcacccagttcgagacctatcagctgtggacagcccttatttccctgacgtgtagcaacaccatctttacactcaccgtggcttggcgcacagccaccctgattctggctggcgtctcccttctgccggtttgccaatctagctccatgcggaaaacggactggctccccatgacagtggccgccatgggggtgcctcccctgcctctcttcatcttttctctgaaggatacccttaagagacgcagctggcccctgaatgaaggagtcatggctgtgggcctggtttccatcctcgcgtctagcctgcttagaaacgacgtgcctatggccgggcccctggtcgctggaggcctcctgattgcctgttacgtgatcaccgggacatccgccgatctcaccgttgagaaagctgccgacgtgacatgggaagaggaagcggagcagacgggagtcagccataacctgatgattaccgtggacgatgacggcacaatgcggatcaaggatgacgagaccgaaaatattcttacagtcctgctgaaaaccgctctcctgatcgtgtctggcatcttcccgtactccattcctgccacgcttctggtttggcacacctggcagaagcagacacaacgcagcggggtgctctgggatgtcccctctcctcccgagacccagaaagccgaactggaggagggagtgtatagaatcaagcagcagggcatttttgggaaaacacaagttggagtgggcgtccagaaggaaggggtgttccataccatgtggcacgtgacacggggagctgttctcacgtacaacggcaagcgcctggagccgaattgggcctccgtcaaaaaggaccttatcagctatggcgggggatggagactgaacgcgcagtggcaaaaaggcgaagaggtccaggtgattgctgtcgaacctgggaagaatcccaaaaactttcagaccatgcctggaacattccagaccaccacaggcgagatcggggccattgccctggatttcaagcccggaacgtctggctcccccatcatcaatcgggagggcaaggtggttgggctctacggaaacggcgtggtcaccaaaaatgggggatatgtgagcggcattgctcaaacaaacgccgaacctgacgggccgacccccgagctggaagaggaaatgtttaagaaacgcaatcttacaatcatggatctgcaccctggctccggaaagaccagaaaatacctccccgctattgttcgggaggccatcaagcgcagactgcggacgctcattctggcgcctacaagagtggtcgccgctgagatggaagaggcccttaagggcctgcccatccgctatcagaccaccgctacaaaaagcgaacataccgggcgggagatcgtggacctgatgtgccacgccacattcaccatgagactcctgtctcctgttcgcgtgccgaactacaatcttattatcatggatgaagcccattttacggaccccgctagcattgcggcccggggatacatctccacaagagtcggcatgggggaggctgccgccattttcatgaccgctacacctcccggaaccgccgatgcgtttcctcagtctaacgctcccatccaggacgaggaacgcgacatcccggagcggagctggaactccggcaacgaatggattacggatttcgccgggaagaccgtgtggtttgtgccttctatcaaagccggcaacgacattgctaattgtctgagaaagaacggcaaaaaggtcatccaactcagccgcaagacattcgataccgagtatcagaaaacaaagctgaatgactgggattttgttgtgaccacagacatttccgagatgggagccaacttcaaagcggatcgggtgatcgaccccagacggtgcctgaagcccgtcattctcaccgatgggcctgaacgcgtgatccttgccggacccatccctgttacggctgcctctgctgcccagagacggggccgcgtggggagaaatccgcagaaagagaacgaccaatacatttttacaggacagcccctgaataacgatgaagaccacgctcattggaccgaggccaagatgctgctcgacaatatcaacacccctgaaggcattatccccgcgctgttcgagcctgagcgggaaaagagcgccgctattgatggggagtatagacttaaaggcgaatcccgcaagacattcgtcgagctgatgcggagaggagacctccccgtgtggctggcccacaaagttgctagcgaaggcatcaagtacaccgatcgcaaatggtgctttgacgggcagcggaataaccagatcctggaggagaatatggatgtggaaatttggacaaaggagggagagaagaagaagctcagaccgcgctggcttgacgcccggacgtattctgatcctctggccctgaaagagttcaaggactttgctgcgggcagaaaatccatcgccctcgatctggtcaccgaaattgggcgcgtgcccagccaccttgctcatagaacacggaacgccctggacaatctcgtcatgctgcacacctctgagcatggaggcaaggcctaccgccacgctgtggaggaactgcctgagacaatggaaaccctccttctgctgggcctcatgatcctgcttacagggggagccatgctgttcctcatttccggcaaagggatcggaaagaccagcatcggcctgatttgtgttatcgcgtcctctgggatgctgtggatggccgagattcccctccaatggatcgctagcgccattgtgcttgagtttttcatgatggtgctgctgatccctgaacccgagaagcagagaacaccgcaggataaccaactcgcttatgtcgttattggaatcctgacccttgccgcgatcattgccgctaatgaaatgggcctgctcgagacaaccaaacgggacctgggcatgtccaaggaacctggggtggtgagccccacgtcttacctggatgtcgacctccaccccgcctccgcttggacactttacgccgtggctaccacagttatcacccctatgctgcgccataccattgagaacagcacagccaacgtgtctctggcggccatcgctaatcaggccgtcgtgctcatgggactggacaaaggctggccgattagcaagatggatcttggggtccccctgctcgctctgggatgctattcccaggtgaaccctctgacgctcaccgccgccgttcttctgctgatcacacactacgcgatcattggccccgggctccaggctaaagccaccagagaggctcaaaagcggacagccgccggaatcatgaagaatcctaccgtggacggcattatgacgatcgatctggaccccgtcatttatgattctaaatttgaaaagcagcttggccaggtgatgctgctcgttctgtgtgctgtgcagctgctccttatgagaacaagctgggccctgtgcgaggcgctgaccctcgccaccgggcctatcacaaccctgtgggaaggatccccgggcaaattctggaacacaacgatcgctgtctctatggccaatatttttcgcgggagctacatcgctggagccggccttgcgttctccattatgaaaagcgtggggaccggaaaacggggcacaggctctcaaggggagaccctgggagaaaagtggaagaaaaagctcaaccagctgtccagaaaagagtttgacctgtataagaaaagcggcatcacagaggtggatcgcaccgaagccaaggaggggctcaaacggggagaaattacgcatcacgctgtttccagaggctctgccaaacttcagtggttcgtcgagcggaatatggtgacccccgaagggcgcgtgatcgacctgggatgtggcagaggcgggtggagctactattgcgctggactgaagaaagtcacagaggttcggggctacaccaaagggggacctggccatgaggaacccgtgcctatgtccacatacgggtggaacattgtgaaactcatgtctggaaaggatgtcttttatctgcccccggagaaatgtgacacccttctgtgcgatatcggcgaaagctcccctagccccacagtggaggagtctcgcaccatcagagttctcaagatggtggaaccctggctgaagaataaccagttctgtattaaagtcctgaatccttacatgcccacggtgatcgagcacctcgaacggcttcaacgcaagcacggcgggatgctggttagatcccctctgagccggaactctacacatgagatgtattggatttccaatggaaccggcaacatcgtggccagcgtcaatatggtgtctcgcctcctgcttaacagattcaccatgacacaccggagaccgacgattgaaaaagacgtggatctgggggctggaacccgccatgtcaacgccgagcccgagacacctaatatggacgttatcggcgaacggatcaagagaattaaagaggaacacaacagcacctggcactacgacgatgagaatccctataagacatgggcgtaccatgggtcctatgaagtgaaggccaccggatctgctagctccatgatcaacggcgtggtcaaactcctgacaaagccttgggacgtggttcccatggtgacccagatggccatgacggataccacaccgtttggccagcaacgcgtcttcaaagagaaggtggacacccggacacctagaagcatgcccgggacccgccgggttatgggaattacggctgagtggctgtggagaacactcggccgcaataaaaagcctcggctgtgcaccagagaagagtttacaaagaaagtgcgcaccaacgccgccatgggggcggtcttcacggaagagaatcagtgggattccgctaaggccgccgtggaagacgaggatttttggaaacttgttgaccgggagagagaactgcaccgcctcggaaagtgtggctcttgcgtgtacaacatgatggggaaaagagagaagaaactgggcgagttcggaaaggctaagggcagccgggccatctggtacatgtggcttggggctcgctatctggagtttgaggccctcggattcctgaatgaagatcattggttttccagagagaactcttacagcggcgtcgaaggggagggactgcacaaactcggctatattctgcgggacatctccaagatccccgggggcgcgatgtacgccgatgacaccgctggatgggacacaagaattaccgaagatgaccttcataatgaggagaaaatcacacagcagatggatcctgaacaccggcaactggccaacgctattttcaagctcacctatcagaataaagtggtcaaggtgcagcgccccacaccgaccggcacggttatggacatcatttctagaaaggatcagcgggggagcggacaagtgggcacatacgggctgaacacctttaccaatatggaggcccagcttatccgccagatggaaggagagggcgtcctgtccaaagcggacctcgaaaaccctcatctgcccgagaagaaaatcacacagtggctggagaccaagggggtggaaagactcaaacggatggccattagcggcgatgactgcgtggttaagcccatcgatgaccgcttcgctaacgccctgcttgctctgaatgatatgggaaaggtgagaaaagacattcctcaatggcagccgtctaagggctggcatgattggcagcaggtccccttttgttcccaccatttccacgagctcatcatgaaagacgggcggaagctggtggttccttgccgcccccaagacgaacttattggacgggcccggatcagccagggcgctgggtggtctctgcgcgagacagcctgtctcggaaaagcgtatgcccagatgtggtccctgatgtacttccacagacgggatctgcgcctcgctagcaacgccatttgctctgccgtgcctgtccattgggtgcccacgtccagaaccacatggagcatccacgctcatcaccaatggatgaccacagaagacatgctgaccgtctggaatcgggtgtggatcgaggataacccttggatggaggacaagacgcccgttaccacatgggaaaatgtgccgtaccttggcaagagagaggatcagtggtgtgggtccctgattggcctcaccagccgcgccacatgggcgcagaacatccctaccgctattcagcaagtccggtctctgatcggaaatgaagagtttcttgactatatgcccagcatgaaaagattccgcaaggaggaagagtccgaaggcgccatttggtga

SEQ ID NO: 20779 - RNA, 9873 nt, synthetic construct
  misc_feature 1..9873: note = derived and/or modified CDS sequence (opt5) from DENV-3__FJ639778__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaagaattacaaacatcaccacggattcccggtgccctacacagggcgaagcggtgctcccggaggaacaggaccagaattatgtgtgtaagcacacctacgtcgatcgcggctgggggaacggatgcggcctgttcgggaaaggaagccttgtgacctgcgccaagtttcaatgtctggagcccattgagggcaaggttgtgcagtatgaaaatctcaaatacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctagaacgggactggacttcaatgagatgattcttctgaccatgaagaacaaagcctggatggtccatcggcagtggtttttcgatctccccctgccgtggacaagcggcgccaccacagaaacccctacgtggaatcgcaaggagcttctggtgacatttaaaaacgctcacgcgaagaaacaagaagtcgtggttctcgggtctcaggagggagccatgcacaccgctctgacaggcgccaccgaaatccagaattccgggggcaccagcattttcgccggacatctgaagtgtagactcaagatggacaaactggagcttaagggcatgtcttacgctatgtgcacaaacacgtttgtgctgaaaaaggaggtctccgaaacccagcacgggacaatcctcatcaaagtggagtacaagggagaagatgttccctgtaagattcctttcagcaccgaggacggccaagggaaagcccataacggacggctgatcacagcgaatcccgtggtcaccaagaaagaggaacccgtgaacattgaggctgaacctccgttcggcgagtccaatatggtgatcgggattggcgataacgccctgaagatcaattggtataaaaagggatctagcatcggcaagatgtttgaagccacggctagaggggcccgccggatggctattcttggagacacagcctgggatttcggctccgttgggggagtcctcaacagcctgggcaaaatggtgcaccagatctttgggtctgcgtacaccgccctgttctccggcgtgagctgggtcatgaagattggaatcggcgtgctcctgacctggattgggcttaattctaaaaacacaagcatgtccttttcttgcatcgctattggaatcatcaccctgtatctcggcgccgttgtgcaggctgacatggggtgtgtcattaattggaagggaaaagagctgaagtgcggcagcgggatcttcgtgacaaacgaggttcatacgtggaccgaacagtacaagtttcaagccgattcccccaaaagactggcgacagccattgctggcgcctgggagaatggagtgtgtggcatccgcagcaccacacggatggaaaaccttctctggaagcagattgctaatgagctgaactatatcctgtgggaaaataacatcaaactcaccgtcgtggttggggacattatcggagtgctggagcagggcaagagaacgcttacccctcagcccatggagctgaaatactcttggaagacatgggggaaagccaagattgtcaccgccgaaacacaaaactccagcttcatcattgatggacctaatacccccgagtgcccgtctgcttcccgcgcgtggaacgtgtgggaagtggaggactatggctttggcgtcttcacaaccaatatctggctcaagctgcgggaagtttacacgcagctgtgtgaccacagacttatgagcgccgctgtgaaagatgagcgcgccgtgcacgccgacatggggtactggatcgagtcccagaagaacggatcttggaaactcgaaaaggctagcctgattgaggtcaaaacatgcacctggcctaagtcccataccctgtggtctaatggcgtgctcgaaagcgatatgatcattcccaagtccctggccgggcctatcagccagcacaactatcggcccggataccatacacaaaccgcgggcccttggcaccttgggaaactggagctcgactttaattattgcgagggaacgacagttgtgattaccgaaaactgtggcacaagaggcccctctctgcgcaccacaaccgtctccgggaagctgatccacgagtggtgctgtcggagctgcacgcttccgcctctcagatacatgggagaagatggctgttggtatgggatggagatccggcccatttctgaaaaagaggagaatatggtgaagtccctggttagcgctggatctggcgaagtggacaacttcaccatgggggtcctgtgcctcgccatcctgtttgaggaagtgatgcgcggaaaattcggcaagaagcatatgattgccggcgttttctttacattcgtgcttctgctcagcgggcagatcacctggagagatatggctcacacactgattatgatcggatccaatgccagcgaccggatgggcatgggggtcacctacctggcgcttattgctacgtttaaaatccagcccttcctggccctcggatttttcctgagaaagctcacatctcgcgagaacctgcttctgggcgtggggctcgccatggctaccacactgcaactgcctgaagatatcgagcagatggccaatggaattgctcttggcctgatggccctcaaactgatcacccagtttgagacctatcagctctggacagcgctgatttcccttacgtgtagcaacaccatcttcacactgaccgtggcctggcggacagctaccctcattctggccggcgtctccctgcttccggtttgccaatctagctccatgagaaagacggactggctgcccatgacagtggctgccatgggggtgcctcccctccctctgtttatcttctctctcaaagataccctgaagcgcagaagctggccccttaatgaaggagtcatggccgtgggcctggtttccatcctggcttctagcctcctgaagaacgacgtgcctatggcggggccccttgtcgccggaggcctgctcattgcttgttacgtgatcaccgggacatccgccgatctgaccgttgagaaagccgctgacgtgacatgggaagaggaagccgagcagacgggagtcagccataacctcatgattaccgtggacgatgacggcacaatgcggatcaaggatgacgagaccgaaaatattctgacagtccttctgaaaaccgcgctgctcatcgtgtctggcatctttccgtactccattcctgctacgctgcttgtttggcacacctggcagaagcagacacaacgcagcggggtgctgtgggatgtcccctctcctcccgagacccagaaagccgaactcgaggagggagtgtatagaatcaagcagcagggcattttcgggaaaacacaagttggagtgggcgtccagaaggaaggggtgtttcataccatgtggcacgtgacacggggagccgttctgacgtacaacggcaagcgcctcgagccgaattgggcttccgtcaaaaaggacctgatcagctatggcgggggatggagactttctgcccagtggcaaaaaggcgaagaggtgcaggtgattgcggtcgaacctgggaagaaccccaaaaatttccagaccatgcctggaacattccagaccaccacaggcgagatcggggctattgccctggattttaagcccggaacgtccggcagccccatcatcaaccgggagggcaaggtggttgggctgtacggaaatggcgtggtcaccaaaaacgggggatatgtgtccggcattgcccaaacaaatgctgaacctgacgggccgacccccgagctcgaagaggaaatgttcaagaaacgcaacctgacaatcatggatcttcaccctggcagcggaaagaccagaaaatacctgcccgccattgttcgggaggctatcaagcgcagactccggacgctgattctcgcccctacaagagtggtcgcggccgagatggaagaggctctgaagggccttcccatccgctatcagaccaccgccacaaaatctgaacataccgggcgggagatcgtggacctgatgtgccacgctacatttaccatgagactgctcagccctgttcgcgtgccgaattacaacctgattatcatggatgaagcccatttcacggaccccgcctccattgctgcgcggggatacatctctacaagagtcggcatgggggaggccgctgccatttttatgaccgccacacctcccggaaccgctgatgccttccctcagagcaatgcgcccatccaggacgaggaacgcgacatcccggagcggtcctggaactctggcaatgaatggattacggattttgctgggaagaccgtgtggttcgtgcctagcatcaaagccggcaacgacattgccaactgtcttagaaagaatggaaaaaaggtcatccaactgtcccgcaagacatttgataccgagtatcagaaaacaaagctcaacgactgggatttcgttgtgaccacagacatttctgagatgggcgctaattttaaagccgatcgggtgatcgaccccagacggtgcctgaagcccgtcattctgaccgatgggcctgaacgcgtgatcctcgcgggacccatgcctgttacggccgctagcgccgctcagagacggggccgcgtggggagaaacccgcagaaagagaatgaccaatacatcttcacaggacagccccttaacaatgatgaagaccacgcccattggaccgaggctaagatgctgctggacaacattaatacccctgaaggcatcattcccgccctcttcgagcctgagcgggaaaagtccgcggccatcgatggggagtatagactgaaaggcgaaagccgcaagacatttgtcgagcttatgcggagaggagacctgcccgtgtggctcgctcacaaagttgcctctgaaggcattaagtacaccgatcgcaaatggtgcttcgacgggcagcggaacaatcagatcctggaggagaacatggatgtggaaatctggacaaaggagggagaaaaaaagaagctgagaccgcgctggctcgacgctcggacgtattccgatcctcttgccctgaaagagtttaaggacttcgccgctggcagaaaaagcattgcgctggatctcgtcaccgaaatcgggcgcgtgcccacacacctggcccatagaacccggaatgctcttgacaacctggtcatgctccacacatctgagcatggaggcaaggcctaccgccacgccgtggaggaactgcctgagaccatggaaacgctgctccttctgggcctgatgattctcctgaccgggggagctatgctttttctgatctccggcaaagggattggaaagacaagcatcggcctcatctgtgttattgcctcctctgggatgctgtggatggcggagatccccctgcaatggattgccagcgctatcgtgctcgagttctttatgatggtgcttctgattcctgaacccgagaagcagagaaccccgcaggataatcaactggcctatgtcgttatcggaattctcacactggctgccatcatcgcggccaacgaaatgggccttctggagaccacgaaacgggacctcggcatgtccaaggaacctggggtggtgagccccacatcttacctggatgtcgacctgcaccccgcttccgcctggaccctctacgctgtggccacaaccgttattacccctatgcttcgccatacaatcgagaatagcacggctaacgtgtctctggccgcgattgccaaccaggctgtcgtgctgatgggactcgacaaaggctggccgatcagcaagatggatctgggggtcccccttctggccctcggatgctattcccaggtgaatcctctgaccctgacagctgccgttctccttctgattacccactacgccatcatcggccccgggctgcaggcgaaagctacaagagaggcccaaaagcggaccgctgccggaattatgaagaaccctacggtggacggcatcatgacaattgatctcgaccccgtcatctatgattctaaattcgaaaagcagctgggccaggtgatgcttctggttctctgtgccgtgcagctgctgctcatgagaaccagctgggctctttgcgaggccctgaccctggcgacagggcctattaccacactctgggaaggatccccgggcaaattttggaatacgaccatcgccgtctctatggctaacatcttccgcgggagctacctggccggagctggccttgccttttccattatgaagagcgtggggacaggaaaacggggcaccggctctcaaggggagacactgggagaaaagtggaagaaaaagctcaatcagctgtccagaaaagagttcgacctgtataagaaaagcggcatcaccgaggtggatcgcacggaagcgaaggaggggctccggagaggagaaattacccatcacgccgtttcccggggctctgctaaacttcagtggtttgtcgagcgcaacatggtgatccccgaagggagagtgattgacctgggatgtggccggggcgggtggagctactattgcgccggactgaagaaggtcacagaggttcgcggctacaccaaagggggacctggccatgaggaacccgtgcctatgtccacatacgggtggaatatcgtgaagctcatgtctggaaaagatgtcttctatctgcccccggagaagtgtgacacccttctgtgcgatattggcgaaagctcccctagccccacagtggaggagtctagaaccatccgggttctcaaaatggtggaaccctggctgaagaacaatcagttctgtatcaaggtcctgaacccttacatgcccacggtgattgagcacctcgaacgccttcaaagaaaacacggcgggatgctggttcggaatcctctgtcccgcaacagcacacatgagatgtattggatctctaatggaaccggcaacattgtggcttccgtcaatatggtgagcagactcctgcttaaccggtttaccatgacacacagacgcccgacgatcgaaaaggacgtggatctgggggccggaacccggcatgtcaacgctgagcccgagacacctaatatggacgttattggcgaaagaatcaaacgcatcaaggaggaacacaactctacctggcactacgacgatgagaatccctataaaacatgggcctaccatgggagctatgaagtgaaggcgaccggatccgcctctagcatgattaacggcgtggtcaagctcctgacaaaaccttgggacgtggttcccatggtgacccagatggctatgacggataccacaccgttcggccagcaacgggtctttaaggagaaagtggacaccagaacacctcgctccatgcccgggacccggagagttatgggaatcacggccgagtggctgtggcgcacactcggccggaataagaaacctagactgtgcacccgcgaagagttcacaaagaaggtgcggaccaacgctgccatgggggccgtctttacggaagagaatcagtgggatagcgcgaaagctgccgtggaagacgaggatttctggaagcttgttgacagagagcgcgaactgcacaaactcggaaagtgtggctcctgcgtgtacaacatgatggggaaaagagagaagaaactgggcgaatttggaaaggccaagggctctcgggctatttggtacatgtggcttggggcccgctatctggagttcgaggctctcggatttctgaatgaagatcattggttcagcagagagaactcctactctggcgtcgaaggggagggactgcacaaactcggctatatcctgcgggacattagcaagatccccgggggcgccatgtacgcggatgacaccgccggatgggacacaagaatcaccgaagatgaccttcataatgaggagaaaattacacagcagatggatcctgaacaccggcaactggctaacgccatctttaagctcacctatcagaataaagtggtcaaggtgcagcgccccacaccgaccggcacggttatggacattatctccagaaaggatcagcgggggtctggacaagtgggcacatacgggctgaacaccttcaccaatatggaggctcagcttattcgccagatggaaggagagggcgtcctgagcaaagccgacctcgaaaaccctcacctgcccgagaagaaaatcacacagtggctggagaccaagggggtggaaagactcaaacggatggcgatctccggcgatgactgcgtggttaagcccattgatgaccgctttgccaacgctctgcttgccctgaatgatatgggaaaggtgagaaaagacatccctcaatggcagccgagcaagggctggcatgattggcagcaggtccccttctgttctcaccatttccacgagctcattatgaaagacgggcggaagctggtggttccttgccgcccccaagacgaacttatcggaagagctcggatttcccagggcgccgggtggagcctgcgcgagacagcttgtctcggaaaagcctatgcgcagatgtggtctctgatgtactttcacagacgggatctgcgcctcgcctccaacgctatctgcagcgccgtgcctgtccattgggtgcccacgtctagaaccacatggtccattcacgcccatcaccaatggatgaccacagaagacatgctgaccgtctggaatcgggtgtggatcgaggataacccttggatggaggacaagacgcccgttaccacatgggaaaatgtgccgtaccttggcaagagagaggatcagtggtgtgggagcctgatcggcctcacctcccgcgctacatgggcccagaacattcctaccgcgatccagcaagtccggagcctgattggaaatgaagagttccttgactatatgccctctatgaaaagatttcgcaaggaggaagagagcgaaggcgctatctggtga

SEQ ID NO: 20780 - RNA, 9873 nt, synthetic construct
  misc_feature 1..9873: note = derived and/or modified CDS sequence (opt5) from DENV-3__FJ639779__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccagaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaaagaaaggcccataacgggcggctgatcacagcgaatcccgtggtcaccaaaaaggaggaacccgtgaacattgaggctgaacctccgttcggagagtccaatatcgtgattggcatcggggataacgccctgaaaatcaattggtataagaagggctctagcattggaaaaatgtttgaagccacggctagaggcgcccgccggatggctatccttggggacacagcctgggatttcggatccgttggcggggtcctcaacagcctgggaaagatggtgcaccagatttttggctctgcgtacaccgccctgttctccggggtgagctgggtcatgaaaatcggcattggagtgctcctgacctggatcggccttaattctaagaacacaagcatgtccttttcttgcattgctatcgggatcattaccctgtatctcggagccgttgtgcaggctgacatgggctgtgtcatcaattggaaagggaaggagctgaagtgcggaagcggcattttcgtgacaaacgaggttcatacgtggaccgaacagtacaaatttcaagccgattcccccaagagactggcgacagccatcgctggggcctgggagaatggcgtgtgtggaattcgcagcaccacacggatggaaaaccttctctggaaacagatcgctaatgagctgaactatatcctgtgggaaaataacattaagctcaccgtcgtggttggcgacatcattggggtgctggagcagggaaaaagaacgcttacccctcagcccatggagctgaagtactcttggaaaacatggggcaaggccaagatcgtcaccgccgaaacacaaaactccagcttcattatcgatgggcctaatacccccgagtgcccgtctgcttcccgcgcgtggaacgtgtgggaagtggaggactatggatttggcgtcttcacaaccaatatctggctcaaactgcgggaagtttacacgcagctgtgtgaccacagacttatgagcgccgctgtgaaggatgagcgcgccgtgcacgccgacatgggctactggattgagtcccagaaaaacgggtcttggaagctcgaaaaagctagcctgatcgaggtcaagacatgcacctggcctaagtcccataccctgtggtctaatggagtgctcgaaagcgatatgattatccccaaatccctggccggccctattagccagcacaactatcggcccgggtaccatacacaaaccgcgggaccttggcaccttggcaagctggagctcgactttaattattgcgaggggacgacagttgtgatcaccgaaaactgtggaacaagaggcccctctctgcgcaccacaaccgtctccggcaaactgatccacgagtggtgctgtcggagctgcacgcttccgcctctcagatacatgggggaagatggatgttggtatggcatggagattcggcccatctctgaaaaggaggagaatatggtgaaatccctggttagcgctgggtctggagaagtggacaacttcaccatgggcgtcctgtgcctcgccattctgtttgaggaagtgatgcgcgggaagttcggaaagaaacatatgatcgccggcgttttctttacattcgtgcttctgctcagcggccagattacctggagagatatggctcacacactgatcatgattgggtccaatgccagcgaccggatgggaatgggcgtcacctacctggcgcttatcgctacgtttaagatccagcccttcctggccctcgggtttttcctgagaaaactcacatctcgcgagaacctgcttctgggagtgggcctcgccatggctaccacactgcaactgcctgaagattttgagcagatggccaatgggattgctcttggactgatggccctcaagctgatcacccagttcgagacctatcagctctggacagcgctgatttcccttacgtgtagcaacaccatctttacactgaccgtggcctggcggacagctaccctcattctggccggcgtctccctgcttccggtttgccaatctagctccatgagaaaaacggactggctgcccatgacagtggctgccatgggcgtgcctcccctccctctgttcatcttttctctcaaggataccctgaagcgcagaagctggccccttaatgaaggggtcatggccgtgggactggtttccatcctggcttctagcctcctgcggaacgacgtgcctatggcgggcccccttgtcgccgggggactgctcattgcttgttacgtgatcaccggcacatccgccgatctgaccgttgagaaagccgctgacgtgacatgggaagaggaagccgagcagacgggggtcagccataacctcatgattaccgtggacgatgacggaacaatgcgcatcaaggatgacgagaccgaaaatattctgacagtccttctgaaaaccgcgctgctcatcgtgtctggcatcttcccgtactccattcctgctacgctgcttgtttggcacacctggcagaagcagacacaaagaagcggcgtgctgtgggatgtcccctctcctcccgagacccagaaagccgaactcgaggagggggtgtatcggatcaagcagcagggaatttttggcaaaacacaagttggggtgggagtccagaaggaaggcgtgttccataccatgtggcacgtgacacgcggggccgttctgacgtacaacggaaagagactcgagccgaattgggcttccgtcaaaaaggacctgatcagctatggcggcgggtggcggctttctgcccagtggcaaaaaggagaagaggtgcaggtgattgcggtcgaacctggcaagaaccccaaaaatttccagaccatgcctgggacatttcagaccaccacaggagagatcggcgctattgccctggatttcaagcccgggacgtccggaagccccatcatcaaccgcgagggcaaggtggttggcctgtacgggaatggagtggtcaccaaaaacggcgggtatgtgtccggaattgcccaaacaaatgctgaacctgacggcccggcccccgagctcgaagaggaaatgtttaagaaaagaaacctgaccatcatggatcttcaccctgggagcggcaagacacggaaatacctgcccgctattgttcgcgaggccatcaagagacggctcagaaccctgattctcgcgcctacgcgcgtggtcgccgctgagatggaagaggccctgaagggacttcccatccggtatcagacaaccgctaccaaatctgaacatacaggcagagagatcgtggacctgatgtgccacgccaccttcacaatgcgcctgctcagccctgttcgggtgccgaattacaacctgattatcatggatgaagcccattttaccgaccccgcttccattgcggccagagggtacatctctacgcgcgtcggaatgggcgaggctgccgccattttcatgacagctacccctcccgggacagccgatgcgtttcctcagagcaatgctcccatccaggacgaggaacgggacatcccggagagatcctggaactctggaaatgaatggattaccgatttcgccggcaagacggtgtggtttgtgcctagcatcaaagccgggaacgacattgctaactgtcttcgcaagaatggcaaaaaggtcatccaactgtcccggaagaccttcgatacagagtatcagaaaaccaagctcaacgactgggattttgttgtgacaaccgacatttctgagatgggagccaatttcaaagcggatagagtgatcgacccccggcgctgcctgaagcccgtcattctgacagatggccctgaaagagtgatcctcgccgggcccatgcctgttaccgctgccagcgctgcccagcggcgcggaagagtgggccggaacccgcagaaagagaatgaccaatacatcttcacggggcagccccttaacaatgatgaagaccacgctcattggacagaggccaagatgctgctggacaacattaatacccctgaaggaatcattcccgcgctctttgagcctgagagagaaaagtccgccgctatcgatggcgagtatcgcctgaaaggggaaagccggaagaccttcgtcgagcttatgagacgcggcgacctgcccgtgtggctcgcccacaaagttgcttctgaaggaattaagtacacagatcggaaatggtgctttgacggccagagaaacaatcagatcctggaggagaacatggatgtggaaatctggaccaaggagggggaaaaaaagaagctgcgcccgcggtggctcgacgccagaacatattccgatcctcttgccctgaaagagttcaaggactttgctgcgggacgcaaaagcattgccctggatctcgtcacggaaatcggcagagtgcccacccacctggctcatcggacacgcaatgcccttgacaacctggtcatgctccacacctctgagcatgggggaaaggcctacagacacgctgtggaggaactgcctgagacaatggaaaccctgctccttctgggcctgatgattctcctgacgggcggggccatgcttttcctgatctccggaaaaggcattgggaagaccagcatcggactcatctgtgttattgcgtcctctggcatgctgtggatggccgagatccccctgcaatggattgctagcgccatcgtgctcgagtttttcatgatggtgcttctgattcctgaacccgagaagcagcggacaccgcaggataatcaactggcttatgtcgttatcgggattctcaccctggccgcgatcatcgccgctaacgaaatgggacttctggagacaaccaaacgcgacctcggcatgtccaaggaacctggcgtggtgagccccacgtcttacctggatgtcgacctgcaccccgcctccgcttggacactctacgccgtggctaccacagttattacccctatgcttagacataccatcgagaatagcacagccaacgtgtctctggcggccattgctaaccaggccgtcgtgctgatggggctcgacaaaggatggccgatcagcaagatggatctgggcgtcccccttctggctctcgggtgctattcccaggtgaatcctctgacgctgaccgccgccgttctccttctgattacacactacgcgatcatcggacccggcctgcaggctaaagccacccgggaggctcaaaagagaacagccgccgggattatgaagaaccctaccgtggacggaatcatgacgattgatctcgaccccgtcatctatgattctaaatttgaaaagcagctgggccaggtgatgcttctggttctctgtgctgtgcagctgctgctcatgcgcacaagctgggccctttgcgaggcgctgaccctggccaccggccctattacaaccctctgggaagggtccccgggaaaattctggaatacaacgatcgctgtctctatggccaacatctttcggggcagctacctggctggggccggacttgcgttctccattatgaagagcgtgggcaccgggaaaagaggaacaggctctcaaggcgagaccctgggggaaaagtggaagaaaaagctcaatcagctgtcccgcaaagagtttgacctgtataagaaaagcggaatcacagaggtggatcggaccgaagccaaggagggcctcaaaagaggggaaattacgcatcacgctgtttcccggggatctgccaagcttcagtggttcgtcgagcgcaacatggtgatccccgaaggcagagtgattgacctggggtgtggacggggcggctggagctactattgcgctgggctgaagaaagtcaccgaggttcgcggatacacaaagggcgggcctggacatgaggaacccgtgcctatgtccacctacggctggaatatcgtgaaactcatgtctgggaaggatgtcttctatctgcccccggagaaatgtgacacacttctgtgcgatattggagaaagctcccctagccccaccgtggaggagtctagaacaatccgggttctcaagatggtggaaccctggctgaagaacaatcagttttgtatcaaagtcctgaacccttacatgcccaccgtgattgagcacctcgaacgccttcaaagaaagcacggcggcatgctggttcggaatcctctgtcccgcaacagcacgcatgagatgtattggatctctaatgggacaggaaacattgtggcctccgtcaatatggtgagcagactcctgcttaaccggttcaccatgacccacagacgcccgacaatcgaaaaagacgtggatctgggcgctgggacgcggcatgtcaacgccgagcccgagacccctaatatggacgttattggagaaagaatcaagcgcatcaaagaggaacacaactctacatggcactacgacgatgagaatccctataagacctgggcgtaccatggcagctatgaagtgaaggccacagggtccgcttctagcatgattaacggagtggtcaaactcctgaccaagccttgggacgtggttcccatggtgacacagatggccatgaccgatacgaccccgtttggccagcaacgggtcttcaaagagaaggtggacacaagaacccctcgctccatgcccggcacacggagagttatggggatcaccgctgagtggctgtggcgcacgctcggacggaataaaaagcctagactgtgcacacgcgaagagtttaccaagaaagtgcggacaaacgccgccatgggcgcggtcttcaccgaagagaatcagtgggatagcgctaaggccgccgtggaagacgaggatttttggaaacttgttgacagagagcgcgaactgcacaagctcgggaaatgtggatcctgcgtgtacaacatgatgggcaagagagagaaaaagctgggggaattcggcaaggctaaaggatctcgggccatttggtacatgtggcttggcgctcgctatctggagtttgaggccctcgggttcctgaatgaagatcattggtttagcagagagaactcctactctggagtcgaaggcgaggggctgcacaagctcggatatatcctgcgggacattagcaaaatccccggcggggcgatgtacgccgatgacacggctggctgggacaccagaatcacagaagatgaccttcataatgaggagaagattacccagcagatggatcctgaacaccggcaactggccaacgctatcttcaaactcacatatcagaataaggtggtcaaggtgcagcgccccaccccgacaggaaccgttatggacattatctccagaaaagatcagcggggctctgggcaagtgggaacgtacggcctgaacacatttaccaatatggaggcccagcttattcgccagatggaaggggagggagtcctgagcaaggcggacctcgaaaaccctcacctgcccgagaaaaagatcacccagtggctggagacaaaaggcgtggaaagactcaagcggatggccatctccggggatgactgcgtggttaagcccattgatgaccgcttcgctaacgccctgcttgctctgaatgatatgggcaaagtgagaaaggacatccctcaatggcagccgagcaaaggatggcatgattggcagcaggtccccttctgttctcaccattttcacgagctcattatgaaggacggccggaaactggtggttccttgccgcccccaagacgaacttatcgggagagcccggatttcccagggagctggctggagcctgcgcgagaccgcctgtctcgggaaggcgtatgcccagatgtggtctctgatgtacttccacagacgggatctgcgcctcgcttccaacgccatctgcagcgccgtgcctgtccattgggtgcccacatctagaacgacctggtccattcacgctcatcaccaatggatgacaaccgaagacatgctgacagtctggaatcgggtgtggatcgaggataacccttggatggaggacaagacccccgttacgacctgggaaaatgtgccgtaccttggaaaaagagaggatcagtggtgtggcagcctgatcgggctcacatcccgcgccacctgggcgcagaacattcctacagctatccagcaagtccggagcctgattggcaatgaagagtttcttgactatatgcccgccatgaagagattccgcaaagaggaagagtctgaaggagccatctggtga

SEQ ID NO: 20781 - RNA, 9873 nt, synthetic construct
  misc_feature 1..9873: note = derived and/or modified CDS sequence (opt5) from DENV-3__FJ639780__SS-prME
  source 1..9873: mol_type = other RNA
acaagcctgtgcctcatgatgatcctgcccgccgctcttgccttccacctgacatccagagacggagagcctcggatgattgtggggaagaatgaaagaggaaaatctctcctgtttaagacggcgagcggcatcaatatgtgtacccttattgctatggatctgggggagatgtgcgacgatacagtcacctacaaatgtccgcacatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacagacctggatgagcgccgagggcgcttggcggcaagtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcaccacaaccgaaacgcctacatggaatcggaaagagcttctggtgacctttaagaacgcccacgctaaaaagcaagaagtcgtggttctcgggtctcaggagggagcgatgcacacagccctgaccggcgctaccgaaatccaaaattccgggggcacaagcattttcgccggacatctgaagtgtcgcctcaaaatggacaagctggagcttaaaggcatgtcttacgccatgtgcacgaacacctttgtgctgaagaaagaggtctccgaaacacagcacgggaccatcctcatcaaggtggagtacaagggagaagatgttccctgtaaaattcctttcagcacagaggacggccaagggaaggctcataacggaagactgatcaccgccaatcccgtggtcacgaaaaaggaggaacccgtgaacattgaggcggaacctccgttcggcgagtccaatatcgtgattgggatcggcgataacgctctgaaaatcaattggtataagaagggatctagcattggcaaaatgtttgaagccacagccagaggggctagacgcatggccatccttggagacaccgcttgggatttcggctccgttgggggagtcctcaacagcctgggcaagatggtgcaccagatttttgggtctgcctacaccgcgctgttctccggcgtgagctgggtcatgaaaatcggaattggcgtgctcctgacatggatcgggcttaattctaagaacaccagcatgtccttttcttgcattgccatcggaatcattacactgtatctcggcgctgttgtgcaggccgacatggggtgtgtcatcaattggaaaggaaaggagctgaagtgcggcagcgggattttcgtgacgaacgaggttcatacctggacagaacagtacaaatttcaagctgattcccccaagcggctggccaccgcgatcgccggcgcttgggagaatggagtgtgtggcattagaagcacaacccgcatggaaaaccttctctggaaacagatcgccaatgagctgaactatatcctgtgggaaaataacattaagctcacggtcgtggttggggacatcattggagtgctggagcagggcaaacggacccttacacctcagcccatggagctgaagtactcttggaaaacctgggggaaggctaagatcgtcacagccgaaacccaaaactccagcttcattatcgatggacctaatacacccgagtgcccgaacgcctctagagcttggaatgtgtgggaagtggaggactatggctttggcgtcttcaccacgaacatctggctcaaactgcgcgaagtttacacacagctgtgtgaccaccggcttatgtccgcggccgtgaaggatgagagagctgtgcacgccgacatggggtactggattgagagccagaaaaatggatcctggaagctcgaaaaagcctctctgatcgaggtcaagacctgcacctggcctaagagccatacactgtggtccaacggcgtgctcgaatctgatatgattatccccaaaagcctggctgggcctatttcccagcacaattatcgccccggataccatacccaaacggccggcccttggcaccttgggaagctggagctcgactttaactattgcgagggaacaaccgttgtgatcacagaaaattgtggcacccggggccccagcctgagaacaaccacggtctctgggaaactgatccacgagtggtgctgtcgctcctgcacccttccgcctctccggtacatgggagaagatggctgttggtatgggatggagattagacccatcagcgaaaaggaggagaacatggtgaaatctctggtttccgcgggaagcggcgaagtggacaatttcacaatgggggtcctgtgcctcgctattctgtttgaggaagtgatgcggggaaagttcggcaagaaacatatgatcgccggcgttttctttaccttcgtgcttctgctctctgggcagattacatggcgcgatatggcccacaccctgatcatgattggaagcaacgcttccgacagaatgggcatgggggtcacgtacctggcccttatcgcgacatttaagatccagcccttcctggctctcggatttttcctgcggaaactcaccagcagagagaatctgcttctgggcgtggggctcgccatggccacaaccctgcaactgcctgaagatattgagcagatggctaacggaatcgcccttggcctgatggctctcaagctgattacccagtttgagacatatcagctctggacggccctgatctctcttacctgttccaatacaattttcaccctgacagtggcgtggcgcaccgccacgctcatcctggctggcgtcagcctgcttccggtttgccaatcctctagcatgcggaaaacagactggctgcccatgaccgtggccgctatggggatccctcccctccctctgtttattttctccctcaaggataccctgaagagacgctcttggccccttaacgaaggagtgatggccgtcggcctggtgagcatcctggcctcctctctcctgagaaacgacgttcctatggctgggccccttgtggcgggaggcctgctcattgcctgttacgtcatcacagggaccagcgctgatctgacagtggagaaagccgccgacgttacgtgggaagaggaagctgagcagaccggagtgtcccataatctcatgattacagtcgacgatgacggcaccatgcggatcaaggatgacgagacagaaaacatcctgaccgtgcttctgaaaacggccctgctcattgtcagcggcatctttccgtactctattcctgcgaccctgcttgtgtggcacacatggcagaagcagacccaacgctccggggttctgtgggatgtgcccagccctcccgagacacagaaagctgaactcgaggagggagtctatagaatcaagcagcagggcattttcgggaaaacccaagtgggagttggcgtgcagaaggaaggggtctttcatacaatgtggcacgtgacgcggggagccgtgctgacctacaatggcaagcgcctcgagccgaactgggcctctgttaaaaaggacctgatctcctatggcgggggatggagacttagcgctcagtggcaaaaaggcgaagaggtccaggtgattgccgtggaacctgggaagaatcccaaaaacttccagacaatgcctggaaccttccagaccacaacgggcgagatcggggcgatcgctctggattttaagcccggaacctctggctcccccattatcaatcgggagggcaaggtcgtggggctgtacggaaacggcgttgtgaccaagaatgggggatatgtcagcggcattgcccaaaccaacgccgaacctgacgggccgacacccgagctcgaagaggaaatgttcaagaaacgcaatctgaccatcatggatcttcaccctggctccggaaagacgagaaaatacctgcccgctattgtgcgggaggccatcaagcgcagactccggacactgatcctcgctcctaccagagttgtggccgcggagatggaagaggccctgaagggccttcccattcgctatcagaccacagctaccaaaagcgaacatacagggcgggagatcgtcgacctgatgtgccacgccacctttacgatgagactgctctctcctgtgcgcgttccgaactacaatctgattatcatggatgaagctcatttcacagaccccgccagcattgccgctcggggatacatctccaccagagtgggcatgggggaggcggccgctatctttatgacagccacccctcccggaacggccgatgctttccctcagtctaacgcccccattcaggacgaggaacgcgacatcccggagcggagctggaactccggcaacgaatggattaccgattttgcggggaagacagtctggttcgtgccttctatcaaagctggcaacgacattgccaattgtcttagaaagaacggcaaaaaggtgatccaactgagccgcaagacctttgatacagagtatcagaaaaccaagctcaatgactgggatttcgtcgttacaaccgacatttccgagatgggagccaactttaaagctgatcgggtgatcgaccccagacggtgcctgaagcccgtgatcctgacggatgggcctgaacgcgtcattctcgccggacccatgcctgtgacagcggcctctgctgcccagagacggggccgcgttgggagaaatccgcagaaagagaacgaccaatacatcttcaccggacagccccttaataacgatgaagaccacgctcattggaccgaggccaagatgctgctggacaatattaacacacctgaaggcatcattcccgctctcttcgagcctgagcgggaaaagagcgccgcgatcgatggggagtatagactgaaaggcgaatcccgcaagacctttgtggagcttatgcggagaggagacctgcccgtctggctcgcccacaaagtggctagcgaaggcatcaagtacacagatcgcaaatggtgcttcgacgggcagcggaataaccagattctggaggagaatatggatgttgaaatctggacgaaggagggagaacgcaagaaactgcgcccgcggtggctcgacgccagaacctattctgatcctcttgctctgaaagagtttaaagacttcgccgccggccgcaagtccattgctctggatctcgtgacagaaatcgggagagtccccacccacctggcgcatcggacacgcaacgcccttgacaatctggtgatgctccacaccagcgagcatggaggcaaggcttacagacacgccgtcgaggaactgcctgagacgatggaaaccctgctccttctgggcctgatgattctcctgacagggggagccatgctttttctgatctctggcaaggggatcggaaaaacctccattggcctcatctgtgtgattgctagctccgggatgctgtggatggccgagatccccctgcaatggattgcgtctgccatcgttctcgagttctttatgatggtgcttctgattcctgaacccgagaagcagcggacaccgcaggataaccaactggcttatgtggtcatcggaatcctcaccctggccgctattatcgccgcgaatgaaatgggccttctggagacgacaaagcgcgacctcggcatgagcaaagaacctggggttgtgtcccccaccagctacctggatgtggacctgcaccccgcctctgcttggacactctacgccgtcgctaccaccgtgattacacctatgcttagacatacgatcgagaactccaccgccaacgttagcctggctgccattgcgaatcaggccgtggtcctgatgggactcgacaagggctggccgatctctaaaatggatctgggggtgccccttctggctctcggatgctatagccaggtcaaccctctgacactgaccgccgctgtgctccttctgatcacacactacgccattatcggccccgggctgcaggccaaggcgacccgggaggctcagaaacggacggccgctggaattatgaagaatcctacagttgacggcatcatgaccattgatctcgaccccgtgatctatgattccaagttcgaaaaacagctgggccaggtcatgcttctggtgctctgtgccgttcagctgctgctcatgcgcacctcttgggccctttgcgaggctctgacactggccaccgggcctatcacaacgctctgggaaggaagcccgggcaagttttggaacaccacaattgcggtgtccatggccaatatcttccgggggtcttacctggctggagccggccttgcttttagcattatgaaatccgtcgggaccggaaagagaggcacaggcagccaaggggagaccctgggagaaaaatggaagaagaaactcaaccagctgtctcgcaaggagttcgacctgtataaaaagtccggcatcacggaggtggatcggaccgaagccaaagaggggctcaagagaggagaaattacacatcacgcggtgagccggggctccgccaaacttcagtggtttgttgagcgcaatatggtcatccccgaagggagagtgattgacctgggatgtggccggggcgggtggtcttactattgcgctggactgaagaaggtgaccgaggtccgcggctacacaaaagggggacctggccatgaggaacccgttcctatgagcacctacgggtggaacatcgtgaagctcatgtccggaaaagatgtgttctatctgcccccggagaagtgtgacacacttctgtgcgatatcggcgaatctagcccttcccccaccgtcgaggagagcagaacgattcgggtgctcaaaatggttgaaccctggctgaagaataaccagttctgtatcaaggtgctgaatccttacatgcccgccgtcattgagcacctcgaacgccttcaaagaaaacacggcgggatgctggtgcggaaccctctgtctcgcaattccacacatgagatgtattggatcagcaacggaaccggcaatattgttgcttctgtgaacatggtctccagactcctgcttaaccggtttaccatgacacacagacgcccgacgatcgaaaaggacgtggatctgggggccggaacccggcatgtgaatgctgagcccgagacacctaacatggacgtcatcggcgaaagaattaaacgcatcaaggaggaacacaatagcacctggcactacgacgatgagaacccctataaaacatgggcctaccatgggtcttatgaagttaaggcgaccggaagcgcctcctctatgattaatggcgtggtgaagctcctgacaaaaccttgggacgtcgtgcccatggttacccagatggctatgacggataccacaccgttcggccagcaacgggtgtttaaggagaaagtcgacaccagaacacctcgcagcatgcccgggacccggagagtgatgggaatcacggccgagtggctgtggcgcacactcggccggaacaagaaacctagactgtgcacccgcgaagagttcacaaagaaggttcggaccaatgctgccatgggggccgtgtttacggaagagaaccagtgggattccgcgaaagctgccgtcgaagacgaggatttctggaaacttgtggacagagagcgcgaactgcacaaactcggaaagtgtggcagctgcgtttacaatatgatggggaaaagagagaagaaactgggcgaatttggaaaggccaagggctcccgggctatttggtacatgtggcttggggcccgctatctggagttcgaggctctcggatttctgaacgaagatcattggttctctagagagaatagctactccggcgtggaaggggagggactgcacaaactcggctatatcctgcgggacatctctaagattcccgggggcgccatgtacgcggatgacaccgccggatgggacacaagaatcaccgaagatgaccttcataacgaggagaaaattacacagcagatggatcctgaacaccggcaactggctaatgccatctttaagctcacctatcagaacaaagtcgtgaaggtccagcgccccacaccgaccggcacggtgatggacattatcagcagaaaggatcagcgggggtccggacaagttggcacatacgggctgaataccttcaccaacatggaggctcagcttatccgccagatggaaggagagggcgtgctgtctaaagccgacctcgaaaaccctcatctgcccgagaagaaaattacacagtggctggagaccaagggggtcgaaagactcaaacggatggcgatcagcggcgatgactgcgtggtgaagcccattgatgaccgctttgccaatgctctgcttgccctgaacgatatgggaaaggttagaaaagacatccctcaatggcagccgtccaagggctggcatgattggcaacaggtgcccttctgtagccaccatttccacgagctcattatgaaagacgggcggaagctggtcgtgccttgccgcccccaagacgaacttatcggcagagctcggatttctcagggcgccgggtggtccctgcgcgagacagcttgtctcggaaaagcctatgcgcagatgtggagcctgatgtactttcacagacgggatctgcgcctcgcctctaatgctatctgctccgccgttcctgtgcattgggtccccacgagcagaaccacatggtctatccacgcccatcaccaatggatgaccacagaagacatgctgaccgtgtggaaccgggtctggattgaggataatccttggatggaggacaagacgcccgtgaccacatgggaaaacgttccgtaccttggcaagagagaggatcagtggtgtgggtccctgatcggcctcaccagccgcgctacatgggcccagaatattcctaccgcgatccagcaagtgcggtccctgattggaaacgaagagttccttgactatatgcccagcatgaaaagatttcgcaaggaggaagagtctgaaggcgctatctggtga

SEQ ID NO: 20782 - RNA, 9873 nt, synthetic construct
  misc_feature 1..9873: note = derived and/or modified CDS sequence (opt5) from DENV-3__FJ639781__SS-prME
  source 1..9873: mol_type = other RNA
accagcctgtgcctcatgatgatcctgcccgcggctcttgccttccacctgacatcccgggacggcgagcctcggatgattgtggggaagaacgaacgcggaaagtctctcctgtttaagacggcgagcggcatcaatatgtgtacccttattgctatggatctgggggaaatgtgcgacgatacagtcacctacaagtgtccgcacatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccagtacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcatggcgggtgcgttaccacaatggccaagaataaacccacgctggacattgagctccaaaagaccgaagctacacagctggccacccttcgcaaactgtgtatcgagggaaagattacaaacatcaccacggattccagatgccctacacagggcgaagcggtgctcccggaggaacaggaccaaaattatgtgtgtaaacacacctacgtcgatcggggctgggggaacggatgcggcctgttcgggaagggaagccttgtgacctgcgccaagtttcagtgtctggagcccattgagggcaaagttgtgcagtatgaaaatctcaagtacacagtcatcatcaccgtgcacacaggggaccagcatcaagttggaaacgagacgcagggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccacagacaatggtttttcgatctccccctgccgtggacaagcggcgccaccacagaaacccctacgtggaatcggaaagagcttctggtgacatttaagaacgctcatgcgaaaaagcaggaagtcgtggttctcgggtctcaggagggagccatgcacaccgctctgacaggcgccaccgaaatccaaaattccgggggcaccagcattttcgccggacacctgaagtgtcgcctcaaaatggacaagctggagcttaaaggcatgtcttacgctatgtgcacaaacacgtttgtgctgaagaaagaggtctccgaaacccaacatgggacaatcctcatcaaggtggagtacaagggagaagatgttccctgtaaaattcctttcagcaccgaggacggccaggggaaggcccacaacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggctagacgcatggctatccttggagacacagcctgggatttcggctccgttgggggagtcctcaacagcctgggcaagatggtgcatcagatttttgggtctgcgtacaccgccctgttctccggcgtgagctgggtcatgaaaatcggaattggcgtgctcctgacctggatcgggcttaattctaagaacattagcatgtccttttcttgcatcgctatcggaattatcacactgtatctcggcgccgttgtgcaggctgacatggggtgtgtcattaattggaaaggaaaggagctgaagtgcggcagcgggatcttcgtgaccaacgaggttcacacatggacggaacaatacaaatttcaggccgattcccccaagcggctggcgaccgccattgctggcgcctgggagaatggagtgtgtggcatcagaagcacaacccgcatggaaaaccttctctggaaacagatcgctaatgagctgaactatattctgtgggaaaataacatcaagctcacagtcgtggttggggacaccattggagtgctggagcagggcaaacggacgcttacccctcaacccatggagctgaagtactcttggaaaacatgggggaaggccaagatcgtcaccgccgaaacacagaactccagcttcattatcgatggacctaatacccccgagtgcccgtctgcttccagagcgtggaacgtgtgggaagtggaggactatggctttggcgtcttcacaaccaatatctggctcaaactgcgcgaagtttacacgcagctgtgtgaccatcggcttatgagcgccgctgtgaaggatgagagagccgtgcacgccgacatggggtactggattgagtcccagaaaaacggatcttggaagctcgaaaaagctagcctgatcgaggtcaagacatgcacctggcctaagtcccacaccctgtggtctaatggcgtgctcgaaagcgatatgattatccccaaatccctggccgggcctattagccaacataactatcgccccggataccacacacagaccgcgggcccttggcatcttgggaagctggagctcgactttaattattgcgagggaacgacagttgtgatcaccgaaaactgtggcacacggggcccctctctgagaaccacaaccgtctccgggaaactgatccacgagtggtgctgtcgcagctgcacgcttccgcctctccggtacatgggagaagatggctgttggtatgggatggagattagacccatctctgaaaaggaggagaatatggtgaaatccctggttagcgctggatctggcgaagtggacaacttcaccatgggggtcctgtgcctcgccattctgtttgaggaagtgatgcggggaaagttcggcaagaaacacatgatcgccggcgttttctttacattcgcccttctgctcagcgggcagattacctggcgcgatatggcccatacactgatcatgattggatccaatgcgagcgacagaatgggcatgggggtgacctacctggctcttatcgccacgtttaagatccaacccttcctggccctcggatttttcctgcggaaactcacatctagagagaacctgcttctgggcgtcgggctcgctatggccaccacactgcagctgcctgaagatattgagcagatggctaatggaatcgcccttggcctgatggcgctcaagctgattacccagtttgagacctatcaactctggacagccctgatctcccttacgtgtagcaacaccattttcacactgaccgtggcttggcgcacagccaccctcatcctggctggcgtgtccctgcttccggtctgccagtctagctccatgcggaaaacggactggctgcccatgacagttgccgccatgggggtgcctcccctccctctgtttatcttctctctcaaggataccctgaagagacgcagctggccccttaatgaaggagtgatggctgtcggcctggtgtccattctggcgtctagcctcctgagaaacgacgttcctatggccgggccccttgtggctggaggcctgctcatcgcctgttacgtcattaccgggacatccgccgatctgaccgtggagaaagctgccgacgttacatgggaagaggaagcggagcagacgggagtgagccacaacctcatgatcaccgtcgacgatgacggcacaatgcggattaaggatgacgagaccgaaaatatcctgacagtgcttctgaaaaccgctctgctcatcgtctctggcatttttccgtactccatccctgccacgctgcttgtgtggcatacctggcagaagcaaacacagcgcagcggggttctgtgggatgtgccctctcctcccgagacccagaaagccgaactcgaggagggagtctatagaattaagcagcaaggcatcttcgggaaaacacaggtgggagttggcgtgcagaaggaaggggtctttcacaccatgtggcatgtgacacggggagctgtgctgacgtacaacggcaagcgcctcgagccgaattgggcctccgttaaaaaggacctgattagctatggcgggggatggagactttctgcgcaatggcagaaaggcgaagaggtccaggtgatcgctgtggaacctgggaagaaccccaaaaatttccagaccatgcctggaacattccaaaccaccacaggcgagattggggccatcgccctggattttaagcccggaacgtccggcagccccatcattaaccgggagggcaaggtcgtggggctgtacggaaatggcgttgtgaccaaaaacgggggatatgtctccggcatcgctcagacaaatgccgaacctgacgggccgacccccgagctcgaagaggaaatgttcaagaaacgcaacctgacaattatggatcttcaccctggcagcggaaagaccagaaaatacctgcccgctatcgtgcgggaggccattaagcgcagactccggacgctgatcctcgcgcctacaagagttgtggccgctgagatggaagaggccctgaagggccttcccatccgctatcagaccaccgctacaaaatctgaacacaccgggcgggagattgtcgacctgatgtgccatgccacatttaccatgagactgctcagccctgtgcgcgttccgaattacaacctgatcattatggatgaagcccacttcacggaccccgcttccatcgcggcccggggatacatttctacaagagtgggcatgggggaggctgccgccatctttatgaccgctacacctcccggaaccgccgatgcgttccctcagagcaatgctcccatccaagacgaggaacgcgacattccggagcggtcctggaactctggcaatgaatggatcacggattttgccgggaagaccgtctggttcgtgcctagcattaaagccggcaacgacatcgctaactgtcttagaaagaatggcaaaaaggtgattcagctgtcccgcaagacatttgataccgagtatcagaaaacaaagctcaacgactgggatttcgtcgttaccacagacatctctgagatgggagccaattttaaagcggatcgggtgattgaccccagacggtgcctgaagcccgtgatcctgaccgatgggcctgaacgcgtcatcctcgccggacccatgcctgtgacggctgccagcgctgcccagagacggggccgcgttgggagaaacccgcaaaaagagaatgaccagtacattttcacaggacagccccttaacaatgatgaagaccatgctcactggaccgaggccaagatgctgctggacaacatcaatacccctgaaggcattatccccgccctcttcgagcctgagcgggaaaagtccgccgctattgatggggagtatagactgaaaggcgaaagccgcaagacatttgtggagcttatgcggagaggagacctgcccgtctggctcgcccataaagtggcttctgaaggcatcaagtacaccgatcgcaaatggtgcttcgacgggcagcggaacaatcaaatcctggaggagaacatggatgttgaaatttggacaaaggagggagagaagaagaagctgagaccgcgctggctcgacgcccggacgtattccgatcctcttgccctgaaagagtttaaggacttcgctgcgggcagaaaaagcatcgccctggatctcgtgaccgaaattgggcgcgtccccacacacctggctcacagaacccggaatgcccttgacaacctggtgatgctccatacatctgagcacggaggcaaggcctaccgccatgctgtcgaggaactgcctgagaccatggaaacgctgctccttctgggcctgatgatcctcctgaccgggggagccatgctttttctgatttccggcaaagggatcggaaagacaagcatcggcctcatttgtgtgatcgcgtcctctgggatgctgtggatggccgagattcccctgcagtggatcgctagcgccattgttctcgagttctttatgatggtgcttctgatccctgaacccgagaagcagagaaccccgcaagataatcagctggcttatgtggtcattggaatcctcacactggccgcgaccatcgccgctaacgaaatgggccttctggagacgacaaaacgggacctcggcatgtccaaggaacctggggttgtgagccccacctcttacctggatgtggacctgcaccccgcctccgcttggacactctacgccgtcgctaccaccgtgattacacctatgcttcgccacacgatcgagaatagcaccgccaacgtttctctggcggccattgctaaccaggccgtggtcctgatgggactcgacaaaggctggccgatcagcaagatggatctgggggtgccccttctggctctcggatgctattcccaggtcaatcctctgacactgaccgccgccgtgctccttctgattacacattacgcgatcatcggccccgggctgcaagctaaagccaccagagaggctcagaagcggacggccgccggaattatgaagaaccctacagttgacggcatcatgaccattgatctcgaccccgtgatctatgattctaaattcgaaaagcagctgggccaggtcatgcttctggtgctctgtgctgttcaactgctgctcatgagaaccagctgggccctttgcgaggcgctgacactggccaccgggcctattacaacgctctgggaaggatccccgggcaaattttggaataccacaatcgctgtgtctatggccaacatcttccgcgggagctacctggctggagccggccttgcgttttccattatgaaaagcgtcgggaccggaaaacggggcacaggctctcagggggagaccctgggagaaaagtggaagaaaaagctcaatcagctgtccagaaaagagttcgacctgtataagaaaagcggcatcacggaggtggatcgcaccgaagccaaggaggggctcaaacggggagaaattacacaccatgctgtgtccagaggctctgccaaacttcagtggtttgttgagcggaacatggtcatccccgaagggcgcgtgattgacctgggatgtggcagaggcgggtggagctactattgcgctggactgaagaaagtgaccgaggtccggggctacacaaaagggggacctggccacgaggaacccgttcctatgtccacctacgggtggaatatcgtgaaactcatgtctggaaaggatgtgttctatctgcccccggagaaatgtgacacacttctgtgcgatattggcgaaagctcccctagccccaccgtcgaggagtctcgcacgatcagagtgctcaagatggttgaaccctggctgaagaacaatcaattctgtatcaaagtgctgaacccttacatgcccacagtcattgagcatctcgaacggcttcagcgcaagcacggcgggatgctggtgagaaatcctctgtcccggaacagcacccacgagatgtattggatctctaatggaaccggcaacattgttgcctccgtgaatatggtcagccgcctcctgcttaacagatttacaatgacgcatcggagaccgaccatcgaaaaagacgtggatctgggggctggaacacgccacgtgaacgccgagcccgagacccctaatatggacgtcattggcgaacggatcaagagaatcaaagaggaacataactctacatggcactacgacgatgagaatccctataagacctgggcgtaccacgggagctatgaagttaaggccacaggatccgcttctagcatgattaacggcgtggtgaaactcctgaccaagccttgggacgtcgtgcccatggttacgcagatggccatgaccgatacaaccccgttcggccaacagcgcgtgtttaaagagaaggtcgacacacggacccctagatccatgcccgggacgcgccgggtgatgggaatcacagctgagtggctgtggagaaccctcggccgcaataaaaagcctcggctgtgcacaagagaagagttcaccaagaaagttcgcacgaacgccgccatgggggcggtgtttaccgaagagaatcagtgggatagcgctaaggccgccgtcgaagacgaggatttctggaaacttgtggaccgggagagagaactgcataagctcggaaaatgtggctcctgcgtttacaacatgatggggaagcgcgagaaaaagctgggcgaatttggaaaggctaaaggctctagagccatttggtacatgtggcttggggctcggtatctggagttcgaggccctcggatttctgaatgaagatcactggttcagccgcgagaactcctactctggcgtggaaggggagggactgcataagctcggctatatcctgagagacattagcaaaatccccgggggcgcgatgtacgccgatgacacagctggatgggacacccggatcacagaagatgaccttcacaatgaggagaagattacccagcaaatggatcctgaacatagacagctggccaacgctatctttaaactcacatatcagaataaggtcgtgaaggtccagcggcccaccccgacgggcacagtgatggacattatctcccgcaaagatcaaagagggtctggacaggttggcacctacgggctgaacaccttcacaaatatggaggcccagcttattcggcagatggaaggagagggcgtgctgagcaaggcggacctcgaaaaccctcatctgcccgagaaaaagatcacccaatggctggagacaaaaggggtcgaacgcctcaagagaatggccatctccggcgatgactgcgtggtgaagcccattgatgaccggtttgctaacgccctgcttgctctgaatgatatgggaaaagttcgcaaggacatccctcagtggcagccgagcaaaggctggcacgattggcagcaagtgcccttctgttctcatcacttccatgagctcattatgaaggacgggagaaaactggtcgtgccttgccggccccaggacgaacttatcggacgcgccagaatttcccagggcgctgggtggagcctgcgggagacggcctgtctcggaaaggcgtatgcccaaatgtggtctctgatgtactttcaccgcagagatctgcggctcgcttccaacgccatctgcagcgccgttcctgtgcactgggtccccacctctcgcacaacctggtccattcatgctcaccatcagtggatgacaaccgaagacatgctgacggtgtggaatagagtctggatcgaggataacccttggatggaggacaagacccccgtgacaacctgggaaaatgttccgtaccttggcaaacgggaggatcagtggtgtgggagcctgatcggcctcacatccagagccacctgggcgcagaacattcctacggctatccaacaggtgcgcagcctgattggaaatgaagagttccttgactatatgccctctatgaagcggtttagaaaagaggaagagagcgaaggcgccatctggtga

SEQ ID NO: 20783 - RNA, 9873 nt, synthetic construct
  misc_feature 1..9873: note = derived and/or modified CDS sequence (opt5) from DENV-3__FJ639782__SS-prME
  source 1..9873: mol_type = other RNA
accagcctgtgcctcatgatgatcctgcccgccgctcttgccttccacctgacatcccgggacggcgagcctcggatgattgtggggaagaacgaacgcggaaagtctctcctgtttaagacggcgagcggcatcaatatgtgtacccttattgctatggatctgggggaaatgtgcgacgatacagtgacctacaagtgtccgcacatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacatcattggagtgctggagcagggcaaacggacgcttacccctcagcccatggagctgaagtactcttggaaaacatgggggaaggccaagatcgtcaccgccgaaacacaaaactccagcttcattatcgatggacctaatacccccgagtgcccgtctgcttccagagcgtggaacgtgtgggaagtggaggactatggctttggcgtcttcacaaccaatatctggctcaaactgcgcgaagtttacacgcagctgtgtgaccaccggcttatgagcgccgctgtgaaggatgagagagccgtgcacgccgacatggggtactggattgagtcccagaaaaacggatcttggaagctcgaaaaagctagcctgatcgaggtcaagacatgcacctggcctaagtcccataccctgtggtctaatggcgtgctcgaaagcgatatgattatccccaaatccctggccgggcctattagccagcacaactatcgccccggataccatacacaaaccgcgggcccttggcaccttgggaagctggagctcgactttaattattgcgagggaacgacagttgtgatcaccgaaaactgtggcacacggggcccctctctgagaaccacaaccgtctccgggaaactgatccacgagtggtgctgtcgcagctgcacgcttccgcctctccggtacatgggagaagatggctgttggtatgggatggagattagacccatctctgaaaaggaggagaatatggtgaaatccctggttagcgctggatctggcgaagtggacaacttcaccatgggggtcctgtgcctcgccattctgtttgaggaagtgatgcggggaaagttcggcaagaaacatatgatcgccggcgttttctttacattcgtgcttctgctcagcgggcagattacctggcgcgatatggctcacacactgatcatgattggatccaatgccagcgacagaatgggcatgggggtcacctacctggcgcttatcgctacgtttaagatccagcccttcctggccctcggatttttcctgcggaaactcacatctagagagaacctgcttctgggcgtggggctcgccatggctaccacactgcaactgcctgaagatattgagcagatggccaatggaatcgctcttggcctgatggccctcaagctgattacccagtttgagacctatcagctctggacagcgctgatctcccttacgtgtagcaacaccattttcacactgaccgtggcctggcgcacagctaccctcatcctggccggcgtctccctgcttccggtttgccaatctagctccatgcggaaaacggactggctgcccatgacagtggctgccatgggggtgcctcccctccctctgtttatcttctctctcaaggataccctgaagagacgcagctggccccttaatgaaggagtcatggccgtgggcctggtttccattctggcttctagcctcctgagaaacgacgtgcctatggcggggccccttgtcgccggaggcctgctcatcgcttgttacgtgattaccgggacatccgccgatctgaccgttgagaaagccgctgacgtgacatgggaagaggaagccgagcagacgggagtcagccataacctcatgatcaccgtggacgatgacggcacaatgcggattaaggatgacgagaccgaaaatatcctgacagtccttctgaaaaccgcgctgctcatcgtgtctggcatttttccgtactccatccctgctacgctgcttgtttggcacacctggcagaagcagacacaacgcagcggggtgctgtgggatgtcccctctcctcccgagacccagaaagccgaactcgaggagggagtgtatagaattaagcagcagggcatcttcgggaaaacacaagttggagtgggcgtccagaaggaaggggtgtttcataccatgtggcacgtgacacggggagccgttctgacgtacaacggcaagcgcctcgagccgaattgggcttccgtcaaaaaggacctgattagctatggcgggggatggagactttctgcccagtggcaaaaaggcgaagaggtccaggtgatcgcggtcgaacctgggaagaaccccaaaaatttccagaccatgcctggaacattccagaccaccacaggcgagattggggctatcgccctggattttaagcccggaacgtccggcagccccatcattaaccgggagggcaagatcgtggggctgtacggaaatggcgttgtgaccaaaaacgggggatatgtctccggcattgcccaaacaaatgctgaacctgacgggccgacccccgagctcgaagaggaaatgttcaagaaacgcaacctgacaatcatggatcttcaccctggcagcggaaagaccagaaaatacctgcccgccattgtgcgggaggctatcaagcgcagactccggacgctgatcctcgcccctacaagagttgtggcggccgagatggaagaggctctgaagggccttcccattcgctatcagaccaccgccacaaaatctgaacataccgggcgggagatcgtcgacctgatgtgccacgctacatttaccatgagactgctcagccctgtgcgcgttccgaattacaacctgattatcatggatgaagcccatttcacggaccccgcctccattgctgcgcggggatacatctctacaagagtgggcatgggggaggccgctgccatctttatgaccgccacacctcccggaaccgctgatgccttccctcagagcaatgcgcccattcaggacgaggaacgcgacatcccggagcggtcctggaactctggcaatgaatggattacggattttgctgggaagaccgtctggttcgtgcctagcatcaaagccggcaacgacattgccaactgtcttagaaagaatggcaaaaaggtgatccaactgtcccgcaagacatttgataccgagtatcagaaaacaaagctcaacgactgggatttcgtcgttaccacagacatttctgagatgggagctaattttaaagccgatcgggtgatcgaccccagacggtgcctgaagcccgtgatcctgaccgatgggcctgaacgcgtcattctcgcgggacccatgcctgtgacggccgctagcgccgctcagagacggggccgcgttgggagaaacccgcagaaagagaatgaccaatacatcttcacaggacagccccttaacaatgatgaagaccacgcccattggaccgaggctaagatgctgctggacaacattaatacccctgaaggcatcattcccgccctcttcgagcctgagcgggaaaagtccgcggccatcgatggggagtatagactgaaaggcgaaagccgcaagacatttgtggagcttatgcggagaggagacctgcccgtctggctcgctcacaaagtggcctctgaaggcatcaagtacaccgatcgcaaatggtgcttcgacgggcagcggaacaatcagattctggaggagaacatggatgttgaaatctggacaaaggagggagagaagaagaagctgagaccgcgctggctcgacgctcggacgtattccgatcctcttgccctgaaagagtttaaggacttcgccgctggcagaaaaagcattgcgctggatctcgtgaccgaaatcgggcgcgtccccacacacctggcccatagaacccggaatgctcttgacaacctggtgatgctccacacatctgagcatggaggcaaggcctaccgccacgccgtcgaggaactgcctgagaccatggaaacgctgctccttctgggcctgatgattctcctgaccgggggagctatgctttttctgatctccggcaaagggatcggaaagacaagcattggcctcatctgtgtgattgcctcctctgggatgctgtggatggcggagatccccctgcaatggattgccagcgctatcgttctcgagttctttatgatggtgcttctgattcctgaacccgagaagcagagaaccccgcaggataatcaactggcctatgtggtcatcggaatcctcacactggctgccaccattgcggccaacgaaatgggccttctggagacgacaaaacgggacctcggcatgtccaaggaacctggggttgtgagccccacctcttacctggatgtggacctgcaccccgcttccgcctggacactctacgctgtcgccaccaccgtgatcacacctatgcttcgccatacgattgagaatagcaccgctaacgtttctctggccgcgatcgccaaccaggctgtggtcctgatgggactcgacaaaggctggccgattagcaagatggatctgggggtgccccttctggccctcggatgctattcccaggtcaatcctctgacactgaccgctgccgtgctccttctgatcacacactacgccatcattggccccgggctgcaggcgaaagctaccagagaggcccaaaagcggacggctgccggaatcatgaagaaccctacagttgacggcattatgaccatcgatctcgaccccgtgatttatgattctaaattcgaaaagcagctgggccaggtcatgcttctggtgctctgtgccgttcagctgctgctcatgagaaccagctgggctctttgcgaggccctgacactggcgaccgggcctatcacaacgctctgggaaggatccccgggcaaattttggaataccacaatcgccgtgtctatggctaacattttccgcgggagctacctggccggagctggccttgccttttccatcatgaaaagcgtcgggaccggaaaacggggcacaggctctcaaggggagaccctgggagaaaagtggaagaaaaagctcaatcagctgtccagaaaagagttcgacctgtataagaaaagcggcattacggaggtggatcgcaccgaagcgaaggaggggctcaaacggggagaaatcacacatcacgccgtgtccagaggctctgctaaacttcagtggtttgttgagcggaacatggtcattcccgaagggcgcgtgatcgacctgggatgtggcagaggcgggtggagctactattgcgccggactgaagaaagtgaccgaggtccggggctacacaaaagggggacctggccatgaggaacccgttcctatgtccacctacgggtggaatattgtgaaactcatgtctggaaaggatgtgttctatctgcccccggagaaatgtgacacacttctgtgcgatatcggcgaaagctcccctagccccaccgtcgaggagtctcgcacgatcagagtgctcaagatggttgaaccctggctgaagaacaatcagttctgtattaaagtgctgaacccttacatgcccacagtcatcgagcacctcgaacggcttcaacgcaagcacggcgggatgctggtgagaaatcctctgtcccggaacagcacccatgagatgtattggatttctaatggaaccggcaacatcgttgcttccgtgaatatggtcagccgcctcctgcttaacagatttacaatgacgtaccggagaccgaccattgaaaaagacgtggatctgggggccggaacacgccacgtgaacgctgagcccgagacccctaatatggacgtcatcggcgaacggatcaagagaattaaagaggaacataactctacatggcactatgacgatgagaatccctacaagacctgggcctatcacgggagctacgaagttaaggcgacaggatccgcctctagcatgatcaacggcgtggtgaaactcctgaccaagccttgggacgtcgtgcccatggttacgcagatggctatgaccgatacaaccccgttcggccagcaacgcgtgtttaaagagaaggtcgacacacggacccctagatccatgcccgggacgcgccgggtgatgggaattacagccgagtggctgtggagaaccctcggccgcaataaaaagcctcggctgtgcacaagagaagagttcaccaagaaagttcgcacgaacgctgccatgggggccgtgtttaccgaagagaatcagtgggatagcgcgaaggctgccgtcgaagacgaggatttctggaaacttgtggaccgggagagagaactgcataagctcggaaaatgtggctcctgcgtttacaacatgatggggaagcgcgagaaaaagctgggcgaatttggaaaggccaaaggctctagagctatctggtatatgtggcttggggcccggtacctggagttcgaggctctcggatttctgaatgaagatcactggttcagccgcgagaactcctattctggcgtggaaggggagggactgcataagctcggctacattctgagagacatcagcaaaatccccgggggcgccatgtatgcggatgacacagccggatgggacacccggattacagaagatgaccttcacaatgaggagaagatcacccagcagatggatcctgaacatagacaactggctaacgccatttttaaactcacataccagaataaggtcgtgaaggtccagcggcccaccccgacgggcacagtgatggacatcatttcccgcaaagatcagagagggtctggacaagttggcacctatgggctgaacaccttcacaaatatggaggctcagcttatccggcagatggaaggagagggcgtgctgagcaaggccgacctcgaaaaccctcatctgcccgagaaaaagatcacccagtggctggagacaaaaggggtcgaacgcctcaagagaatggcgatttccggcgatgactgcgtggtgaagcccatcgatgaccggtttgccaacgctctgcttgccctgaatgatatgggaaaagttcgcaaggacattcctcaatggcagccgagcaaaggctggcacgattggcaacaggtgcccttctgttctcatcacttccatgagctcatcatgaaggacgggagaaaactggtcgtgccttgccggccccaagacgaacttattggacgcgctagaatctcccagggcgccgggtggagcctgcgggagacggcttgtctcggaaaggcctacgcgcagatgtggtctctgatgtactttcaccgcagagatctgcggctcgcctccaacgctatttgcagcgccgttcctgtgcactgggtccccacctctcgcacaacctggtccatccatgcccaccatcaatggatgacaaccgaagacatgctgacggtgtggaatagagtctggatcgaggataacccttggatggaggacaagacccccgtgacaacctgggaaaatgttccgtatcttggcaaacgggaggatcagtggtgtgggagcctgattggcctcacatccagagctacctgggcccagaacatccctacggcgattcagcaagtgcgcagcctgatcggaaatgaagagttccttgactacatgccctctatgaagcggtttagaaaagaggaagagagcgaaggcgctatttggtga

SEQ ID NO: 20784 - RNA, 9873 nt, synthetic construct
  misc_feature 1..9873: note = derived and/or modified CDS sequence (opt5) from DENV-3__FJ639785__SS-prME
  source 1..9873: mol_type = other RNA
acaagcctgtgcctcatgatgatcctgcccgccgctcttgccttccacctgacatcccgggacggagagcctcggatgattgtggggaagaacgaacgcggaaagtctctcctgtttaagacggcgagcggcatcaatatgtgtacccttattgctatggatctgggggaaatgtgcgacgatacagtgacctacaaatgtccgcacatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacacgatcggagtgctggagcagggcaaacggacccttacacctcagcccatggagctgaagtactcttggaaaacctgggggaaggccaagattgtcacagccgaaacccaaaactccagcttcatcattgatggacctaatacacccgagtgcccgtctgcttccagagcgtggaacgtgtgggaagtggaggactatggctttggcgtcttcaccacgaatatctggctcaaactgcgcgaagtttacacacagctgtgtgaccaccggcttatgagcgccgctgtgaaggatgagagagccgtgcacgccgacatggggtactggatcgagtcccagaaaaacggatcttggaagctcgaaaaagctagcctgattgaggtcaagacctgcacctggcctaagtcccatacactgtggtctaatggcgtgctcgaaagcgatatgatcattcccaaatccctggccgggcctatcagccagcacaactatcgccccggataccatacccaaacggcgggcccttggcaccttgggaagctggagctcgactttaattattgcgagggaacaaccgttgtgattacagaaaactgtggcacccggggcccctctctgagaacaaccacggtctccgggaaactgatccacgagtggtgctgtcgcagctgcacccttccgcctctccggtacatgggagaagatggctgttggtatgggatggagatcagacccatttctgaaaaggaggagaatatggtgaaatccctggttagcgctggatctggcgaagtggacaacttcacaatgggggtcctgtgcctcgccatcctgtttgaggaagtgatgcggggaaagttcggcaagaaacatatgattgccggcgttttctttaccttcgtgcttctgctcagcgggcagatcacatggcgcgatatggctcacaccctgattatgatcggatccaatgccagcgacagaatgggcatgggggtcacgtacctggcgcttattgctacatttaagatccagcccttcctggccctcggatttttcctgcggaaactcacctctagagagaacctgcttctgggcgtggggctcgccatggctacaaccctgcaactgcctgaagatatcgagcagatggccaatggaattgctcttggcctgatggccctcaagctgatcacccagtttgagacatatcagctctggacggcgctgatttcccttacctgtagcaacacaatcttcaccctgacagtggcctggcgcaccgctacgctcattctggccggcgtctccctgcttccggtttgccaatctagctccatgcggaaaacagactggctgcccatgaccgtggctgccatgggggtgcctcccctccctctgtttatcttctctctcaaggataccctgaagagacgcagctggccccttaatgaaggagtcatggccgtgggcctggtttccatcctggcttctagcctcctgagaaacgacgtgcctatggcggggccccttgtcgccggaggcctgctcattgcttgttacgtgatcacagggacctccgccgatctgacagttgagaaagccgctgacgtgacgtgggaagaggaagccgagcagaccggagtcagccataacctcatgattacagtggacgatgacggcaccatgcggatcaaggatgacgagacagaaaatattctgaccgtccttctgaaaacggcgctgctcatcgtgtctggcatctttccgtactccattcctgctaccctgcttgtttggcacacatggcagaagcagacccaacgcagcggggtgctgtgggatgtcccctctcctcccgagacacagaaagccgaactcgaggagggagtgtatagaatcaagcagcagggcattttcgggaaaacccaagttggagtgggcgtccagaaggaaggggtgtttcatacaatgtggcacgtgacgcggggagccgttctgacctacaacggcaagcgcctcgagccgaattgggcttccgtcaaaaaggacctgatcagctatggcgggggatggagactttctgcccagtggcaaaaaggcgaagaggtccaggtgattgcggtcgaacctgggaagaaccccaaaaatttccagacaatgcctggaaccttccagaccacaacgggcgagatcggggctattgccctggattttaagcccggaacctccggcagccccatcatcaaccgggagggcaaggtggttgggctgtacggaaatggcgtggtcaccaagaacgggggatatgtgtccggcattgcccaaaccaatgctgaacctgacgggccgacacccgagctcgaagaggaaatgttcaagaaacgcaacctgaccatcatggatcttcaccctggcagcggaaagacgagaaaatacctgcccgccattgttcgggaggctatcaagcgcagactccggacactgattctcgcccctaccagagtggtcgcggccgagatggaagaggctctgaagggccttcccatccgctatcagaccacagccaccaaatctgaacatacagggcgggagatcgtggacctgatgtgccacgctacctttacgatgagactgctcagccctgttcgcgtgccgaattacaacctgattatcatggatgaagcccatttcacagaccccgcctccattgctgcgcggggatacatctctaccagagtcggcatgggggaggccgctgccatttttatgacagccacccctcccggaacggctgatgccttccctcagagcaatgcgcccatccaggacgaggaacgcgacatcccggagcggtcctggaactctggcaatgaatggattaccgattttgctgggaagacagtgtggttcgtgcctagcatcaaagccggcaacgacattgccaactgtcttagaaagaatggcaaaaaggtcatccaactgtcccgcaagacctttgatacagagtatcagaaaaccaagctcaacgactgggatttcgttgtgacaaccgacatttctgagatgggagctaattttaaagccgatcgggtgatcgaccccagacggtgcctgaagcccgtcattctgacggatgggcctgaacgcgtgatcctcgcgggacccatgcctgttacagccgctagcgccgctcagagacggggccgcgtggggagaaacccgcagaaagagaatgaccaatacatcttcaccggacagccccttaacaatgatgaagaccacgcccattggaccgaggctaagatgctgctggacaacattaatacacctgaaggcatcattcccgccctcttcgagcctgagcgggaaaagtccgcggccatcgatggggagtatagactgaaaggcgaaagccgcaagacctttgtcgagcttatgcggagaggagacctgcccgtgtggctcgctcacaaagttgcctctgaaggcattaagtacacagatcgcaaatggtgcttcgacgggcagcggaacaatcagatcctggaggagaacatggatgtggaaatctggacgaaggagggagagaagaagaagctgagaccgcgctggctcgacgctcggacctattccgatcctcttgccctgaaagagtttaaggacttcgccgctggcagaaaaagcattgcgctggatctcgtcacagaaatcgggcgcgtgcccacccacctggcccatagaacacggaatgctcttgacaacctggtcatgctccacacctctgagcatggaggcaaggcctaccgccacgccgtggaggaactgcctgagacgatggaaaccctgctccttctgggcctgatgattctcctgacagggggagctatgctttttctgatctccggcaaagggattggaaagaccagcatcggcctcatctgtgttattgcctcctctgggatgctgtggatggcggagatccccctgcaatggattgccagcgctatcgtgctcgagttctttatgatggtgcttctgattcctgaacccgagaagcagagaacaccgcaggataatcaactggcctatgtcgttatcggcattctcaccctggctgccacgatcgcggccaacgaaatgggccttctggagacaaccaaacgggacctcggcatgtccaaggaacctggggtggtgagccccacatcttacctggatgtcgacctgcaccccgcttccgcctggaccctctacgctgtggccaccacagttatcacgcctatgcttcgccataccattgagaatagcacagctaacgtgtctctggccgcgatcgccaaccaggctgtcgtgctgatgggactcgacaaaggctggccgattagcaagatggatctgggggtcccccttctggccctcggatgctattcccaggtgaatcctctgaccctgacagctgccgttctccttctgatcacccactacgccattatcggccccgggctgcaggcgaaagctacgagagaggcccaaaagcggacagctgccggaatcatgaagaaccctaccgtggacggcattatgaccatcgatctcgaccccgtcatttatgattctaaattcgaaaagcagctgggccaggtgatgcttctggttctctgtgccgtgcagctgctgctcatgagaacaagctgggctctttgcgaggccctgaccctggcgacagggcctatcacgaccctctgggaaggatccccgggcaaattttggaatacaaccattgccgtctctatggctaacatcttccgcgggagctacctggccggagctggccttgccttttccatcatgaaaagcgtggggacaggaaaacggggcaccggctctcaaggggagacgctgggagaaaagtggaagaaaaagctcaatcagctgtccagaaaagagttcgacctgtataagaaaagcggcattaccgaggtggatcgcacagaagcgaaggaggggctcaaacggggagaaatcacccatcacgccgtttccagaggctctgctaaacttcagtggtttgtcgagcggaacatggtgattcccgaagggcgcgtgatcgacctgggatgtggcagaggcgggtggagctactattgcgccggactgaagaaagtcacagaggttcggggctacaccaaagggggacctggccatgaggaacccgtgcctatgtccacatacgggtggaatattgtgaaactcatgtctggaaaggatgtcttctatctgcccccggagaaatgtgacacccttctgtgcgatatcggcgaaagctcccctagccccacggtggaggagtctcgcacaattagagttctcaagatggtggaaccctggctgaagaacaatcagttctgtatcaaagtcctgaacccttacatgcccaccgtgatcgagcacctcgaacggcttcaacgcaagcacggcgggatgctggttagaaatcctctgtcccggaacagcacccatgagatgtattggatttctaatggaacaggcaacatcgtggcttccgtcaatatggtgagccgcctcctgcttaacagatttacgatgacccaccggagaccgacaattgaaaaagacgtggatctgggggccggaacccgccatgtcaacgctgagcccgagacacctaatatggacgttatcggcgaacggattaagagaatcaaagaggaacacaactctacctggcactacgacgatgagaatccctataagacatgggcctaccatgggagctatgaagtgaaggcgaccggatccgcctctagcatgatcaacggcgtggtcaaactcctgacgaagccttgggacgtggttcccatggtgacccagatggctatgacagataccacaccgttcggccagcaacgcgtctttaaagagaaggtggacacccggacgcctagatccatgcccgggacacgccgggttatgggaattaccgccgagtggctgtggagaacactcggccgcaataaaaagcctcggctgtgcaccagagaagagttcacgaagaaagtgcgcaccaacgctgccatgggggccgtctttacagaagagaatcagtgggatagcgcgaaggctgccgtggaagacgaggatttctggaaacttgttgaccgggagagagaactgcacaagctcggaaaatgtggctcctgcgtgtacaacatgatggggaagcgcgagaaaaagctgggcgaatttggaaaggccaaaggctctagagctatctggtacatgtggcttggggcccggtatctggagttcgaggctctcggatttctgaatgaagatcattggttcagccgcgagaactcctactctggcgtcgaaggggagggactgcacaagctcggctatattctgagagacatcagcaaaattcccgggggcgccatgtacgcggatgacaccgccggatgggacacacggatcaccgaagatgaccttcataatgaggagaagatcacacagcagatggatcctgaacacagacaactggctaacgccatttttaaactcacctatcagaataaggtggtcaaggtgcagcggcccacgccgacaggcaccgttatggacatcatttcccgcaaagatcagagagggtctggacaagtgggcacctacgggctgaacacattcaccaatatggaggctcagcttatccggcagatggaaggagagggcgtcctgagcaaggccgacctcgaaaaccctcatctgcccgagaaaaagattacacagtggctggagacgaaaggggtggaacgcctcaagagaatggcgatctccggcgatgactgcgtggttaagcccatcgatgaccggtttgccaacgctctgcttgccctgaatgatatgggaaaagtgcgcaaggacattcctcaatggcagccgagcaaaggctggcatgattggcagcaggtccccttctgttctcaccatttccacgagctcatcatgaaggacgggagaaaactggtggttccttgccggccccaagacgaacttattggacgcgctagaatctcccagggcgccgggtggagcctgcgggagaccgcttgtctcggaaaggcctatgcgcagatgtggtctctgatgtactttcaccgcagagatctgcggctcgcctccaacgctatttgcagcgccgtgcctgtccattgggtgcccacatctcgcaccacatggtccatccacgcccatcaccaatggatgaccacggaagacatgctgaccgtctggaatagagtgtggattgaggataacccttggatggaggacaagacacccgttaccacatgggaaaatgtgccgtaccttggcaaacgggaggatcagtggtgtgggagcctgatcggcctcacctccagagctacgtgggcccagaacatccctacagcgattcagcaagtccgcagcctgatcggaaatgaagagttccttgactatatgccctctatgaagcggtttagaaaagaggaagagagcgaaggcgctatttggtga

SEQ ID NO: 20785 - RNA, 9873 nt, synthetic construct
  misc_feature 1..9873: note = derived and/or modified CDS sequence (opt5) from DENV-3__FJ639786__SS-prME
  source 1..9873: mol_type = other RNA
acaagcctgtgcctcatgatgatcctgcccgccgctcttgccttccacctgacatcccgggacggcgagcctcggatgattgtggggaagaacgaacgcggaaaatctctcctgtttaagacggcgagcggcatcaatatgtgtacccttattgctatggatctgggggaaatgtgcgacgatacagtgacctacaaatgtccgcacatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtgggccagcggcgctacaaccgaaacacctacctggaatcggaaagagcttctggtgacgtttaagaacgcgcacgccaaaaagcaagaagtcgtggttctcgggtctcaggagggagctatgcacacagccctgaccggcgccacagaaatccaaaattccgggggcaccagcattttcgctggacatctgaagtgtcgcctcaaaatggacaagctggagcttaaaggcatgtcttacgccatgtgcaccaacacatttgtgctgaagaaagaggtctccgaaacgcagcacgggaccatcctcatcaaggtggagtacaagggagaagatgttccctgtaaaattcctttcagcacagaggacggccaagggaaggcgcataacggaagactgatcaccgctaatcccgtggtcaccaagaaggaggaacccgtgaacattgaggccgaacctccgttcggcgagtccaatatcgtgattgggatcggcgataacgccctgaaaatcaattggtataagaagggatctagcattggcaaaatgtttgaagctaccgccagaggggctagacgcatggccatccttggagacacggcgtgggatttcggctccgttgggggagtcctcaacagcctgggcaagatggtgcaccagatttttgggtctgcctacacagctctgttctccggcgtgagctgggtcatgaaaatcggaattggcgtgctcctgacctggatcgggcttaattctaagaacaccagcatgtccttttcttgcattgccatcggaatcattacactgtatctcggcgctgttgtgcaggccgacatggggtgtgtcatcaattggaaaggaaaggagctgaagtgcggcagcgggattttcgtgaccaacgaggttcatacatggacggaacagtacaaatttcaagcggattcccccaagcggctggccaccgctatcgccggcgcttgggagaatggagtgtgtggcattagaagcacaacccgcatggaaaaccttctctggaaacagatcgccaatgagctgaactatatcctgtgggaaaataacattaagctcacagtcgtggttggggacatcattggagtgctggagcagggcaaacggacccttacgcctcagcccatggagctgaagtactcttggaaaacctgggggaaggccaagatcgtcacagctgaaacccaaaactccagcttcattatcgatggacctaatacacccgagtgcccgtctgcgtccagagcctggaacgtgtgggaagtggaggactatggctttggcgtcttcaccacaaatatctggctcaaactgcgcgaagtttacacccagctgtgtgaccaccggcttatgagcgctgccgtgaaggatgagagagccgtgcacgctgacatggggtactggattgagtcccagaaaaacggatcttggaagctcgaaaaagccagcctgatcgaggtcaagacgtgcacatggcctaagtcccataccctgtggtctaatggcgtgctcgaaagcgatatgattatccccaaatccctggcggggcctattagccagcacaactatcgccccggataccatacccaaacagctggcccttggcaccttgggaagctggagctcgactttaattattgcgagggaaccacggttgtgatcacagaaaactgtggcacccggggcccctctctgagaacaaccacagtctccgggaaactgatccacgagtggtgctgtcgcagctgcacccttccgcctctccggtacatgggagaagatggctgttggtatgggatggagattagacccatctctgaaaaggaggagaatatggtgaaatccctggttagcgccggatctggcgaagtggacaacttcacgatgggggtcctgtgcctcgccattctgtttgaggaagtgatgcggggaaagttcggcaagaaacatatgatcgctggcgttttctttaccttcgtgcttctgctcagcgggcagattacatggcgcgatatggcccacaccctgatcatgattggatccaatgcgagcgacagaatgggcatgggggtcacatacctggctcttatcgccacctttaagatccagcccttcctggccctcggatttttcctgcggaaactcacgtctagagagaacctgcttctgggcgtggggctcgctatggccacaaccctgcaactgcctgaagatattgagcagatggctaatggaatcgcccttggcctgatggcgctcaagctgattacacagtttgagacctatcagctctggaccgccctgatctcccttacatgtagcaacacgattttcaccctgacagtggcttggcgcaccgccacactcatcctggctggcgtctccctgcttccggtttgccaatctagctccatgcggaaaaccgactggctgcccatgacggtggccgccatgggggtgcctcccctccctctgtttatcttctctctcaaggatacactgaagagacgcagctggccccttaatgaaggagtcatggctgtgggcctggtttccattctggcgtctagcctcctgagaaacgacgtgcctatggccgggccccttgtcgctggaggcctgctcatcgcctgttacgtgattaccgggacctccgccgatctgacagttgagaaagctgccgacgtgacctgggaagaggaagcggagcagacaggagtcagccataacctcatgatcacggtggacgatgacggcaccatgcggattaaggatgacgagacagaaaatatcctgaccgtccttctgaaaacagctctgctcatcgtgtctggcatttttccgtactccatccctgccaccctgcttgtttggcacacgtggcagaagcagacccaacgcagcggggtgctgtgggatgtcccctctcctcccgagacacagaaagccgaactcgaggagggagtgtatagaattaagcagcagggcatcttcgggaaaacccaagttggagtgggcgtccagaaggaaggggtgtttcatacaatgtggcacgtgacccggggagctgttctgacatacaacggcaagcgcctcgagccgaattgggcctccgtcaaaaaggacctgattagctatggcgggggatggagactttctgcgcagtggcaaaaaggcgaagaggtccaggtgatcgctgtcgaacctgggaagaaccccaaaaatttccagacgatgcctggaaccttccagacaaccaccggcgagattggggccatcgccctggattttaagcccggaacatccggcagccccatcattaaccgggagggcaaggtggttgggctgtacggaaatggcgtggtcacgaaaaacgggggatatgtgtccggcatcgctcaaaccaatgccgaacctgacgggccgacacccgagctcgaagaggaaatgttcaagaaacgcaacctgaccattatggatcttcaccctggcagcggaaagacaagaaaatacctgcccgctatcgttcgggaggccattaagcgcagactccggaccctgatcctcgcgcctacgagagtggtcgccgctgagatggaagaggccctgaagggccttcccatccgctatcagacaaccgctaccaaatctgaacatacagggcgggagattgtggacctgatgtgccacgccacctttacaatgagactgctcagccctgttcgcgtgccgaattacaacctgatcattatggatgaagcccatttcaccgaccccgcttccatcgcggcccggggatacatttctacgagagtcggcatgggggaggctgccgccatctttatgacagctacccctcccggaacagccgatgcgttccctcagagcaatgctcccatccaggacgaggaacgcgacattccggagcggtcctggaactctggcaatgaatggatcaccgattttgccgggaagacggtgtggttcgtgcctagcattaaagccggcaacgacatcgctaactgtcttagaaagaatggcaaaaaggtcattcaactgtcccgcaagacctttgatacagagtatcagaaaaccaagctcaacgactgggatttcgttgtgacaaccgacatctctgagatgggagccaattttaaaacagatcgggtgattgaccccagacggtgcctgaagcccgtcatcctgaccgatgggcctgaacgcgtgatcctcgcgggacccatgcctgttacggccgctagcgccgctcagagacggggccgcgtggggagaaacccgcagaaagagaatgaccaatacattttcacaggacagccccttaacaatgatgaagaccacgcccattggaccgaggctaagatgctgctggacaacatcaatacccctgaaggcattatccccgccctcttcgagcctgagcgggaaaagtccgcggccattgatggggagtatagactgaaaggcgaaagccgcaagacatttgtcgagcttatgcggagaggagacctgcccgtgtggctcgctcacaaagttgcctctgaaggcatcaagtacaccgatcgcaaatggtgcttcgacgggcagcggaacaatcagatcctggaggagaacatggatgtggaaatttggacaaaggagggagagaagaagaagctgagaccgcgctggctcgacgctcggacgtattccgatcctcttgccctgaaagagtttaaggacttcgccgctggcagaaaaagcatcgcgctggatctcgtcaccgaaattgggcgcgtgcccacacacctggcccatagaacccggaatgctcttgacaacctggtcatgctccacacatctgagcatggaggcaaggcctaccgccacgccgtggaggaactgcctgagaccatggaaacgctgctccttctgggcctgatgatcctcctgaccgggggagctatgctttttctgatttccggcaaagggatcggaaagacaagcatcggcctcatttgtgttatcgcctcctctgggatgctgtggatggcggagattcccctgcaatggatcgccagcgctattgtgctcgagttctttatgatggtgcttctgatccctgaacccgagaagcagagaaccccgcaggataatcaactggcctatgtcgttattggaatcctcacactggctgccatcattgcggccaacgaaatgggccttctggagaccacgaaacgggacctcggcatgtccaaggaacctggggtggtgagccccacatcttacctggatgtcgacctgcaccccgcttccgcctggaccctctacgctgtggccacaaccgttatcacccctatgcttcgccatacaattgagaatagcacggctaacgtgtctctggccgcgatcgccaaccaggctgtcgtgctgatgggactcgacaaaggctggccgattagcaagatggatctgggggtcccccttctggccctcggatgctattcccaggtgaatcctctgaccctgacagctgccgttctccttctgatcacccactacgccatcattggccccgggctgcaggcgaaagctacaagagaggcccaaaagcggaccgctgccggaatcatgaagaaccctacggtggacggcattatgacaatcgatctcgaccccgtcatttatgattctaaattcgaaaagcagctgggccaggtgatgcttctggttctctgtgccgtgcagctgctgctcatgagaaccagctgggctctttgcgaggccctgaccctggcgacagggcctatcaccacactctgggaaggatccccgggcaaattttggaatacgaccatcgccgtctctatggctaacattttccgcgggagctacctggccggagctggccttgccttttccatcatgaaaagcgtggggacaggaaaacggggcaccggctctcaaggggagacactgggagaaaagtggaagaaaaagctcaatcagctgtccagacgcgagttcgacctgtataaaaagagcggcattaccgaggtggatcggacggaagcgaaagaggggctcaagagaggagaaatcacccatcacgccgtttcccggggctctgctaaacttcagtggtttgtcgagcgcaacatggtgattcccgaagggagagtgatcgacctgggatgtggccggggcgggtggagctactattgcgccggactgaagaaggtcacagaggttcgcggctacaccaaagggggacctggccatgaggaacccgtgcctatgtccacatacgggtggaatattgtgaagctcatgtctggaaaagatgtcttctatctgcccccggagaagtgtgacacccttctgtgcgatatcggcgaaagctcccctagccccacagtggaggagtctagaaccatccgggttctcaaaatggtggaaccctggctgaagaacaatcagttctgtattaaggtcctgaacccttacatgcccacggtgatcgagcacctcgaacgccttcaaagaaaacacggcgggatgctggttcggaatcctctgtcccgcaacagcacacatgagatgtattggatttctaatggaaccggcaacatcgtggcttccgtcaatatggtgagcagactcctgcttaaccggtttaccatgacacacagacgcccgacgattgaaaaggacgtggatctgggggccggaacccggcatgtcaacgctgagcccgagacacctaatatggacgttatcggcgaaagaatcaaacgcattaaggaggaacacaactctacctggcactacgacgatgagaatccctataaaacatgggcctaccatgggagctatgaagtgaaggcgaccggatccgcctctagcatgatcaacggcgtggtcaagctcctgacaaaaccttgggacgtggttcccatggtgacccagatggctatgacggataccacaccgttcggccagcaacgggtctttaaggagaaagtggacaccagaacacctcgccccatgcctgggacccggagagttatgggaattacggccgagtggctgtggcgcacactcggccggaataagaaacccagactgtgcacccgcgaagagttcacaaagaaggtgcggaccaacgctgccatgggggccgtctttacggaagagaatcagtgggattccgcgaaagctgccgtggaagacgaggatttctggaaacttgttgacagagagcgcgaactgcacaaactcggaaagtgtggcagctgcgtgtacaacatgatggggaaaagagagaagaaactgggcgaatttggaaaggccaagggctcccgggctatctggtacatgtggcttggggcccgctatctggagttcgaggctctcggatttctgaatgaagatcattggttctctagagagaacagctactccggcgtcgaaggggagggactgcacaaactcggctatattctgcgggacatctctaagatccctgggggcgccatgtacgcggatgacaccgccggatgggacacaagaattaccgaagatgaccttcataatgaggagaaaatcacacagcagatggatcccgaacaccggcaactggctaacgccatttttaagctcacctatcagaataaagtggtcaaggtgcagcgcccgacacctaccggcacggttatggacatcattagcagaaaggatcagcgggggtccggacaagtgggcacatacgggctgaacaccttcaccaatatggaggctcagcttatccgccagatggaaggagagggcgtcctgtctaaagccgacctcgaaaacccccatctgcccgagaagaaaatcacacagtggctggagaccaagggggtggaaagactcaaacggatggcgattagcggcgatgactgcgtggttaagcctatcgatgaccgctttgccaacgctctgcttgccctgaatgatatgggaaaggtgagaaaagacattccgcaatggcagccctccaagggctggcatgattggcagcaggtccctttctgtagccaccatttccacgagctcatcatgaaagacgggcggaagctggtggttccctgccgccctcaagacgaacttattggacgggctcggatctctcagggcgccgggtggtccctgcgcgagacagcttgtctcggaaaagcctatgcgcagatgtggagcctgatgtactttcacagacgggatctgcgcctcgcctctaacgctatttgctccgccgtgcccgtccattgggtgcctacgagcagaaccacatggtctatccacgcccatcaccaatggatgaccacagaagacatgctgaccgtctggaatcgggtgtggatcgaggataacccctggatggaggacaagacgccggttaccacatgggaaaatgtgccttaccttggcaagagagaggatcagtggtgtgggtccctgattggcctcaccagccgcgctacatgggcccagaacatctccaccgcgattcagcaagtccggagcctgatcggaaatgaagagttccttgactatatgccctctatgaaaagatttcgcaaggaggaagagagcgaaggcgctatttggtga

SEQ ID NO: 20786 - RNA, 9873 nt, synthetic construct
  misc_feature 1..9873: note = derived and/or modified CDS sequence (opt5) from DENV-3__FJ639787__SS-prME
  source 1..9873: mol_type = other RNA
acaagcctgtgcctgatgatgatcctgcccgccgctcttgccttccacctgacatcccgggacggagagcctcggatgattgtggggaagaacgaacgcggaaagtctctcctgtttaagacggcgagcggcatcaatatgtgtacccttattgctatggatctgggggaaatgtgcgacgatacagtgacctacaagtgtccgcacatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggctcagcgccgagggcgcttggagacaggtggaaaaagttgagacatgggccctgcgccaccccggcttcaccatccttgcgctgtttctcgcccattacatcgggacgtccctgacacagaaggtggtcattttcatccttctgatgctcgtgaccccttctatgacaatgagatgtgttggagtgggcaaccgggactttgtcgaagggctgagcggagctacctgggtggatgtggtcctggagcacggcgggtgcgttaccacaatggccaagaataaacccacgctcgacattgagctgcagaagaccgaagctacacaacttgccaccctgcgcaaactctgtatcgagggaaagattacaaacatcaccacggattccagatgccctacacagggcgaagcggtgctgccggaggaacaggaccagaattatgtgtgtaaacacacctacgtcgatcggggctgggggaacggatgcggccttttcgggaagggaagcctggtgacctgcgccaagtttcaatgtctcgagcccattgagggcaaagttgtgcagtatgaaaatctgaagtacacagtcatcatcaccgtgcatacaggggaccagcaccaggttggaaacgagacgcaaggcgtgaccgctgaaattacacctcaggcctctaccacagaggctatcctgcccgaatatggcaccctcgggctggagtgctcccctcgcacgggacttgacttcaatgagatgattctgctcaccatgaaaaacaaggcctggatggtccatagacagtggtttttcgatctgccccttccgtggacaagcggcgccaccacagaaacccctacgtggaatcggaaagagctgctcgtgacatttaagaacgctcacgcgaaaaagcaagaagtcgtggttctggggtctcaggagggagccatgcacaccgctctgacaggcgccaccgaaatccaaaattccgggggcaccagcattttcgccggacatctcaagtgtcgcctgaaaatggacaaacttgagctgaaaggcatgtcttacgctatgtgcacaaacacgtttgtgctcaagaaagaggtctccgaaacccagcacgggacaatcctgatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgcccttaaaatcaattggtataagaagggatctagcattggcaaaatgtttgaagccacggctagaggggctagacgcatggctatcctcggagacacagcctgggatttcggctccgttgggggagtcctgaacagcctgggcaagatggtgcaccagatttttgggtctgcgtacaccgccctcttctccggcgtgagctgggtcatgaaaatcggaattggcgtgctgcttacctggatcgggctcaattctaagaacacaagcatgtccttttcttgcattgctatcggaatcattaccctctatctgggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggcttgcgacagccatcgctggcgcctgggagaatggagtgtgtggcattagaagcaccacacgcatggaaaacctcctgtggaaacagatcgctaatgagctgaactatatcctctgggaaaataacattaagctgaccgtcgtggttggggacacgatcggagtgcttgagcagggcaaacggaccctgacacctcagcccatggagctcaagtactcttggaaaacctgggggaaggccaagattgtcacagccgaaacccaaaactccagcttcatcattgatggacctaatacacccgagtgcccgtctgcttccagagcgtggaacgtgtgggaagtggaggactatggctttggcgtcttcaccacgaatatctggctgaaactgcgcgaagtttacacacagctttgtgaccaccggctcatgagcgccgctgtgaaggatgagagagccgtgcacgccgacatggggtactggatcgagtcccagaaaaacggatcttggaagctggaaaaagctagcctgattgaggtcaagacctgcacctggcctaagtcccatacactctggtctaatggcgtgctggaaagcgatatgatcattcccaaatcccttgccgggcctatcagccagcacaactatcgccccggataccatacccaaacggcgggcccttggcacctggggaagctcgagctggactttaattattgcgagggaacaaccgttgtgattacagaaaactgtggcacccggggcccctctctgagaacaaccacggtctccgggaaacttatccacgagtggtgctgtcgcagctgcaccctcccgcctctgcggtacatgggagaagatggctgttggtatgggatggagatcagacccatttctgaaaaggaggagaatatggtgaaatccctggttagcgctggatctggcgaagtggacaacttcacaatgggggtcctctgcctggccatcctttttgaggaagtgatgcggggaaagttcggcaagaaacatatgattgccggcgttttctttaccttcgtgctgctcctgagcgggcagatcacatggcgcgatatggctcacaccctgattatgatcggatccaatgccagcgacagaatgggcatgggggtcacgtaccttgcgctgattgctacatttaagatccagcccttcctcgccctgggatttttcctccggaaactgacctctagagagaaccttctgctcggcgtggggctggccatggctacaaccctgcaacttcctgaagatatcgagcagatggccaatggaattgctctgggcctcatggccctgaagctcatcacccagtttgagacatatcagctgtggacggcgcttatttccctgacctgtagcaacacaatcttcaccctcacagtggcctggcgcaccgctacgctgattctggccggcgtctcccttctgccggtttgccaatctagctccatgcggaaaacagactggctccccatgaccgtggctgccatgggggtgcctcccctgcctctctttatcttctctctgaaggatacccttaagagacgcagctggcccctgaatgaaggagtcatggccgtgggcctggtttccatcctcgcttctagcctgcttagaaacgacgtgcctatggcggggcccctggtcgccggaggcctcctgattgcttgttacgtgatcacagggacctccgccgatctcacagttgagaaagccgctgacgtgacgtgggaagaggaagccgagcagaccggagtcagccataacctgatgattacagtggacgatgacggcaccatgcggatcaaggatgacgagacagaaaatattcttaccgtcctgctgaaaacggcgctcctgatcgtgtctggcatctttccgtactccattcctgctacccttctggtttggcacacatggcagaagcagacccaacgcagcggggtgctctgggatgtcccctctcctcccgagacacagaaagccgaactggaggagggagtgtatagaatcaagcagcagggcattttcgggaaaacccaagttggagtgggcgtccagaaggaaggggtgtttcatacaatgtggcacgtgacgcggggagccgttctcacctacaacggcaagcgcctggagccgaattgggcttccgtcaaaaaggaccttatcagctatggcgggggatggagactgtctgcccagtggcaaaaaggcgaagaggtccaggtgattgcggtcgaacctgggaagaaccccaaaaatttccagacaatgcctggaaccttccagaccacaacgggcgagatcggggctattgccctggattttaagcccggaacctccggcagccccatcatcaaccgggagggcaaggtggttgggctctacggaaatggcgtggtcaccaagaacgggggatatgtgtccggcattgcccaaaccaatgctgaacctgacgggccgacacccgagctggaagaggaaatgttcaagaaacgcaaccttaccatcatggatctgcaccctggcagcggaaagacgagaaaatacctccccgccattgttcgggaggctatcaagcgcagactgcggacactcattctggcccctaccagagtggtcgcggccgagatggaagaggctcttaagggcctgcccatccgctatcagaccacagccaccaaatctgaacatacagggcgggagatcgtggacctgatgtgccacgctacctttacgatgagactcctgagccctgttcgcgtgccgaattacaaccttattatcatggatgaagcccatttcacagaccccgcctccattgctgcgcggggatacatctctaccagagtcggcatgggggaggccgctgccatttttatgacagccacccctcccggaacggctgatgccttccctcagagcaatgcgcccatccaggacgaggaacgcgacatcccggagcggtcctggaactctggcaatgaatggattaccgattttgctgggaagacagtgtggttcgtgcctagcatcaaagccggcaacgacattgccaactgtctgagaaagaatggcaaaaaggtcatccaactctcccgcaagacctttgatacagagtatcagaaaaccaagctgaacgactgggatttcgttgtgacaaccgacatttctgagatgggagctaattttaaagccgatcgggtgatcgaccccagacggtgcctgaagcccgtcattctcacggatgggcctgaacgcgtgatccttgcgggacccatgcctgttacagccgctagcgccgctcagagacggggccgcgtggggagaaacccgcagaaagagaatgaccaatacatcttcaccggacagcccctgaacaatgatgaagaccacgcccattggaccgaggctaagatgctgctcgacaacattaatacacctgaaggcatcattcccgccctgttcgagcctgagcgggaaaagtccgcggccatcgatggggagtatagacttaaaggcgaaagccgcaagacctttgtcgagctgatgcggagaggagacctccccgtgtggctggctcacaaagttgcctctgaaggcattaagtacacagatcgcaaatggtgcttcgacgggcagcggaacaatcagatcctggaggagaacatggatgtggaaatctggacgaaggagggagagaagaagaagctcagaccgcgctggcttgacgctcggacctattccgatcctctggccctgaaagagtttaaggacttcgccgctggcagaaaaagcattgcgctcgatctggtcacagaaatcgggcgcgtgcccacccaccttgcccatagaacacggaatgctctggacaacctcgtcatgctgcacacctctgagcatggaggcaaggcctaccgccacgccgtggaggaactgcctgagacgatggaaaccctccttctgctgggcctcatgattctgcttacagggggagctatgctgtttctcatctccggcaaagggattggaaagaccagcatcggcctgatctgtgttattgcctcctctgggatgctgtggatggcggagatccccctccaatggattgccagcgctatcgtgcttgagttctttatgatggtgctgctgattcctgaacccgagaagcagagaacaccgcaggataatcaactcgcctatgtcgttatcggcattctgacccttgctgccacgatcgcggccaacgaaatgggcctgctcgagacaaccaaacgggacctgggcatgtccaaggaacctggggtggtgagccccacatcttacctggatgtcgacctccaccccgcttccgcctggaccctttacgctgtggccaccacagttatcacgcctatgctgcgccataccattgagaatagcacagctaacgtgtctctggccgcgatcgccaaccaggctgtcgtgctcatgggactggacaaaggctggccgattagcaagatggatcttggggtccccctgctcgccctgggatgctattcccaggtgaatcctctgaccctcacagctgccgttcttctgctgatcacccactacgccattatcggccccgggctccaggcgaaagctacgagagaggcccaaaagcggacagctgccggaatcatgaagaaccctaccgtggacggcattatgaccatcgatctggaccccgtcatttatgattctaaattcgaaaagcagcttggccaggtgatgctgctcgttctgtgtgccgtgcagctgctccttatgagaacaagctgggctctgtgcgaggccctgaccctcgcgacagggcctatcacgaccctgtgggaaggatccccgggcaaattttggaatacaaccattgccgtctctatggctaacatcttccgcgggagctaccttgccggagctggcctggccttttccatcatgaaaagcgtggggacaggaaaacggggcaccggctctcaaggggagacgctcggagaaaagtggaagaaaaagctgaatcagctgtccagaaaagagttcgacctctataagaaaagcggcattaccgaggtggatcgcacagaagcgaaggaggggcttaaacggggagaaatcacccatcacgccgtttccagaggctctgctaagctgcagtggtttgtcgagcggaacatggtgattcccgaagggcgcgtgatcgacctgggatgtggcagaggcgggtggagctactattgcgccggactcaagaaagtcacagaggttcggggctacaccaaagggggacctggccatgaggaacccgtgcctatgtccacatacgggtggaatattgtgaaactgatgtctggaaaggatgtcttctatcttcccccggagaaatgtgacaccctgctctgcgatatcggcgaaagctcccctagccccacggtggaggagtctcgcacaattagagttctgaagatggtggaaccctggctgaagaacaatcagttctgtatcaaagtcctcaacccttacatgcccaccgtgatcgagcaccttgaacggctgcaacgcaagcacggcgggatgctggttagaaatcctctctcccggaacagcacccatgagatgtattggatttctaatggaacaggcaacatcgtggcttccgtcaatatggtgagccgcctgcttctgaacagatttacgatgacccaccggagaccgacaattgaaaaagacgtggatctcggggccggaacccgccatgtcaacgctgagcccgagacacctaatatggacgttatcggcgaacggattaagagaatcaaagaggaacacaactctacctggcactacgacgatgagaatccctataagacatgggcctaccatgggagctatgaagtgaaggcgaccggatccgcctctagcatgatcaacggcgtggtcaaactgctgacgaagccttgggacgtggttcccatggtgacccagatggctatgacagataccacaccgttcggccagcaacgcgtctttaaagagaaggtggacacccggacgcctagatccatgcccgggacacgccgggttatgggaattaccgccgagtggctctggagaacactgggccgcaataaaaagcctcggctttgcaccagagaagagttcacgaagaaagtgcgcaccaacgctgccatgggggccgtctttacagaagagaatcagtgggatagcgcgaaggctgccgtggaagacgaggatttctggaaactggttgaccgggagagagaactccacaagctgggaaaatgtggctcctgcgtgtacaacatgatggggaagcgcgagaagaaacttggcgaatttggaaaagccaaaggctctagagctatctggtacatgtggctgggggcccggtatctcgagttcgaggctctgggatttctgaatgaagatcattggttcagccgcgagaactcctactctggcgtcgaaggggagggactccacaagctgggctatattcttagagacatcagcaaaattcccgggggcgccatgtacgcggatgacaccgccggatgggacacacggatcaccgaagatgacctgcataatgaggagaagatcacacagcagatggatcctgaacacagacaactcgctaacgccatttttaaactgacctatcagaataaggtggtcaaggtgcagcggcccacgccgacaggcaccgttatggacatcatttcccgcaaagatcagagagggtctggacaagtgggcacctacgggcttaacacattcaccaatatggaggctcagctgatccggcagatggaaggagagggcgtcctcagcaaggccgacctggaaaaccctcatctgcccgagaaaaagattacacagtggctcgagacgaaaggggtggaacgcctgaagagaatggcgatctccggcgatgactgcgtggttaagcccatcgatgaccggtttgccaacgcccttctggccctcaatgatatgggaaaagtgcgcaaggacattcctcaatggcagccgagcaaaggctggcatgattggcagcaggtccccttctgttctcaccatttccacgagctgatcatgaaggacgggagaaaacttgtggttccttgccggccccaagacgaactgattggacgcgctagaatctcccagggcgccgggtggagcctccgggagaccgcttgtctgggaaaggcctatgcgcagatgtggtctctgatgtactttcaccgcagagatctccggctggcctccaacgctatttgcagcgccgtgcctgtccattgggtgcccacatctcgcaccacatggtccatccacgcccatcaccaatggatgaccacggaagacatgcttaccgtctggaatagagtgtggattgaggataacccttggatggaggacaagacacccgttaccacatgggaaaatgtgccgtacctgggcaaacgggaggatcagtggtgtgggagcctcatcggcctgacctccagagctacgtgggcccagaacatccctacagcgattcagcaagtccgcagccttatcggaaatgaagagttcctggactatatgccctctatgaagcggtttagaaaagaggaagagagcgaaggcgctatttggtga

SEQ ID NO: 20787 - RNA, 9873 nt, synthetic construct
  misc_feature 1..9873: note = derived and/or modified CDS sequence (opt5) from DENV-3__FJ639790__SS-prME
  source 1..9873: mol_type = other RNA
accagcctgtgcctcatgatgatcctgcccgccgctcttgccttccacctgacatcccgggacggcgaacctcggatgattgtggggaagaatgaacgcggaaagtctctcctgtttaagacggcgagcggcatcaatatgtgtacccttattgctatggatctgggggaaatgtgcgacgatacagtgacctacaaatgtccgcacatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggatacccggacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacatcattggagtgctggagcagggcaaacggacgcttacccctcagcccatggagctgaagtactcttggaaaacatgggggaaggccaagatcgtcaccgccgaaacacaaaactccagcttcattatcgatggacctaatacccccgagtgcccgtctgcttccagagcgtggaacgtgtgggaagtggaggactatggctttggcgtcttcacaaccaatatctggctcaaactgcgcgaagtttacacgcagctgtgtgaccaccggcttatgagcgccgctgtgaaggatgagagagccgtgcacgccgacatggggtactggattgagtcccagaaaaacggatcttggaagctcgaaaaagctagcctgatcgaggtcaagacatgcacctggcctaagtcccataccctgtggtctaatggcgtgctcgaaagcgatatgattatccccaaatccctggccgggcctattagccagcacaactatcgccccggataccatacacaaaccgcgggcccttggcaccttgggaagctggagctcgactttaattattgcgagggaacgacagttgtgatcaccgaaaactgtggcacacggggcccctctctgagaaccacaaccgtctccgggaaactgatccacgagtggtgctgtcgcagctgcacgcttccgcctctccggtacatgggagaagatggctgttggtatgggatggagattagacccatctctgaaaaggaggagaatatggtgaaatccctggttagcgctggatctggcgaagtggacaacttcaccatgggggtcctgtgcctcgccattctgtttgaggaagtgatgcggggaaagttcggcaagaaacatatgatcgccggcgttttccttacatttgtgctgctcctgagcgggcagattacctggcgcgatatggctcacacactgatcatgattggatccaatgccagcgacagaatgggcatgggggtcacctaccttgcgctgatcgctacgttcaagatccagccctttctcgccctgggattctttctccggaaactgacatctagagagaaccttctgctcggcgtggggctggccatggctaccacactgcaacttcctgaagatattgagcagatggccaatggaatcgctctgggcctcatggccctgaagctcattacccagttcgagacctatcagctgtggacagcgcttatctccctgacgtgtagcaacaccatttttacactcaccgtggcctggcgcacagctaccctgatcctggccggcgtctcccttctgccggtttgccaatctagctccatgcggaaaacggactggctccccatgacagtggctgccatgggggtgcctcccctgcctctcttcatctttaatctgaaggatacccttaagagacgctcttggcccctgaacgaaggagtcatggccgtgggcctggttagcattctcgcttcctctctgcttagaaacgacgtgcctatggcggggcccctggtcgccggaggcctcctgatcgcttgttacgtgattaccgggacaagcgccgatctcaccgttgagaaagccgctgacgtgacatgggaagaggaagccgagcagacgggagtctcccataatctgatgatcaccgtggacgatgacggcacaatgcggattaaggatgacgagaccgaaaacatccttacagtcctgctgaaaaccgcgctcctgatcgtgagcggcattttcccgtactctatccctgctacgcttctggtttggcacacctggcagaagcagacacaacgctccggggtgctctgggatgtccccagccctcccgagacccagaaagccgaactggaggagggagtgtatagaattaagcagcagggcatctttgggaaaacacaagttggagtgggcgtccagaaggaaggggtgttccataccatgtggcacgtgacacggggagccgttctcacgtacaatggcaagcgcctggagccgaactgggcttctgtcaaaaaggaccttatttcctatggcgggggatggagactgagcgcccagtggcaaaaaggcgaagaggtccaggtgatcgcggtcgaacctgggaagaatcccaaaaactttcagaccatgcctggaacattccagaccaccacaggcgagattggggctatcgccctggatttcaagcccggaacgtctggctcccccatcattaatcgggagggcaaggtggttgggctctacggaaacggcgtggtcaccaaaaatgggggatatgtgagcggcatcgcccaaacaaacgctgaacctgacgggccgacccccgagctggaagaggaaatgtttaagaaacgcaatcttacaattatggatctgcaccctggctccggaaagaccagaaaatacctccccgccatcgttcgggaggctattaagcgcagactgcggacgctcatcctggcccctacaagagtggtcgcggccgagatggaagaggctcttaagggcctgcccatccgctatcagaccaccgccacaaaaagcgaacataccgggcgggagattgtggacctgatgtgccacgctacattcaccatgagactcctgtctcctgttcgcgtgccgaactacaatcttatcattatggatgaagcccattttacggaccccgccagcatcgctgcgcggggatacatttccacaagagtcggcatgggggaggccgctgccatcttcatgaccgccacacctcccggaaccgctgatgcctttcctcagtctaacgcgcccatccaggacgaggaacgcgacattccggagcggagctggaactccggcaacgaatggatcacggatttcgctgggaagaccgtgtggtttgtgccttctattaaagccggcaacgacatcgccaattgtctgagaaagaacggcaaaaaggtcattcaactcagccgcaagacattcgataccgagtatcagaaaacaaagctgaatgactgggattttgttgtgaccacagacatctccgagatgggagctaacttcaaagccgatcgggtgattgaccccagacggtgcctgaagcccgtcatcctcaccgatgggcctgaacgcgtgatccttgcgggacccatgcctgttacggccgcttctgccgctcagagacggggccgcgtggggagaaatccgcagaaagagaacgaccaatacatttttacaggacagcccctgaataacgatgaagaccacgcccattggaccgaggctaagatgctgctcgacaatatcaacacccctgaaggcattatccccgccctgttcgagcctgagcgggaaaagagcgcggccattgatggggagtatagacttaaaggcgaatcccgcaagacattcgtcgagctgatgcggagaggagacctccccgtgtggctggctcacaaagttgccagcgaaggcatcaagtacaccgatcgcaaatggtgctttgacgggcagcggaataaccagatcctggaggagaatatggatgtggaaatttggacaaaggagggagagaagaagaagctcagaccgcgctggcttgacgctcggacgtattctgatcctctggccctgaaagagttcaaggactttgccgctggcagaaaatccatcgcgctcgatctggtcaccgaaattgggcgcgtgcccacacaccttgcccatagaacccggaacgctctggacaatctcgtcatgctgcacacaagcgagcatggaggcaaggcctaccgccacgccgtggaggaactgcctgagaccatggaaacgctccttctgctgggcctcatgatcctgcttaccgggggagctatgctgttcctcatttctggcaaagggatcggaaagacatccatcggcctgatttgtgttatcgccagctccgggatgctgtggatggcggagattcccctccaatggatcgcctctgctattgtgcttgagtttttcatgatggtgctgctgatccctgaacccgagaagcagagaaccccgcaggataaccaactcgcctatgtcgttattggaatcctgacacttgctgccatcattgcggccaatgaaatgggcctgctcgagaccacgaaacgggacctgggcatgagcaaggaacctggggtggtgtcccccacaagctacctggatgtcgacctccaccccgcttctgcctggaccctttacgctgtggccacaaccgttatcacccctatgctgcgccatacaattgagaactccacggctaacgtgagcctggccgcgatcgccaatcaggctgtcgtgctcatgggactggacaaaggctggccgatttctaagatggatcttggggtccccctgctcgccctgggatgctatagccaggtgaaccctctgaccctcacagctgccgttcttctgctgatcacccactacgccatcattggccccgggctccaggcgaaagctacaagagaggcccaaaagcggaccgctgccggaatcatgaagaatcctacggtggacggcattatgacaatcgatctggaccccgtcatttatgattccaaatttgaaaagcagcttggccaggtgatgctgctcgttctgtgtgccgtgcagctgctccttatgagaacctcttgggctctgtgcgaggccctgaccctcgcgacagggcctatcaccacactgtgggaaggaagcccgggcaaattctggaacacgaccatcgccgtctccatggctaatatttttcgcgggtcttaccttgccggagctggcctggccttcagcatcatgaagtccgtggggacaggaaaacggggcaccggcagccaaggggagacactcggagaaaagtggaagaaaaagctgaaccagctgtctagaaaagagtttgacctctataagaaatccggcattaccgaggtggatcgcacggaagcgaaggaggggcttaaacggggagaaatcacccatcacgccgttagcagaggctccgctaagctgcagtggttcgtcgagcggaatatggtgattcccgaagggcgcgtgatcgacctgggatgtggcagaggcgggtggtcttactattgcgccggactcaagaaagtcacagaggttcggggctacaccaaagggggacctggccatgaggaacccgtgcctatgagcacatacgggtggaacattgtgaaactgatgtccggaaaggatgtcttttatcttcccccggagaaatgtgacaccctgctctgcgatatcggcgaatctagcccttcccccacagtggaggagagccgcaccatcagagttctgaagatggtggaaccctggctgaagaataaccagttctgtattaaagtcctcaatccttacatgcccacggtgatcgagcaccttgaacggctgcaacgcaagcacggcgggatgctggttagaaaccctctctctagaaattccacacatgagatgtattggattagcaacggaaccggcaatatcgtggcttctgtcaacatggtgtcccgcctgcttctgaacagattcaccatgacacaccggagaccgacgattgaaaaagacgtggatctcggggccggaacccgccatgtcaatgctgagcccgagacacctaacatggacgttatcggcgaacggatcaagagaattaaagaggaacacaatagcacctggcactacgacgatgagaacccctataagacatgggcctaccatgggtcttatgaagtgaaggcgaccggaagcgcctcctctatgatcaatggcgtggtcaaactgctgacaaagccttgggacgtggttcccatggtgacccagatggctatgacggataccacaccgtttggccagcaacgcgtcttcaaagagaaggtggacacccggacacctagaagcatgcccgggacccgccgggttatgggaattacggccgagtggctctggagaacactgggccgcaacaaaaagcctcggctttgcaccagagaagagtttacaaagaaagtgcgcaccaatgctgccatgggggccgtcttcacggaagagaaccagtgggattccgcgaaggctgccgtggaagacgaggatttttggaaactggttgaccgggagagagaactccacaagctgggaaaatgtggcagctgcgtgtacaatatgatggggaagcgcgagaagaaacttggcgagttcggaaaagccaaaggctccagagctatctggtacatgtggctgggggcccggtatctcgagtttgaggctctgggattcctgaacgaagatcattggttttctcgcgagaatagctactccggcgtcgaaggggagggactccacaagctgggctatattcttagagacatctctaaaatccccgggggcgccatgtacgcggatgacaccgccggatgggacacacggattaccgaagatgacctgcataacgaggagaagatcacacagcagatggatcctgaacacagacaactcgctaatgccattttcaaactgacctatcagaacaaggtggtcaaggtgcagcggcccacaccggctggcaccgttatggacatcattagccgcaaagatcagagagggtccggacaagtgggcacgtacgggcttaatacatttaccaacatggaggcccagctgatccggcagatggaaggagagggcgtcctctctaaggcggacctggaaaaccctcatctgcccgagaaaaagatcacccagtggctcgagacaaaaggggtggaacgcctgaagagaatggccattagcggcgatgactgcgtggttaagcccatcgatgaccggttcgctaatgcccttctggctctcaacgatatgggaaaagtgcgcaaggacattcctcaatggcagccgtccaaaggctggcatgattggcagcaggtccccttttgtagccaccatttccacgagctgatcatgaaggacgggagaaaacttgtggttccttgccggccccaagacgaactgattggacgcgccagaatctctcagggcgctgggtggtccctccgggagaccgcctgtctgggaaaggcgtatgcccagatgtggagcctgatgtacttccaccgcagagatctccggctggcttctaatgccatttgctccgccgtgcctgtccattgggtgcccacaagccgcacgacctggtctatccacgctcatcaccaatggatgacaaccgaagacatgcttacagtctggaacagagtgtggatcgaggataatccttggatggaggacaagacccccgttacgacctgggaaaacgtgccgtacctgggcaaacgggaggatcagtggtgtgggtccctcattggcctgacaagcagagccacctgggcgcagaatatccctacagctattcagcaagtccgctcccttatcggaaacgaagagtttctggactatatgcccagcatgaagcggttcagaaaagaggaagagtctgaaggcgccatttggtga

SEQ ID NO: 20788 - RNA, 9873 nt, synthetic construct
  misc_feature 1..9873: note = derived and/or modified CDS sequence (opt5) from DENV-3__FJ639791__SS-prME
  source 1..9873: mol_type = other RNA
accagcctgtgcctcatgatgatcctgcccgccgctcttgccttccacctgacgtcccgggacggcgaacctcggatgattgtggggaagaatgaacgcggaaagtctctcctgtttaagacggcgagcggcatcaatatgtgtacccttattgctatggatctgggggagatgtgcgacgatacagtcacctacaaatgtccgcacatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggatacccggacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccgttgagggcaaagtggtccagtatgaaaatctcaagtacacagtgattatcaccgttcatacaggggaccagcaccaggtgggaaacgagacgcaaggcgtcaccgctgaaatcacacctcaggcctctaccacagaggctattctgcccgaatatggcaccctggggctcgagtgctcccctcgcacgggactggacttcaatgagatgatccttctgaccatgaaaaacaaggcctggatggtgcatagacagtggtttttcgatctccccctgccgtggacaagcggcgccaccacagaaacccctacgtggaatcggaaagagcttctggtcacatttaagaacgctcacgcgaaaaagcaagaagtggttgtgctcgggtctcaggagggagccatgcacaccgctctgacaggcgccaccgaaattcaaaattccgggggcaccagcatcttcgccggacatctgaagtgtcgcctcaaaatggacaagctggagcttaaaggcatgtcttacgctatgtgcacaaacacgtttgtcctgaagaaagaggtgtccgaaacccagcacgggacaattctcatcaaggttgagtacaagggagaagatgtgccctgtaaaatccctttcagcaccgaggacggccaagggaaggcccataacggaagactgattacagcgaatcccgtcgtgaccaaaaaggaggaacccgtgaacatcgaggctgaacctccgttcggcgagtccaatattgttatcgggattggcgataacgccctgaaaatcaattggtataagaagggatctagcatcggcaaaatgtttgaagccacggctagaggggccagacgcatggctattcttggagacacagcctgggatttcggctccgtcgggggagtgctcaacagcctgggcaagatggtgcaccagatctttgggtctgcgtacaccgccctgttctccggcgtcagctgggtgatgaaaattggaatcggcgttctcctgacctggattgggcttaattctaagaacacaagcatgtccttttcttgcatcgctattggaatcatcaccctgtatctcggcgccgtggtccaggctgacatggggtgtgtgattaattggaaaggaaaggagctgaagtgcggcagcgggatcttcgttacaaacgaggtgcatacgtggaccgaacagtacaaatttcaagccgattcccccaagcggctggcgacagccattgctggcgcctgggagaatggagtctgtggcatcagaagcaccacacgcatggaaaaccttctctggaaacagattgctaatgagctgaactatatcctgtgggaaaataacatcaagctcaccgtggttgtgggggacattatcggagtcctggagcagggcaaacggacgcttacccctcagcccatggagctgaagtactcttggaaaacatgggggaaggccaagattgtgaccgccgaaacacaaaactccagcttcatcattgatggacctaatacccccgagtgcccgtctgcttccagagcgtggaacgtgtgggaagtcgaggactatggctttggcgttttcacaaccaatatctggctcaaactgcgcgaagtgtacacgcagctgtgtgaccaccggcttatgagcgccgctgtgaaggatgagagagccgtccacgccgacatggggtactggatcgagtcccagaaaaacggatcttggaagctcgaaaaagctagcctgattgaggtgaagacatgcacctggcctaagtcccataccctgtggtctaatggcgttctcgaaagcgatatgatcattcccaaatccctggccgggcctatcagccagcacaactatcgccccggataccatacacaaaccgcgggcccttggcaccttgggaagctggagctcgactttaattattgcgagggaacgacagtggtcattaccgaaaactgtggcacacggggcccctctctgagaaccacaaccgtgtccgggaaactgatccacgagtggtgctgtcgcagctgcacgcttccgcctctccggtacatgggagaagatggctgttggtatgggatggagatcagacccatttctgaaaaggaggagaatatggttaaatccctggtgagcgctggatctggcgaagtcgacaacttcaccatgggggtgctgtgcctcgccatcctgtttgaggaagttatgcggggaaagttcggcaagaaacatatgattgccggcgtgttctttacattcgtccttctgctcagcgggcagatcacctggcgcgatatggctcacacactgattatgatcggatccaatgccagcgacagaatgggcatgggggtgacctacctggcgcttattgctacgtttaagatccagcccttcctggccctcggatttttcctgcggaaactcacatctagagagaacctgcttctgggcgtggggctcgccatggctaccacactgcaactgcctgaagatatcgagcagatggccaatggaattgctcttggcctgatggccctcaagctgatcacccagtttgagatttatcagctctggaccgcgctgatctcccttacatgtagcaacacgattttcaccctgacagtcgcctggcgcaccgctacactcatcctggccggcgtttccctgcttccggtgtgccaatctagctccatgcggaaaaccgactggctgcccatgacggtggctgccatgggggtccctcccctccctctgtttatcttcaatctcaaggatacactgaagagacgctcttggccccttaacgaaggagtgatggccgttggcctggtgagcattctggcttcctctctcctgagaaacgacgtccctatggcggggccccttgtggccggaggcctgctcatcgcttgttacgttattaccgggaccagcgccgatctgacagtggagaaagccgctgacgtcacctgggaagaggaagccgagcagacaggagtgtcccataatctcatgatcacggtcgacgatgacggcaccatgcggattaaggatgacgagacagaaaacatcctgaccgtgcttctgaaaacagcgctgctcatcgttagcggcatttttccgtactctatccctgctaccctgcttgtgtggcacacgtggcagaagcagacccaacgctccggggtcctgtgggatgtgcccagccctcccgagacacagaaagccgaactcgaggagggagtttatagaattaagcagcagggcatcttcgggaaaacccaagtgggagtcggcgtgcagaaggaaggggtgtttcatacaatgtggcacgttacccggggagccgtcctgacatacaatggcaagcgcctcgagccgaactgggcttctgtgaaaaaggacctgatttcctatggcgggggatggagacttagcgcccagtggcaaaaaggcgaagaggtgcaggtcatcgcggtggaacctgggaagaatcccaaaaacttccagacgatgcctggaaccttccagacaaccaccggcgagattggggctatcgccctggattttaagcccggaacatctggctcccccatcattaatcgggagggcaaggttgtggggctgtacggaaacggcgtcgtgacgaaaaatgggggatatgttagcggcatcgcccaaaccaacgctgaacctgacgggccgacacccgagctcgaagaggaaatgttcaagaaacgcaatctgaccattatggatcttcaccctggctccggaaagacaagaaaatacctgcccgccatcgtgcgggaggctattaagcgcagactccggaccctgatcctcgcccctacgagagtcgtggcggccgagatggaagaggctctgaagggccttcccatccgctatcagacaaccgccaccaaaagcgaacatacagggcgggagattgttgacctgatgtgccacgctacctttacaatgagactgctctctcctgtgcgcgtcccgaactacaatctgatcattatggatgaagcccatttcaccgaccccgccagcatcgctgcgcggggatacatttccacgagagtgggcatgggggaggccgctgccatctttatgacagccacccctcccggaacagctgatgccttccctcagtctaacgcgcccatccaggacgaggaacgcgacattccggagcggagctggaactccggcaacgaatggatcaccgattttgctgggaagacggtgtggttcgtcccttctattaaagccggcaacgacatcgccaattgtcttagaaagaacggcaaaaaggttattcaactgagccgcaagacctttgatacagagtatcagaaaaccaagctcaatgactgggatttcgtggtgacaaccgacatctccgagatgggagctaactttaaagccgatcgggtcattgaccccagacggtgcctgaagcccgtgatcctgacagatgggcctgaacgcgttatcctcgcgggacccatgcctgtgaccgccgcttctgccgctcagagacggggccgcgtcgggagaaatccgcagaaagagaacgaccaatacattttcacgggacagccccttaataacgatgaagaccacgcccattggacagaggctaagatgctgctggacaatatcaacacccctgaaggcattatccccgccctcttcgagcctgagcgggaaaagagcgcggccattgatggggagtatagactgaaaggcgaatcccgcaagacctttgtggagcttatgcggagaggagacctgcccgtttggctcgctcacaaagtggccagcgaaggcatcaagtacacagatcgcaaatggtgcttcgacgggcagcggaataaccagatcctggaggagaatatggatgtcgaaatttggaccaaggagggagagaagaagaagctgagaccgcgctggctcgacgctcggacatattctgatcctcttgccctgaaagagtttaaggacttcgccgctggcagaaaatccatcgcgctggatctcgtgacggaaattgggcgcgtccccacccacctggcccatagaacacggaacgctcttgacaatctggtgatgctccacaccagcgagcatggaggcaaggcctaccgccacgccgttgaggaactgcctgagacaatggaaaccctgctccttctgggcctgatgatcctcctgacagggggagctatgctttttctgatttctggcaaagggatcggaaagacctccatcggcctcatttgtgtgatcgccagctccgggatgctgtggatggcggagattcccctgcaatggatcgcctctgctattgtgctcgagttctttatgatggtccttctgatccctgaacccgagaagcagagaacaccgcaggataaccaactggcctatgttgtgattggaatcctcaccctggctgccatcattgcggccaatgaaatgggccttctggagacaaccaaacgggacctcggcatgagcaaggaacctggggtggtctcccccacgagctacctggatgtggacctgcaccccgcttctgcctggacactctacgctgttgccaccacagtgatcacccctatgcttcgccataccattgagaactccacagctaacgtcagcctggccgcgatcgccaatcaggctgtggtcctgatgggactcgacaaaggctggccgatttctaagatggatctgggggtgccccttctggccctcggatgctatagccaggttaaccctctgacgctgaccgctgccgtgctccttctgatcacacactacgccatcattggccccgggctgcaggcgaaagctaccagagaggcccaaaagcggacagctgccggaatcatgaagaatcctaccgtcgacggcattatgacgatcgatctcgaccccgtgatttatgattccaaattcgaaaagcagctgggccaggttatgcttctggtgctctgtgccgtccagctgctgctcatgagaacatcttgggctctttgcgaggccctgaccctggcgaccgggcctatcacaaccctctgggaaggaagcccgggcaaattttggaacacaacgatcgccgtgtccatggctaatattttccgcgggtcttacctggccggagctggccttgcctttagcatcatgaagtccgtggggaccggaaaacggggcacaggcagccaaggggagaccctgggagaaaagtggaagaaaaagctcaaccagctgtctagaaaagagttcgacctgtataagaaatccggcattacagaggttgatcgcaccgaagcgaaggaggggctcaaacggggagaaatcacgcatcacgccgtcagcagaggctccgctaaacttcagtggtttgtggagcggaatatggtgattcccgaagggcgcgtcatcgacctgggatgtggcagaggcgggtggtcttactattgcgccggactgaagaaagttaccgaggtgcggggctacacaaaagggggacctggccatgaggaacccgtgcctatgagcacctacgggtggaacattgtcaaactcatctccggaaaggatgtgttctatctgcccccggagaaatgtgacacacttctgtgcgatatcggcgaatctagcccttcccccaccgttgaggagagccgcacaattagagtgctcaagatggtcgaaccctggctgaagaataaccagttctgtatcaaagtgctgaatccttacatgcccaccgttattgagcacctcgaacggcttcaacgcaagcacggcgggatgctggtgagaaaccctctgtctagaaattccacgcatgagatgtattggatcagcaacggatctggcaatattgtcgcttccgtgaacatggtgagccgcctcctgcttaacagatttacaatgacccaccggagaccgaccatcgaaaaagacgtcgatctgggggccggaacacgccatgttaatgctgagcccgagacgcctaacatggacgtgatcggcgaacggattaagagaatcaaagaggaacacaattctacctggcactacgacgatgagaacccctataagacatgggcctaccatgggagctatgaagtgaaggcgaccggatccgcctctagcatgattaatggcgtcgtgaaactcctgacaaagccttgggacgttgtgcccatggtcacccagatggctatgacagataccacgccgttcggccagcaacgcgtgtttaaagagaaggttgacacccggacacctagatccatgcccgggacccgccgggtgatgggaatcacagccgagtggctgtggagaaccctcggccgcaacaaaaagcctcggctgtgcacgagagaagagttcacaaagaaagtccgcaccaatgctgccatgggggccgtgtttacagaagagaaccagtgggatagcgcgaaggctgccgttgaagacgaggatttctggaaacttgtggaccgggagagagaactgcacaagctcggaaaatgtggctcctgcgtctacaatatgatggggaagcgcgagaaaaagctgggcgaatttggaaaggccaaaggctctagagctatttggtacatgtggcttggggcccggtatctggagttcgaggctctcggatttctgaacgaagatcattggttcagccgcgaaaattcctactctggcgtggagggggagggactgcacaagctcggctatatcctgagagacatcagcaaaattcccgggggcgccatgtacgcggatgacaccgccggatgggacacgcggatcaccgaagatgaccttcataacgaggagaagattacacagcagatggatcctgaacacagacaactggctaatgccatctttaaactcacctatcagaacaaggtcgtgaaggttcagcggcccacaccgaccggcacagtgatggacattatctcccgcaaagatcagagagggtctggacaagtcggcacctacgggctgaatacgttcacaaacatggaggctcagcttatccggcagatggaaggagagggcgtgctgagcaaggccgacctcgaaaaccctcatctgcccgagaaaaagattacccagtggctggagaccaaaggggtggaacgcctcaagagaatggcgatctccggcgatgactgcgttgtgaagcccattgatgaccggtttgccaatgctctgcttgccctgaacgatatgggaaaagtccgcaaggacatccctcaatggcagccgagcaaaggctggcatgattggcaacaggtgcccttctgttctcaccatttccacgagctcattatgaaggacgggagaaaactggttgtgccttgccggccccaagacgaacttatcggacgcgctagaatttcccagggcgccgggtggagcctgcgggagacagcttgtctcggaaaggcctatgcgcagatgtggtctctgatgtactttcaccgcagagatctgcggctcgcctccaatgctatctgcagcgccgtccctgtgcattgggtccccacctctcgcacaacgtggtccatccacgcccatcaccaatggatgaccacagaagacatgctgaccgtgtggaacagagtttggattgaggataatccttggatggaggacaagacacccgtgaccacgtgggaaaacgtcccgtaccttggcaaacgggaggatcagtggtgtgggagcctgatcggcctcacctccagagctacatgggcccagaatattcctaccgcgatccagcaagtgcgcagcctgattggaaacgaagagttccttgactatatgccctctatgaagcggtttagaaaagaggaagagagcgaaggcgctatctggtga

SEQ ID NO: 20789 - RNA, 9873 nt, synthetic construct
  misc_feature 1..9873: note = derived and/or modified CDS sequence (opt5) from DENV-3__FJ639792__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccagaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctcggggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacatcattggagtgctggagcagggcaaacggacgcttacccctcagcccatggagctgaagtactcttggaaaacatgggggaaggccaagatcgtcaccgccgaaacacaaaactccagcttcattatcgatggacctaatacccccgagtgcccgtctgcttccagagcgtggaacgtgtgggaagtggaggactatggctttggcgtcttcacaaccaatatctggctcaaactgcgcgaagtttacacgcagctgtgtgaccaccggcttatgagcgccgctgtgaaggatgagagagccgtgcacgccgacatggggtactggattgagtcccagaaaaacggatcttggaagctcgaaaaagctagcctgatcgaggtcaagacatgcacctggcctaagtcccataccctgtggtctaatggcgtgctcgaaagcgatatgattatccccaaatccctggccgggcctattagccagcacaactatcgccccggataccatacacaaaccgcgggcccttggcaccttgggaagctggagctcgactttaattattgcgagggaacgacagttgtgatcaccgaaaactgtggcacacggggcccctctctgagaaccacaaccgtctccgggaaactgatccacgagtggtgctgtcgcagctgcacgcttccgcctctccggtacatgggagaagatggctgttggtatgggatggagattagacccatctctgaaaaggaggagaatatggtgaaatccctggttagcgctggatctggcgaagtggacaacttcaccatgggggtcctgtgcctcgccattctgtttgaggaagtgatgcggggaaagttcggcaagaaacatatgatcgccggcgttttctttacattcgtgcttctgctcagcgggcagattacctggcgcgatatggctcacacactgatcatgattggatccaatgccagcgacagaatgggcatgggggtcacctacctggcgcttatcgctacgtttaagatccagcccttcctggccctcggatttttcctgcggaaactcacatctagagagaacctgcttctgggcgtggggctcgccatggctaccacactgcaactgcctgaagatattgagcagatggccaatggaatcgctcttggcctgatggccctcaagctgattacccagtttgagacctatcagctctggacagcgctgatctcccttacgtgtagcaacaccattttcacactgaccgtggcctggcgcacagctaccctcatcctggccggcgtctccctgcttccggtttgccaatctagctccatgcggaaaacggactggctgcccatgacagtggctgccatgggggtgcctcccctccctctgtttatcttctctctcaaggataccctgaagagacgcagctggccccttaatgaaggagtcatggccgtgggcctggtttccattctggcttctagcctcctgagaaacgacgtgcctatggcggggccccttgtcgccggaggcctgctcatcgcttgttacgtgattaccgggacatccgccgatctgaccgttgagaaagccgctgacgtgacatgggaagaggaagccgagcagacgggagtcagccataacctcatgatcaccgtggacgatgacggcacaatgcggattaaggatgacgagaccgaaaatatcctgacagtccttctgaaaaccgcgctgctcatcgtgtctggcatttttccgtactccatccctgctacgctgcttgtttggcacacctggcagaagcagacacaacgcagcggggtgctgtgggatgtcccctctcctcccgagacccagaaagccgaactcgaggagggagtgtatagaattaagcagcagggcatcttcgggaaaacacaagttggagtgggcgtccagaaggaaggggtgtttcataccatgtggcacgtgacacggggagccgttctgacgcacaacggcaagcgcctcgagccgaattgggcttccgtcaaaagagacctgattagctacggcgggggatggcggctttctgcccagtggcaaaagggcgaagaggtgcaggtgatcgcggtcgaacctgggaaaaaccccaagaatttccagaccatgcctggaacattccagaccaccacaggcgagattggggctatcgccctggattttaaacccggaacgtccggcagccccatcattaaccgcgagggcaaggtggttgggctgtatggaaatggcgtggtcaccaagaacgggggatacgtgtccggcatcgcccaaacaaatgctgaacctgacgggccgacccccgagctcgaagaggaaatgttcaaaaagagaaacctgacaattatggatcttcatcctggcagcggaaaaacccggaagtatctgcccgccatcgttcgcgaggctattaaaagacggctcagaacgctgatcctcgcccctacacgcgtggtcgcggccgagatggaagaggctctgaagggccttcccatccggtaccagaccaccgccacaaagtctgaacacaccgggagagagattgtggacctgatgtgccatgctacatttaccatgcgcctgctcagccctgttcgggtgccgaattataacctgatcattatggatgaagcccacttcacggaccccgcctccatcgctgcgagaggatacatttctacacgcgtcggcatgggggaggccgctgccatctttatgaccgccacacctcccggaaccgctgatgccttccctcagagcaatgcgcccatccaggacgaggaacgggacattccggagagatcctggaactctggcaatgaatggatcacggattttgctgggaaaaccgtgtggttcgtgcctagcattaaggccggcaacgacatcgccaactgtcttcgcaaaaatggaaagaaagtcattcaactgtcccggaagacatttgataccgagtaccagaagacaaaactcaacgactgggatttcgttgtgaccacagacatctctgagatgggcgctaattttaaggccgatagagtgattgacccccggcgctgcctgaaacccgtcatcctgaccgatgggcctgaaagagtgatcctcgcgggacccatgcctgttacggccgctagcgccgctcagcggcgcggcagagtggggcggaacccgcagaaggagaatgaccaatatattttcacaggacagccccttaacaatgatgaagaccatgcccactggaccgaggctaaaatgctgctggacaacatcaatacccctgaaggcattatccccgccctcttcgagcctgagagagaaaagtccgcggccattgatggggagtaccgcctgaagggcgaaagccggaaaacatttgtcgagcttatgagacgcggagacctgcccgtgtggctcgcttataaggttgcctctgaaggcatcaaatacaccgatcggaagtggtgcttcgacgggcagagaaacaatcagatcctggaggagaacatggatgtggaaatttggacaaaagagggagaaaagaaaaagctgcgcccgcggtggctcgacgctagaacgtattccgatcctcttgccctgaaggagtttaaagacttcgccgctggccgcaagagcatcgcgctggatctcgtcaccgaaattgggagagtgcccacacacctggcccatcggacccgcaatgctcttgacaacctggtcatgctccacacatctgagcatggaggcaaagcctacagacacgccgtggaggaactgcctgagaccatggaaacgctgctccttctgggcctgatgatcctcctgaccgggggagctatgctttttctgatttccggcaaggggatcggaaaaacaagcatcggcctcatttgtgttatcgcctcctctgggatgctgtggatggcggagattcccctgcaatggatcgccagcgctattgtgctcgagttctttatgatggtgcttctgatccctgaacccgagaagcagcggaccccgcaggataatcaactggcctatgtcgttattggaatcctcacactggctgccatcattgcggccaacgaaatgggccttctggagaccacgaagcgcgacctcggcatgtccaaagaacctggggtggtgagccccacatcttacctggatgtcgacctgcaccccgcttccgcctggaccctctacgctgtggccacaaccgttatcacccctatgcttagacatacaattgagaatagcacggctaacgtgtctctggccgcgatcgccaaccaggctgtcgtgctgatgggactcgacaagggctggccgattagcaaaatggatctgggggtcccccttctggccctcggatgctattcccaggtgaatcctctgaccctgacagctgccgttctccttctgatcacccactacgccatcattggccccgggctgcaggcgaaggctacacgggaggcccaaaaaagaaccgctgccggaatcatgaagaaccctacggtggacggcattatgacaatcgatctcgaccccgtcatttatgattctaagttcgaaaaacagctgggccaggtgatgcttctggttctctgtgccgtgcagctgctgctcatgcgcaccagctgggctctttgcgaggccctgaccctggcgacagggcctatcaccacactctgggaaggatccccgggcaagttttggaatacgaccatcgccgtctctatggctaacattttccgggggagctacctggccggagctggccttgccttttccatcatgaaaagcgtggggacaggaaagagaggcaccggctctcaaggggagacactgggagaaaaatggaagaagaaactcaatcagctgtcccgcaaggagttcgacctgtataaaaagagcggcattaccgaggtggatcggacggaagcgaaagaggggctcaagagaggagaaatcacccatcacgccgtttcccggggctctgctaaacttcagtggtttgtcgagcgcaacatggtgattcccgaagggagagtgatcgacctgggatgtggccggggcgggtggagctactattgcgccggactgaagaaggtcacagaggttcgcggctacaccaaagggggacctggccatgaggaacccgtgcctatgtccacatacgggtggaatattgtgaagctcatgtctggaaaagatgtcttctatctgcccccggagaagtgtgacacccttctgtgcgatatcggcgaaagctcccctagccccacagtggaggagtctagaaccatccgggttctcaaaatggtggaaccctggctgaagaacaatcagttctgtattaaggtcctgaacccttacatgcccacggtgatcgagcacctcgaacgccttcaaagaaaacacggcgggatgctggttcggaatcctctgtcccgcaacagcacacatgagatgtattggatttctaatggaaccggcaacatcgtggcttccgtcaatatggtgagcagactcctgcttaaccggtttaccatgacacacagacgcccgacgattgaaaaggacgtggatctgggggccggaacccggcatgtcaacgctgagcccgagacacctaatatggacgttatcggcgaaagaatcaaacgcattaaggaggaacacaactctacctggcactacgacgatgagaatccctataaaacatgggcctaccatgggagctatgaagtgaaggcgaccggatccgcctctagcatgatcaacggcgtggtcaagctcctgacaaaaccttgggacgtggttcccatggtgacccagatggctatgacggataccacaccgttcggccagcaacgggtctttaaggagaaagtggacaccagaacacctcgctccatgcccgggacccggagagttatgggaattacggccgagtggctgtggcgcacactcggccggaataagaaacctagactgtgcacccgcgaagagttcacaaagaaggtgcggaccaacgctgccatgggggccgtctttacggaagagaatcagtgggatagcgcgaaagctgccgtggaagacgaggatttctggaagcttgttgacagagagcgcgaactgcacaaactcggaaagtgtggctcctgcgtgtacaacatgatggggaaaagagagaagaaactgggcgaatttggaaaggccaagggctctcgggctatctggtacatgtggcttggggcccgctatctggagttcgaggctctcggatttctgaatgaagatcattggttcagcagagagaactcctactctggcgtcgaaggggagggactgcacaaactcggctatattctgcgggacatcagcaagatccccgggggcgccatgtacgcggatgacaccgccggatgggacacaagaattaccgaagatgaccttcataatgaggagaaaatcacacagcagatggatcctgaacaccggcaactggctaacgccatttttaagctcacctatcagaataaagtggtcaaggtgcagcgccccacaccgaccggcacggttatggacatcatttccagaaaggatcagcgggggtctggacaagtgggcacatacgggctgaacaccttcaccaatatggaggctcagcttatccgccagatggaaggagagggcgtcctgagcaaagccgacctcgaaaaccctcacctgcccgagaagaaaatcacacagtggctggagaccaagggggtggaaagactcaaacggatggcgatttccggcgatgactgcgtggttaagcccatcgatgaccgctttgccaacgctctgcttgccctgaatgatatgggaaaggtgagaaaagacattcctcaatggcagccgagcaagggctggcatgattggcagcaggtccccttctgttctcaccatttccacgagctcatcatgaaagacgggcggaagctggtggttccttgccgcccccaagacgaacttattggaagagctcggatctcccagggcgccgggtggagcctgcgcgagacagcttgtctcggaaaagcctatgcgcagatgtggtctctgatgtactttcacagacgggatctgcgcctcgcctccaacgctatttgcagcgccgtgcctgtccattgggtgcccacgtctagaaccacatggtccatccacgcccatcaccaatggatgaccacagaagacatgctgaccgtctggaatcgggtgtggatcgaggataacccttggatggaggacaagacgcccgttaccacatgggaaaatgtgccgtaccttggcaagagagaggatcagtggtgtgggagcctgattggcctcacctcccgcgctacatgggcccagaacatccctaccgcgattcagcaagtccggagcctgatcggaaatgaagagttccttgactatatgccctctatgaaaagatttcgcaaggaggaagagagcgaaggcgctatttggtga

SEQ ID NO: 20790 - RNA, 9873 nt, synthetic construct
  misc_feature 1..9873: note = derived and/or modified CDS sequence (opt5) from DENV-3__FJ639793__SS-prME
  source 1..9873: mol_type = other RNA
accagcctgtgcctcatgatgatcctgcccgccacacttgctttccacctgacgtcccgggacggcgagcctcggatgattgtggggaagaacgaacgcggaaagtctctcctgtttaagaccgccagcggcatcaatatgtgtacacttattgcgatggatctgggggaaatgtgcgacgataccgtgacatacaagtgtccgcacatcaccgaagttgagcccgaagacattgattgctggtgtaacctcacatccacctgggtgacgtatggaacctgcaatcaggctggcgagcaccggcgggacaagcgctctgtggccctggcccctcatgtcgggatgggactggatacaagaacccagacatggatgagcgctgagggcgcctggagacaggtggaaaaagttgagacctgggctctccgccaccccggcttcacgatcctggccctttttctggcgcattacatcgggacatccctcacccagaaggtggtcattttcatcctgcttatgctggtgacaccttctatgaccatgagatgtgttggagtgggcaaccgggactttgtcgaagggctcagcggagccacctgggtggatgtggtcctggagcacggcgggtgcgttacaacgatggctaagaataaacccaccctggacattgagctccagaagacagaagccacccaactggctacacttcgcaaactgtgtatcgagggaaagattaccaacatcacgacagattccagatgccctacccagggcgaagccgtgctcccggaggaacaggaccagaattatgtgtgtaaacacacctacgtcgatcggggctgggggaacggatgcggcctgttcgggaagggaagccttgtgacatgcgcgaagtttcaatgtctggagcccattgagggcaaagttgtgcagtatgaaaatctcaagtacaccgtcatcatcacagtgcatacgggggaccagcaccaggttggaaacgagacccaaggcgtgacagccgaaattacccctcaggcttctacaaccgaggccatcctgcccgaatatggcacgctggggctcgagtgctcccctcgcaccggactggacttcaatgagatgattcttctgacaatgaaaaacaaggcttggatggtccatagacagtggtttttcgatctccccctgccgtggaccagcggcgccacaaccgaaacgcctacatggaatcggaaagagcttctggtgacctttaagaacgcccacgctaaaaagcaagaagtcgtggttctcgggtctcaggagggagcgatgcacacagccctgaccggcgctaccgaaatccaaaattccgggggcacaagcattttcgccggacatctgaagtgtcgcctcaaaatggacaagctggagcttaaaggcatgtcttacgccatgtgcacgaacacctttgtgctgaagaaagaggtctccgaaacacagcacgggaccatcctcatcaaggtggagtacaagggagaagatgttccctgtaaaattcctttcagcacagaggacggccaagggaaggctcataacggaagactgatcaccgccaatcccgtggtcacgaaaaaggaggaacccgtgaacattgaggcggaacctccgttcggcgagtccaatatcgtgattgggatcggcgataacgctctgaaaatcaattggtataagaagggatctagcattggcaaaatgtttgaagccacagccagaggggctagacgcatggccatccttggagacaccgcttgggatttcggctccgttgggggagtcctcaacagcctgggcaagatggtgcaccagatttttgggtctgcctacaccgcgctgttctccggcgtgagctgggtcatgaaaatcggaattggcgtgctcctgacatggatcgggcttaattctaagaacaccagcatgtccttttcttgcattgccatcggaatcattacactgtatctcggcgctgttgtgcaggccgacatggggtgtgtcatcaattggaaaggaaaggagctgaagtgcggcagcgggattttcgtgacgaacgaggttcatacctggacagaacagtacaaatttcaagctgattcccccaagcggctggccaccgcgatcgccggcgcttgggagaatggagtgtgtggcattagaagcacaacccgcatggaaaaccttctctggaaacagatcgccaatgagctgaactatatcctgtgggaaaataacattaagctcacggtcgtggttggggacatcattggagtgctggagcagggcaaacggacccttacacctcagcccatggagctgaagtactcttggaaaacctgggggaaggctaagatcgtcacagccgaaacccaaaactccagcttcattatcgatggacctaatacacccgagtgcccgtctgcctccagagcttggaacgtgtgggaagtggaggactatggctttggcgtcttcaccacgaatatctggctcaaactgcgcgaagtttacacacagctgtgtgaccaccggcttatgagcgcggccgtgaaggatgagagagctgtgcacgccgacatggggtactggattgagtcccagaaaaacggatcttggaagctcgaaaaagccagcctgatcgaggtcaagacctgcacctggcctaagtcccatacactgtggtctaatggcgtgctcgaaagcgatatgattatccccaaatccctggctgggcctattagccagcacaactatcgccccggataccatacccaaacggccggcccttggcaccttgggaagctggagctcgactttaattattgcgagggaacaaccgttgtgatcacagaaaactgtggcacccggggcccctctctgagaacaaccacggtctccgggaaactgatccacgagtggtgctgtcgcagctgcacccttccgcctctccggtacatgggagaagatggctgttggtatgggatggagattagacccacatctgaaaaggaggagaatatggtgaaatccctggttagcgcgggatctggcgaagtggacaacttcaccatgggggtcctgtgcctcgctatcctgtttgaggaagtgatgcggggaaagttcggcaagaaacatatgattgccggcgttttctttacattcgtgcttctgctcagcgggcagatcacctggcgcgatatggcccacacgctgattatgatcggatccaatgctagcgacagaatgggcatgggggtcacatacctggcccttattgcgacctttaagatccagcccttcctggctctcggatttttcctgcggaaactcacatctagagagaacctgcttctgggcgtggggctcgccatggccaccaccctgcaactgcctgaagatatcgagcagatggctaatggaattgcccttggcctgatggctctcaagctgatcacacagtttgagacgtatcagctctggaccgccctgatttcccttacatgtagcaacaccatcttcacactgaccgtggcgtggcgcacggccacactcattctggctggcgtctccctgcttccggtttgccaatctagctccatgcggaaaaccgactggctgcccatgaccgtggccgctatgggggtgcctcccctccctctgtttatcttctctctcaaggatacactgaagagacgcagctggccccttaatgaaggagtcatggccgtgggcctggtttccatcctggcctctagcctcctgagaaacgacgtgcctatggctgggccccttgtcgcgggaggcctgctcattgcctgttacgtgatcaccgggacatccgctgatctgacggttgagaaagccgccgacgtgacctgggaagaggaagctgagcagacaggagtcagccataacctcatgattaccgtggacgatgacggcacaatgcggatcaaggatgacgagaccgaaaatattctgacggtccttctgaaaaccgccctgctcatcgtgtctggcatctttccgtactccattcctgcgacactgcttgtttggcacacctggcagaagcagacacaacgcagcggggtgctgtgggatgtcccctctcctcccgagacccagaaagctgaactcgaggagggagtgtatagaatcaagcagcagggcattttcgggaaaacacaagttggagtgggcgtccagaaggaaggggtgtttcatacgatgtggcacgtgacccggggagccgttctgacatacaacggcaagcgcctcgagccgaattgggcctccgtcaaaaaggacctgatcagctatggcgggggatggagactttctgctcagtggcaaaaaggcgaagaggtccaggtgattgccgtcgaacctgggaagaaccccaaaaatttccagaccatgcctggaaccttccagacaacgaccggcgagatcggggcgattgctctggattttaagcccggaacatccggcagccccatcatcaaccgggagggcaagattgtggggctgtacggaaatggcgttgtgaccaaaaacgggggatatgtctccggcatcgcccaaacaaatgccgaacctgacgggccgacccccgagctcgaagaggaaatgttcaagaaacgcaacctgacgattatggatcttcaccctggcagcggaaagacaagaaaatacctgcccgctatcgtgcgggaggccattaagcgcagactccggaccctgatcctcgctcctaccagagttgtggccgcggagatggaagaggccctgaagggccttcccatccgctatcagacaaccgctacaaaatctgaacataccgggcgggagattgtcgacctgatgtgccacgccacgtttacaatgagactgctcagccctgtgcgcgttccgaattacaacctgatcattatggatgaagctcatttcaccgaccccgcctccatcgccgctcggggatacatttctacaagagtgggcatgggggaggcggccgctatctttatgaccgccacgcctcccggaaccgccgatgctttccctcagagcaatgcccccatccaggacgaggaacgcgacattccggagcggtcctggaactctggcaatgaatggatcacagattttgcggggaagaccgtctggttcgtgcctagcattaaagctggcaacgacatcgccaactgtcttagaaagaatggcaaaaaggtgattcaactgtcccgcaagacatttgataccgagtatcagaaaacaaagctcaacgactgggatttcgtcgttaccacggacatctctgagatgggagccaattttaaagctgatcgggtgattgaccccagacggtgcctgaagcccgtgatcctgacagatgggcctgaacgcgtcatcctcgccggacccatgcctgtgaccgcggccagcgctgcccagagacggggccgcgttgggagaaacccgcagaaagagaatgaccaatacattttcaccggacagccccttaacaatgatgaagaccacgctcattggacagaggccaagatgctgctggacaacatcaatacccctgaaggcattatccccgctctcttcgagcctgagcgggaaaagtccgccgcgattgatggggagtatagactgaaaggcgaaagccgcaagacatttgtggagcttatgcggagaggagacctgcccgtctggctcgcccacaaagtggcttctgaaggcatcaagtacacggatcgcaaatggtgcttcgacgggcagcggaacaatcagatcctggaggagaacatggatgttgaaatttggaccaaggagggagagaagaagaagctgagaccgcgctggctcgacgcccggacatattccgatcctcttgctctgaaagagtttaaggacttcgccgccggcagaaaaagcatcgctctggatctcgtgaccgaaattgggcgcgtccccacacacctggcgcatagaacccggaatgcccttgacaacctggtgatgctccacacgtctgagcatggaggcaaggcttaccgccacgccgtcgaggaactgcctgagaccatggaaacactgctccttctgggcctgatgatcctcctgaccgggggagccatgctttttctgatttccggcaaagggatcggaaagacaagcatcggcctcatttgtgtgatcgcttcctctgggatgctgtggatggccgagattcccctgcaatggatcgcgagcgccattgttctcgagttctttatgatggtgcttctgatccctgaacccgagaagcagagaaccccgcaggataatcaactggcttatgtggtcattggaatcctcacgctggccgctatcattgccgcgaacgaaatgggccttctggagacaaccaaacgggacctcggcatgtccaaggaacctggggttgtgagccccacatcttacctggatgtggacctgcaccccgcctccgcttggaccctctacgccgtcgctaccacagtgatcacgcctatgcttcgccataccattgagaatagcacagccaacgtttctctggctgccatcgcgaaccaggccgtggtcctgatgggactcgacaaaggctggccgattagcaagatggatctgggggtgccccttctggctctcggatgctattcccaggtcaatcctctgaccctgacagccgctgtgctccttctgatcacccactacgccatcattggccccgggctgcaggccaaagcgacgagagaggctcaaaagcggacagccgctggaatcatgaagaaccctaccgttgacggcattatgaccatcgatctcgaccccgtgatttatgattctaaattcgaaaagcagctgggccaggtcatgcttctggtgctctgtgccgttcagctgctgctcatgagaacaagctgggccctttgcgaggctctgaccctggccacagggcctatcacgaccctctgggaaggatccccgggcaaattttggaatacaaccatcgcggtgtctatggccaacattttccgcgggagctacctggctggagccggccttgctttttccgtcatgaaaagcgtggggacaggaaaacggggcaccggctctcaaggggagacgctgggagaaaagtggaagaaaaagctcaatcagctgtccagaaaagagttcgacctgtataagaaaagcggcatcaccgaggtggatcgcacagaagccaaggaggggctcaaacggggagaaattacccatcacgcggtttccagaggctctgccaaacttcagtggtttgtcgagcggaacatggtgatccccgaagggcgcgtgattgacctgggatgtggcagaggcgggtggagctactattgcgctggactgaagaaagtcacagaggttcggggctacaccaaagggggacctggccatgaggaacccgtgcctatgtccacatacgggtggaatatcgtgaaactcatgtctggaaaggatgtcttctatctgcccccggagaaatgtgacacccttctgtgcgatattggcgaaagctcccctagccccacggtggaggagtctcgcacaatcagagttctcaagatggtggaaccctggctgaagaacaatcagttctgtatcaaagtcctgaacccttacatgcccaccgtgattgagcacctcgaacggcttcaacgcaagcacggcgggatgctggttagaaatcctctgtcccggaacagcacccatgagatgtattggatctctaatggaacaggcaacattgtggcctccgtcaatatggtgagccgcctcctgcttaacagatttacgatgacccaccggagaccgacaatcgaaaaagacgtggatctgggggctggaacccgccatgtcaacgccgagcccgagacacctaatatggacgttattggcgaacggatcaagagaatcaaagaggaacacaactctacctggcactacgacgatgagaatccctataagacatgggcttaccatgggagctatgaagtgaaggccaccggatccgcgtctagcatgattaacggcgtggtcaaactcctgacgaagccttgggacgtggttcccatggtgacccagatggccatgacagataccacaccgttcggccagcaacgcgtctttaaagagaaggtggacacccggacgcctagatccatgcccgggacacgccgggttatgggaatcaccgctgagtggctgtggagaacactcggccgcaataaaaagcctcggctgtgcaccagagaagagttcacgaagaaagtgcgcaccaacgccgctatgggggccgtctttacagaagagaatcagtgggatagcgccaaggcggctgtggaagacgaggatttctggaaacttgttgaccgggagagagaactgcacaagctcggaaaatgtggctcctgcgtgtacaacatgatggggaagcgcgagaaaaagctgggcgaatttggaaaggccaaaggctctagagccatttggtacatgtggcttggggctcggtatctggagttcgaggccctcggatttctgaatgaagatcattggttcagccgcgagaactcctactctggcgtcgaaggggagggactgcacaagctcggctatatcctgagagacattagcaaaatccccgggggcgctatgtacgccgatgacaccgcgggatgggacacacggatcaccgaagatgaccttcataatgaggagaagattacacagcagatggatcctgaacacagacaactggccaacgctatctttaaactcacctatcagaataaggtggtcaaggtgcagcggcccacgccgacaggcaccgttatggacattatctcccgcaaagatcagagagggtctggacaagtgggcacctacgggctgaacacattcaccaatatggaggcccagcttattcggcagatggaaggagagggcgtcctgagcaaggctgacctcgaaaaccctcatctgcccgagaaaaagatcacacagtggctggagacgaaaggggtggaacgcctcaagagaatggccatctccggcgatgactgcgtggttaagcccattgatgaccggtttgcgaacgccctgcttgctctgaatgatatgggaaaagtgcgcaaggacatccctcaatggcagccgagcaaaggctggcatgattggcagcaggtccccttctgttctcaccatttccacgagctcattatgaaggacgggagaaaactggtggttccttgccggccccaagacgaacttatcggacgcgccagaatttcccagggcgctgggtggagcctgcgggagaccgcctgtctcggaaaggcttatgcccagatgtggtctctgatgtactttcaccgcagagatctgcggctcgcgtccaacgccatctgcagcgctgtgcctgtccattgggtgcccacatctcgcaccacatggtccattcacgcccatcaccaatggatgaccacggaagacatgctgaccgtctggaatagagtgtggatcgaggataacccttggatggaggacaagacacccgttaccacatgggaaaatgtgccgtaccttggcaaacgggaggatcagtggtgtgggagcctgatcggcctcacctccagagccacgtgggctcagaacattcctacagccatccagcaagtccgcagcctgattggaaatgaagagttccttgactatatgccctctatgaagcggtttagaaaagaggaagagagcgaaggcgcgatctggtga

SEQ ID NO: 20791 - RNA, 9873 nt, synthetic construct
  misc_feature 1..9873: note = derived and/or modified CDS sequence (opt5) from DENV-3__FJ639795__SS-prME
  source 1..9873: mol_type = other RNA
acaagcctgtgcctcatgatgatcctgcccgccgctcttgccttccacctgacatcccgggacggcgagcctcggatgattgtggggaagaacgaacgcggaaagtctctcctgtttaagacggcgagcggcatcaatatgtgtacccttattgctatggatctgggggaaatgtgcgacgatacagtcacctacaaatgtccgcacatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggctagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacacgatcggagtgctggagcagggcaaacggacccttacacctcagcccatggagctgaagtactcttggaaaacctgggggaaggccaagattgtcacagccgaaacccaaaactccagcttcatcattgatggacctaatacacccgagtgcccgtctgcttccagagcgtggaacgtgtgggaagtggaggactatggctttggcgtcttcaccacgaatatctggctcaaactgcgcgaagtttacacacagctgtgtgaccaccggcttatgagcgccgctgtgaaggatgagagagccgtgcacgccgacatggggtactggatcgagtcccagaaaaacggatcttggaagctcgaaaaagctagcctgattgaggtcaagacctgcacctggcctaagtcccatacactgtggtctaatggcgtgctcgaaagcgatatgatcattcccaaatccctggccgggcctatcagccagcacaactatcgccccggataccatacccaaacggcgggcccttggcaccttgggaagctggagctcgactttaattattgcgagggaacaaccgttgtgattacagaaaactgtggcacccggggcccctctctgagaacaaccacggtctccgggaaactgatccacgagtggtgctgtcgcagctgcacccttccgcctctccggtacatgggagaagatggctgttggtatgggatggagatcagacccatttctgaaaaggaggagaatatggtgaaatccctggttagcgctggatctggcgaagtggacaacttcacaatgggggtcctgtgcctcgccatcctgtttgaggaagtgatgcggggaaagttcggcaagaaacatatgattgccggcgttttctttaccttcgtgcttctgctcagcgggcagatcacatggcgcgatatggctcacaccctgattatgatcggatccaatgccagcgacagaatgggcatggggattacgtacctggcgcttatcgctacatttaagatccagcccttcctggccctcggatttttcctgcggaaactcacctctagagagaacctgcttctgggcgtcgggctcgccatggctacaaccctgcaactgcctgaagatattgagcagatggccaatggaatcgctcttggcctgatggccctcaagctgattacccagtttgagacatatcagctctggacggcgctgatctcccttacctgtagcaacacaattttcaccctgacagtggcctggcgcaccgctacgctcatcctggccggcgtgtccctgcttccggtctgccaatctagctccatgcggaaaacagactggctgcccatgaccgttgctgccatgggggtgcctcccctccctctgtttatcttctctctcaaggataccctgaagagacgcagctggccccttaatgaaggagtgatggccgtcggcctggtgtccattctggcttctagcctcctgagaaacgacgttcctatggcggggccccttgtggccggaggcctgctcatcgcttgttacgtcattacagggacctccgccgatctgacagtggagaaagccgctgacgttacgtgggaagaggaagccgagcagaccggagtgagccataacctcatgatcacagtcgacgatgacggcaccatgcggattaaggatgacgagacagaaaatatcctgaccgtgcttctgaaaacggcgctgctcatcgtctctggcatttttccgtactccatccctgctaccctgcttgtgtggcacacatggcagaagcagacccaacgcagcggggttctgtgggatgtgccctctcctcccgagacacagaaagccgaactcgaggagggagtctatagaattaagcagcagggcatcttcgggaaaacccaagtgggagttggcgtgcagaaggaaggggtctttcatacaatgtggcacgtgacgcggggagccgtgctgacctacaacggcaagcgcctcgagccgaattgggcttccgttaaaaaggacctgattagctatggcgggggatggagactttctgcccagtggcaaaaaggcgaagaggtccaggtgatcgcggtggaacctgggaagaaccccaaaaatttccagacaatgcctggaaccttccagaccacaacgggcgagattggggctatcgccctggattttaagcccggaacctccggcagccccatcattaaccgggagggcaaggtcgtggggctgtacggaaatggcgttgtgaccaagaacgggggatatgtctccggcatcgcccaaaccaatgctgaacctgacgggccgacacccgagctcgaagaggaaatgttcaagaaacgcaacctgaccattatggatcttcaccctggcagcggaaagacgagaaaatacctgcccgccatcgtgcgggaggctattaagcgcagactccggacactgatcctcgcccctaccagagttgtggcggccgagatggaagaggctctgaagggccttcccatccgctatcagaccacagccaccaaatctgaacatacagggcgggagattgtcgacctgatgtgccacgctacctttacgatgagactgctcagccctgtgcgcgttccgaattacaacctgatcattatggatgaagcccatttcacagaccccgcctccatcgctgcgcggggatacatttctaccagagtgggcatgggggaggccgctgccatctttatgacagccacccctcccggaacggctgatgccttccctcagagcaatgcgcccatccaggacgaggaacgcgacattccggagcggtcctggaactctggcaatgaatggatcaccgattttgctgggaagacagtctggttcgtgcctagcattaaagccggcaacgacatcgccaactgtcttagaaagaatggcaaaaaggtgattcaactgtcccgcaagacctttgatacagagtatcagaaaaccaagctcaacgactgggatttcgtcgttacaaccgacatctctgagatgggagctaattttaaagccgatcgggtgattgaccccagacggtgcctgaagcccgtgatcctgacggatgggcctgaacgcgtcatcctcgcgggacccatgcctgtgacagccgctagcgccgctcagagacggggccgcgttgggagaaacccgcagaaagagaatgaccaatacattttcaccggacagccccttaacaatgatgaagaccacgcccattggaccgaggctaagatgctgctggacaacatcaatacacctgaaggcattatccccgccctcttcgagcctgagcgggaaaagtccgcggccattgatggggagtatagactgaaaggcgaaagccgcaagacctttgtggagcttatgcggagaggagacctgcccgtctggctcgctcacaaagtggcctctgaaggcatcaagtacacagatcgcaaatggtgcttcgacgggcagcggaacaatcagatcctggaggagaacatggatgttgaaatttggacgaaggagggagagaagaagaagctgagaccgcgctggctcgacgctcggacctattccgatcctcttgccctgaaagagtttaaggacttcgccgctggcagaaaaagcatcgcgctggatctcgtgacagaaattgggcgcgtccccacccacctggcccatagaacacggaatgctcttgacaacctggtgatgctccacacctctgagcatggaggcaaggcctaccgccacgccgtcgaggaactgcctgagacgatggaaaccctgctccttctgggcctgatgatcctcctgacagggggagctatgctttttctgatttccggcaaagggatcggaaagaccagcatcggcctcatttgtgtgatcgcctcctctgggatgctgtggatggcggagattcccctgcaatggatcgccagcgctattgttctcgagttctttatgatggtgcttctgatccctgaacccgagaagcagagaacaccgcaggataatcaactggcctatgtggtcattggaatcctcaccctggctgccacgatcgcggccaacgaaatgggccttctggagacaaccaaacgggacctcggcatgtccaaggaacctggggttgtgagccccacatcttacctggatgtggacctgcaccccgcttccgcctggaccctctacgctgtcgccaccacagtgattacgcctatgcttcgccataccatcgagaatagcacagctaacgtttctctggccgcgattgccaaccaggctgtggtcctgatgggactcgacaaaggctggccgatcagcaagatggatctgggggtgccccttctggccctcggatgctattcccaggtcaatcctctgaccctgacagctgccgtgctccttctgattacccactacgccatcatcggccccgggctgcaggcgaaagctacgagagaggcccaaaagcggacagctgccggaattatgaagaaccctaccgttgacggcatcatgaccattgatctcgaccccgtgatctatgattctaaattcgaaaagcagctgggccaggtcatgcttctggtgctctgtgccgttcagctgctgctcatgagaacaagctgggctctttgcgaggccctgaccctggcgacagggcctattacgaccctctgggaaggatccccgggcaaattttggaatacaaccatcgccgtgtctatggctaacatcttccgcgggagctacctggccggagctggccttgccttttccattatgaaaagcgtcgggacaggaaaacggggcaccggctctcaaggggagacgctgggagaaaagtggaagaaaaagctcaatcagctgtccagaaaagagttcgacctgtataagaaaagcggcatcaccgaggtggatcgcacagaagcgaaggaggggctcaaacggggagaaattacccatcacgccgtgtccagaggctctgctaaacttcagtggtttgttgagcggaacatggtcatccccgaagggcgcgtgattgacctgggatgtggcagaggcgggtggagctactattgcgccggactgaagaaagtgacagaggtccggggctacaccaaagggggacctggccatgaggaacccgttcctatgtccacatacgggtggaatatcgtgaaactcatgtctggaaaggatgtgttctatctgcccccggagaaatgtgacacccttctgtgcgatattggcgaaagctcccctagccccacggtcgaggagtctcgcacaatcagagtgctcaagatggttgaaccctggctgaagaacaatcagttctgtatcaaagtgctgaacccttacatgcccaccgtcattgagcacctcgaacggcttcaacgcaagcacggcgggatgctggtgagaaatcctctgtcccggaacagcacccatgagatgtattggatctctaatggaacaggcaacattgttgcttccgtgaatatggtcagccgcctcctgcttaacagatttacgatgacccaccggagaccgacaatcgaaaaagacgtggatctgggggccggaacccgccatgtgaacgctgagcccgagacacctaatatggacgtcattggcgaacggatcaagagaatcaaagaggaacacaactctacctggcactacgacgatgagaatccctataagacatgggcctaccatgggagctatgaagttaaggcgaccggatccgcctctagcatgattaacggcgtggtgaaactcctgacgaagccttgggacgtcgtgcccatggttacccagatggctatgacagataccacaccgttcggccagcaacgcgtgtttaaagagaaggtcgacacccggacgcctagatccatgcccgggacacgccgggtgatgggaatcaccgccgagtggctgtggagaacactcggccgcaataaaaagcctcggctgtgcaccagagaagagttcacgaagaaagttcgcaccaacgctgccatgggggccgtgtttacagaagagaatcagtgggatagcgcgaaggctgccgtcgaagacgaggatttctggaaacttgtggaccgggagagagaactgcacaagctcggaaaatgtggctcctgcgtttacaacatgatggggaagcgcgagaaaaagctgggcgaatttggaaaggccaaaggctctagagctatttggtacatgtggcttggggcccggtatctggagttcgaggctctcggatttctgaatgaagatcattggttcagccgcgagaactcctactctggcgtggaaggggagggactgcacaagctcggctatatcctgagagacattagcaaaatccccgggggcgccatgtacgcggatgacaccgccggatgggacacacggatcaccgaagatgaccttcataatgaggagaagattacacagcagatggatcctgaacacagacaactggctaacgccatctttaaactcacctatcagaataaggtcgtgaaggtccagcggcccacgccgacaggcaccgtgatggacattatctcccgcaaagatcagagagggtctggacaagttggcacctacgggctgaacacattcaccaatatggaggctcagcttattcggcagatggaaggagagggcgtgctgctcaaggccgacctggaaaaccctcatctgcccgagaaaaagatcacacagtggctcgagacgaaaggggtcgaacgcctgaagagaatggcgatcagcggcgatgactgcgtggtgaagcccattgatgaccggtttgccaacgcccttctggccctcaatgatatgggaaaagttcgcaaggacatccctcaatggcagccgtccaaaggctggcatgattggcaacaggtgcccttctgtagccaccatttccacgagctgattatgaaggacgggagaaaacttgtcgtgccttgccggccccaagacgaactgatcggacgcgctagaatttctcagggcgccgggtggtccctccgggagaccgcttgtctgggaaaggcctatgcgcagatgtggagcctgatgtactttcaccgcagagatctccggctggcctctaacgctatctgctccgccgttcctgtgcattgggtccccacaagccgcaccacatggtctattcacgcccatcaccaatggatgaccacggaagacatgcttaccgtgtggaatagagtctggatcgaggataacccttggatggaggacaagacacccgtgaccacatgggaaaatgttccgtacctgggcaaacgggaggatcagtggtgtgggtccctcatcggcctgaccagcagagctacgtgggcccagaacattcctacagcgatccagcaagtgcgctcccttattggaaatgaagagttcctggactatatgcccagcatgaagcggtttagaaaagaggaagagtctgaaggcgctatctggtga

SEQ ID NO: 20792 - RNA, 9873 nt, synthetic construct
  misc_feature 1..9873: note = derived and/or modified CDS sequence (opt5) from DENV-3__FJ639798__SS-prME
  source 1..9873: mol_type = other RNA
accagcctgtgcctcatgatgatcctgcccgccgctcttgccttccacctgacatcccgggacggagaacctcggatgattgtggggaagaacgaacgcggaaaatctctcctgtttaagacggcgagcggcatcaatatgtgtacccttattgctatggatctgggggaaatgtgcgacgatacagtcacctacaaatgtccgcacatcacagaagttgaacccgaagacattgattgctggtgtaacctcacctccacatgggtgacctatggaacgtgcaatcaggccggcgagcacagacgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccgttgagggcaaagtggtccagtatgaaaatctcaagtacacagtgattatcaccgttcatacaggggaccagcaccaggtgggaaacgagacgcaaggcgtcaccgctgaaatcacacctcaggcctctaccacagaggctattctgcccgaatatggcaccctggggctcgagtgctcccctcgcacgggactggacttcaatgagatgatccttctgaccatgaaaaacaaggcctggatggtgcatagacagtggtttttcgatctccccctgccgtggacaagcggcgccaccacagaaacccctacgtggaatcggaaagagcttctggtcacatttaagaacgctcacgcgaaaaagcaagaagtggttgtgctcgggtctcaggagggagccatgcacaccgctctgacaggcgccaccgaaattcaaaattccgggggcaccagcatcttcgccggacatctgaagtgtcgcctcaaaatggacaagctggagcttaaaggcatgtcttacgctatgtgcacaaacacgtttgtcctgaagaaagaggtgtccgaaacccagcacgggacaattctcatcaaggttgagtacaagggagaagatgtgccctgtaaaatccctttcagcaccgaggacggccaagggaaggcccataacggaagactgattacagcgaatcccgtcgtgaccaaaaaggaggaacccgtgaacatcgaggctgaacctccgttcggcgagtccaatattgttatcgggattggcgataacgccctgaaaatcaattggtataagaagggatctagcatcggcaaaatgtttgaagccacggctagaggggccagacgcatggctattcttggagacacagcctgggatttcggctccgtcgggggagtgctcaacagcctgggcaagatggtgcaccagatctttgggtctgcgtacaccgccctgttctccggcgtcagctgggtgatgaaaattggaatcggcgttctcctgacctggattgggcttaattctaagaacacaagcatgtccttttcttgcatcgctattggaatcatcaccctgtatctcggcgccgtggtccaggctgacatggggtgtgtgattaattggaaaggaaaggagctgaagtgcggcagcgggatcttcgttacaaacgaggtgcatacgtggaccgaacagtacaaatttcaagccgattcccccaagcggctggcgacagccattgctggcgcctgggagaatggagtctgtggcatcagaagcaccacacgcatggaaaaccttctctggaaacagattgctaatgagctgaactatatcctgtgggaaaataacatcaagctcaccgtggttgtgggggacattatcggagtcctggagcagggcaaacggacgcttacccctcagcccatggagctgaagtactcttggaaaacatgggggaaggccaagattgtgaccgccgaaacacaaaactccagcttcatcattgatggacctaatacccccgagtgcccgtctgcttccagagcgtggaacgtgtgggaagtcgaggactatggctttggcgttttcacaaccaatatctggctcaaactgcgcgaagtgtacacgcagctgtgtgaccaccggcttatgagcgccgctgtgaaggatgagagagccgtccacgccgacatggggtactggatcgagtcccagaaaaacggatcttggaagctcgaaaaagctagcctgattgaggtgaagacatgcacctggcctaagtcccataccctgtggtctaatggcgttctcgaaagcgatatgatcattcccaaatccctggccgggcctatcagccagcacaactatcgccccggataccatacacaaaccgcgggcccttggcaccttgggaagctggagctcgactttaattattgcgagggaacgacagtggtcattaccgaaaactgtggcacacggggcccctctctgagaaccacaaccgtgtccgggaaactgatccacgagtggtgctgtcgcagctgcacgcttccgcctctccggtacatgggagaagatggctgttggtatgggatggagatcagacccatttctgaaaaggaggagaatatggttaaatccctggtgagcgctggatctggcgaagtcgacaacttcaccatgggggtgctgtgcctcgccatcctgtttgaggaagttatgcggggaaagttcggcaagaaacatatgattgccggcgtgttctttacattcgtccttctgctcagcgggcagatcacctggcgcgatatggctcacacactgattatgatcggatccaatgccagcgacagaatgggcatgggggtgacctacctggcgcttattgctacgtttaagatccagcccttcctggccctcggatttttcctgcggaaactcacatctagagagaacctgcttctgggcgtggggctcgccatggctaccacactgcaactgcctgaagatatcgagcagatggccaatggaattgctcttggcctgatggccctcaagctgatcacccagtttgagacctatcagctctggacagcgctgatttcccttacgtgtagcaacaccatcttcacactgaccgtcgcctggcgcacagctaccctcattctggccggcgtttccctgcttccggtgtgccaatctagctccatgcggaaaacggactggctgcccatgacagtggctgccatgggggtccctcccctccctctgtttatcttctctctcaaggataccctgaagagacgcagctggccccttaatgaaggagtgatggccgttggcctggtgtccatcctggcttctagcctcctgagaaacgacgtccctatggcggggccccttgtggccggaggcctgctcattgcttgttacgttatcaccgggacatccgccgatctgaccgtggagaaagccgctgacgtcacatgggaagaggaagccgagcagacgggagtgagccataacctcatgattaccgtcgacgatgacggcacaatgcggatcaaggatgacgagaccgaaaatattctgacagtgcttctgaaaaccgcgctgctcatcgtttctggcatctttccgtactccattcctgctacgctgcttgtgtggcacacctggcagaagcagacacaacgcagcggggtcctgtgggatgtgccctctcctcccgagacccagaaagccgaactcgaggagggagtttatagaatcaagcagcagggcattttcgggaaaacacaagtgggagtcggcgtgcagaaggaaggggtgtttcataccatgtggcacgttacacggggagccgtcctgacgtacaacggcaagcgcctcgagccgaattgggcttccgtgaaaaaggacctgatcagctatggcgggggatggagactttctgcccagtggcaaaaaggcgaagaggtgcaggtcattgcggtggaacctgggaagaaccccaaaaatttccagaccatgcctggaacattccagaccaccacaggcgagatcggggctattgccctggattttaagcccggaacgtccggcagccccatcatcaaccgggagggcaaggttgtggggctgtacggaaatggcgtcgtgaccaaaaacgggggatatgtttccggcattgcccaaacaaatgctgaacctgacgggccgacccccgagctcgaagaggaaatgttcaagaaacgcaacctgacaatcatggatcttcaccctggcagcggaaagaccagaaaatacctgcccgccattgtgcgggaggctatcaagcgcagactccggacgctgattctcgcccctacaagagtcgtggcggccgagatggaagaggctctgaagggccttcccatccgctatcagaccaccgccacaaaatctgaacataccgggcgggagatcgttgacctgatgtgccacgctacatttaccatgagactgctcagccctgtgcgcgtcccgaattacaacctgattatcatggatgaagcccatttcacggaccccgcctccattgctgcgcggggatacatctctacaagagtgggcatgggggaggccgctgccatttttatgaccgccacacctcccggaaccgctgatgccttccctcagagcaatgcgcccatccaggacgaggaacgcgacatcccggagcggtcctggaactctggcaatgaatggattacggattttgctgggaagaccgtgtggttcgtccctagcatcaaagccggcaacgacattgccaactgtcttagaaagaatggcaaaaaggttatccaactgtcccgcaagacatttgataccgagtatcagaaaacaaagctcaacgactgggatttcgtggtgaccacagacatttctgagatgggagctaattttaaagccgatcgggtcatcgaccccagacggtgcctgaagcccgtgattctgaccgatgggcctgaacgcgttatcctcgcgggacccatgcctgtgacggccgctagcgccgctcagagacggggccgcgtcgggagaaacccgcagaaagagaatgaccaatacatcttcacaggacagccccttaacaatgatgaagaccacgcccattggaccgaggctaagatgctgctggacaacattaatacccctgaaggcatcattcccgccctcttcgagcctgagcgggaaaagtccgcggccatcgatggggagtatagactgaaaggcgaaagccgcaagacatttgtggagcttatgcggagaggagacctgcccgtttggctcgctcacaaagtggcctctgaaggcattaagtacaccgatcgcaaatggtgcttcgacgggcagcggaacaatcagatcctggaggagaacatggatgtcgaaatctggacaaaggagggagagaagaagaagctgagaccgcgctggctcgacgctcggacgtattccgatcctcttgccctgaaagagtttaaggacttcgccgctggcagaaaaagcattgcgctggatctcgtgaccgaaatcgggcgcgtccccacacacctggcccatagaacccggaatgctcttgacaacctggtgatgctccacacatctgagcatggaggcaaggcctaccgccacgccgttgaggaactgcctgagaccatggaaacgctgctccttctgggcctgatgattctcctgaccgggggagctatgctttttctgatctccggcaaagggattggaaagacaagcatcggcctcatctgtgtgattgcctcctctgggatgctgtggatggcggagatccccctgcaatggattgccagcgctatcgtgctcgagttctttatgatggtccttctgattcctgaacccgagaagcagagaaccccgcaggataatcaactggcctatgttgtgatcggcattctcacactggctgccaccatcgcggccaacgaaatgggccttctggagacgacaaaacgggacctcggcatgtccaaggaacctggggtggtcagccccacctcttacctggatgtggacctgcaccccgcttccgcctggacactctacgctgttgccaccaccgtgatcacacctatgcttcgccatacgattgagaatagcaccgctaacgtctctctggccgcgatcgccaaccaggctgtggtcctgatgggactcgacaaaggctggccgattagcaagatggatctgggggtgccccttctggccctcggatgctattcccaggttaatcctctgacactgaccgctgccgtgctccttctgatcacacactacgccattatcggccccgggctgcaggcgaaagctaccagagaggcccaaaagcggacggctgccggaatcatgaagaaccctacagtcgacggcattatgaccatcgatctcgaccccgtgatttatgattctaaattcgaaaagcagctgggccaggttatgcttctggtgctctgtgccgtccagctgctgctcatgagaaccagctgggctctttgcgaggccctgacactggcgaccgggcctatcacaacgctctgggaaggatccccgggcaaattttggaataccacaattgccgtgtctatggctaacatcttccgcgggagctacctggccggagctggccttgccttttccatcatgaaaagcgtggggaccggaaaacggggcacaggctctcaaggggagaccctgggagaaaagtggaagaaaaagctcaatcagctgtccagacgcgagttcgacctgtataaaaagagcggcattacggaggttgatcggaccgaagcgaaagaggggctcaagagaggagaaatcacacatcacgccgtctcccggggctctgctaaacttcagtggtttgtggagcgcaacatggtgattcccgaagggagagtcatcgacctgggatgtggccggggcgggtggagctactattgcgccggactgaagaaggttaccgaggtgcgcggctacacaaaagggggacctggccatgaggaacccgtgcctatgtccacctacgggtggaatattgtcaagctcatgtctggaaaagatgtgttctatctgcccccggagaagtgtgacacacttctgtgcgatatcggcgaaagctcccctagccccaccgttgaggagtctagaacgattcgggtgctcaaaatggtcgaaccctggctgaagaacaatcagttctgtatcaaggtgctgaacccttacatgcccacagttatcgagcacctcgaacgccttcaaagaaaacacggcgggatgctggtgcggaatcctctgtcccgcaacagcacccatgagatgtattggatttctaatggaaccggcaacatcgtcgcttccgtgaatatggtgagcagactcctgcttaaccggtttacaatgacgcacagacgcccgaccattgaaaaggacgtcgatctgggggccggaacacggcatatcaacgctgagcccgagacccctaatatggacgttattggcgaaagaatcaaacgcatcaaggaggaacacaactctacatggcactacgacgaggaaaatccctataaaacctgggcctaccatgggagctatgaggtgaaggcgacaggatccgcctctagcatgattaacggcgtggtcaagctcctgaccaaaccttgggatgtggttcccatggtgacgcagatggctatgaccgacacaaccccgttcggccagcaacgggtctttaaggagaaagtggatacaagaacccctcgccccatgcctgggacgcggagagttatgggaatcacagccgaatggctgtggcgcaccctcggccggaataagaaacccagactgtgcacacgcgaggagttcaccaagaaggtgcggacgaacgctgccatgggggccgtctttaccgaggaaaatcagtgggactccgcgaaagctgccgtggaggatgaggacttctggaaacttgttgatagagaacgcgagctgcacaaactcggaaagtgtggcagctgcgtgtacaacatgatggggaaaagagaaaagaaactgggcgagtttggaaaggccaagggctcccgggctatttggtacatgtggcttggggcccgctatctggagttcgaagctctcggatttctgaatgaggaccattggttctctagagaaaacagctactccggcgtcgagggggaaggactgcacaaactcggctatatcctgcgggatatttctaagatccctgggggcgccatgtacgcggacgatacagccggatgggacaccagaatcacagaggacgatcttcataatgaggagaagattacccagcagatggaccccgagcaccggcaactggctaacgccatctttaagctcacatatcagaataaagtggtcaaggtgcagcgcccgacccctacgggcacagttatggatattatcagcagaaaggaccagcgggggtccggacaagtgggcacctacgggctgaacaccttcacaaatatggaagctcagcttattcgccagatggagggagaaggcgtcctgtctaaagccgatctcgagaacccccatctgcccgagaagaaaatcacccagtggctggaaacaaagggggtggagagactcaaacggatggcgatcagcggcgacgattgcgtggttaagcctattgacgatcgctttgccaacgctctgcttgccctgaatgacatgggaaaggtgagaaaagatatcccgcaatggcagccctccaagggctggcatgactggcagcaggtccctttctgtagccaccatttccacgaactcattatgaaagatgggcggaagctggtggttccctgccgccctcaagacgagcttatcggacgggctcggatttctcagggcgccgggtggtccctgcgcgaaacggcttgtctcggaaaagcctatgcgcagatgtggagcctgatgtactttcacagacgggacctgcgcctcgcctctaacgctatctgctccgccgtgcccgtccattgggtgcctaccagcagaacaacctggtctattcacgcccatcaccaatggatgacaaccgaggatatgctgacggtctggaatcgggtgtggatcgaggacaacccctggatggaagataagaccccggttacaacctgggagaatgtgccttaccttggcaagagagaagaccagtggtgtgggtccctgatcggcctcacaagccgcgctacctgggcccagaacattcccacggcgatccagcaagtccggtccctgattggaaatgaggagttccttgattatatgcctagcatgaaaagatttcgcaaggaagaggaatctgagggcgctatctggtga

SEQ ID NO: 20793 - RNA, 9873 nt, synthetic construct
  misc_feature 1..9873: note = derived and/or modified CDS sequence (opt5) from DENV-3__FJ639799__SS-prME
  source 1..9873: mol_type = other RNA
accagcctgtgcctcatgatgatcctgcccgccgctcttgccttccacctgacatccagagacggagagcctcggatgattgtggggaagaacgaacgcggaaaatctctcctgtttaagacggcgagcggaatcaatatgtgtacccttattgctatggatctgggggaaatgtgcgacgatacagtcacctacaaatgtccgcacatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacagacctggatgagcgccgagggcgcttggcggcaagtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacgtgaccacggattccagatgccctacacagggcgaagcggtgctcccggaggaacaggaccagaattatgtctgtaaacacacctacgtggatcggggctgggggaacggatgcggcctgttcgggaagggaagccttgttacctgcgccaagtttcaatgtctggagcccatcgagggcaaagtggtccagtatgaaaatctcaagtacacagtgattatcaccgttcatacaggggaccagcaccaggtgggaaacgagacgcaaggcgtcaccgctgaaatcacacctcaggcctctaccacagaggctattctgcccgaatatggcaccctggggctcgagtgctcccctcgcacgggactggacttcaatgagatgatccttctgaccatgaaaaacaaggcctggatggtgcatagacagtggtttttcgatctccccctgccgtggacaagcggcgccaccacagaaacccctacgtggaatcggaaagagcttctggtcacatttaagaacgctcacgcgaaaaagcaagaagtggttgtgctcgggtctcaggagggagccatgcacaccgctctgacaggcgccaccgaaattcaaaattccgggggcaccagcatcttcgccggacatctgaagtgtcgcctcaaaatggacaagctggagcttaaaggcatgtcttacgctatgtgcacaaacacgtttgtcctgaagaaagaggtgtccgaaacccagcacgggacaattctcatcaaggttgagtacaagggagaagatgtgccctgtaaaatccctttcagcaccgaggacggccaagggaaggcccataacggaagactgattacagcgaatcccgtcgtgaccaaaaaggaggaacccgtgaacatcgaggctgaacctccgttcggcgagtccaatattgttatcgggattggcgataacgccctgaaaatcaattggtataagaagggatctagcatcggcaaaatgtttgaagccacggctagaggggccagacgcatggctattcttggagacacagcctgggatttcggctccgtcgggggagtgctcaacagcctgggcaagatggtgcaccagatctttgggtctgcgtacaccgccctgttctccggcgtcagctgggtgatgaaaattggaatcggcgttctcctgacctggattgggcttaattctaagaacacaagcatgtccttttcttgcatcgctattggaatcatcaccctgtatctcggcgccgtggtccaggctgacatggggtgtgtgattaattggaaaggaaaggagctgaagtgcggcagcgggatcttcgttacaaacgaggtgcatacgtggaccgaacagtacaaatttcaagccgattcccccaagcggctggcgacagccattgctggcgcctgggagaatggagtctgtggcatcagaagcaccacacgcatggaaaaccttctctggaaacagattgctaatgagctgaactatatcctgtgggaaaataacatcaagctcaccgtggttgtgggggacattatcggagtcctggagcagggcaaacggacgcttacccctcagcccatggagctgaagtactcttggaaaacatgggggaaggccaagattgtgaccgccgaaacacaaaactccagcttcatcattgatggacctaatacccccgagtgcccgtctgcttccagagcgtggaacgtgtgggaagtcgaggactatggctttggcgttttcacaaccaatatctggctcaaactgcgcgaagtgtacacgcagctgtgtgaccaccggcttatgagcgccgctgtgaaggatgagagagccgtccacgccgacatggggtactggatcgagtcccagaaaaacggatcttggaagctcgaaaaagctagcctgattgaggtgaagacatgcacctggcctaagtcccataccctgtggtctaatggcgttctcgaaagcgatatgatcattcccaaatccctggccgggcctatcagccagcacaactatcgccccggataccatacacaaaccgcgggcccttggcaccttgggaagctggagctcgactttaattattgcgagggaacgacagtggtcattaccgaaaactgtggcacacggggcccctctctgagaaccacaaccgtgtccgggaaactgatccacgagtggtgctgtcgcagctgcacgcttccgcctctccggtacatgggagaagatggctgttggtatgggatggagatcagacccatttctgaaaaggaggagaatatggttaaatccctggtgagcgctggatctggcgaagtcgacaacttcaccatgggggtgctgtgcctcgccatcctgtttgaggaagttatgcggggaaagttcggcaagaaacatatgattgccggcgtgttctttacattcgtccttctgctcagcgggcagatcacctggcgcgatatggctcacacactgattatgatcggatccaatgccagcgacagaatgggcatgggggtgacctacctggcgcttattgctacgtttaagatccagcccttcctggccctcggatttttcctgcggaaactcacatctagagagaacctgcttctgggcgtggggctcgccatggctaccacactgcaactgcctgaagatatcgagcagatggccaatggaattgctcttggcctgatggccctcaagctgatcacccagtttgagacctatcagctctggacagcgctgatttcccttacgtgtagcaacaccatcttcacactgaccgtcgcctggcgcacagctaccctcattctggccggcgtttccctgcttccggtgtgccaatctagctccatgcggaaaacggactggctgcccatgacagtggctgccatgggggtccctcccctccctctgtttatcttctctctcaaggataccctgaagagacgcagctggccccttaatgaaggagtgatggccgttggcctggtgtccatcctggcttctagcctcctgagaaacgacgtccctatggcggggccccttgtggccggaggcctgctcattgcttgttacgttatcaccgggacatccgccgatctgaccgtggagaaagccgctgacgtcacatgggaagaggaagccgagcagacgggagtgagccataacctcatgattaccgtcgacgatgacggcacaatgcggatcaaggatgacgagaccgaaaatattctgacagtgcttctgaaaaccgcgctgctcatcgtttctggcatctttccgtactccattcctgctacgctgcttgtgtggcacacctggcagaagcagacacaacgcagcggggtcctgtgggatgtgccctctcctcccgagacccagaaagccgaactcgaggagggagtttatagaatcaagcagcagggcattttcgggaaaacacaagtgggagtcggcgtgcagaaggaaggggtgtttcataccatgtggcacgttacacggggagccgtcctgacgtacaacggcaagcgcctcgagccgaattgggcttccgtgaaaaaggacctgatcagctatggcgggggatggagactttctgcccagtggcaaaaaggcgaagaggtgcaggtcattgcggtggaacctgggaagaaccccaaaaatttccagaccatgcctggaacattccagaccaccacaggcgagatcggggctattgccctggattttaagcccggaacgtccggcagccccatcatcaaccgggagggcaaggttgtggggctgtacggaaatggcgtcgtgaccaaaaacgggggatatgtttccggcattgcccaaacaaatgctgaacctgacgggccgacccccgagctcgaagaggaaatgttcaagaaacgcaacctgacaatcatggatcttcaccctggcagcggaaagaccagaaaatacctgcccgccattgtgcgggaggctatcaagcgcagactccggacgctgattctcgcccctacaagagtcgtggcggccgagatggaagaggctctgaagggccttcccatccgctatcagaccaccgccacaaaatctgaacataccgggcgggagatcgttgacctgatgtgccacgctacatttaccatgagactgctcagccctgtgcgcgtcccgaattacaacctgattatcatggatgaagcccatttcacggaccccgcctccattgctgcgcggggatacatctctacaagagtgggcatgggggaggccgctgccatttttatgaccgccacacctcccggaaccgctgatgccttccctcagagcaatgcgcccatccaggacgaggaacgcgacatcccggagcggtcctggaactctggcaatgaatggattacggattttgctgggaagaccgtgtggttcgtccctagcatcaaagccggcaacgacattgccaactgtcttagaaagaatggcaaaaaggttatccaactgtcccgcaagacatttgataccgagtatcagaaaacaaagctcaacgactgggatttcgtggtgaccacagacatttctgagatgggagctaattttaaagccgatcgggtcatcgaccccagacggtgcctgaagcccgtgattctgaccgatgggcctgaacgcgttatcctcgcgggacccatgcctgtgacggccgctagcgccgctcagagacggggccgcgtcgggagaaacccgcagaaagagaatgaccaatacatcttcacaggacagccccttaacaatgatgaagaccacgcccattggaccgaggctaagatgctgctggacaacattaatacccctgaaggcatcattcccgccctcttcgagcctgagcgggaaaagtccgcggccatcgatggggagtatagactgaaaggcgaaagccgcaagacatttgtggagcttatgcggagaggagacctgcccgtttggctcgctcacaaagtggcctctgaaggcattaagtacaccgatcgcaaatggtgcttcgacgggcagcggaacaatcagatcctggaggagaacatggatgtcgaaatctggacaaaggagggagagaagaagaagctgagaccgcgctggctcgacgctcggacgtattccgatcctcttgccctgaaagagtttaaggacttcgccgctggcagaaaaagcattgcgctggatctcgtgaccgaaatcgggcgcgtccccacacacctggcccatagaacccggaatgctcttgacaacctggtgatgctccacacatctgagcatggaggcaaggcctaccgccacgccgttgaggaactgcctgagaccatggaaacgctgctccttctgggcctgatgattctcctgaccgggggagctatgctttttctgatctccggcaaagggattggaaagacaagcatcggcctcatctgtgtgattgcctcctctgggatgctgtggatggcggagatccccctgcaatggattgccagcgctatcgtgctcgagttctttatgatggtccttctgattcctgaacccgagaagcagagaaccccgcaggataatcaactggcctatgttgtgatcggcattctcacactggctgccatcatcgcggccaacgaaatgggccttctggagaccacgaaacgggacctcggcatgtcccgcgaacctggggtggtcagccccacatcttacctggatgtggacctgcaccccgcttccgcctggaccctctacgctgttgccacaaccgtgattacccctatgcttagacatacaatcgagaatagcacggctaacgtctctctggccgcgattgccaaccaggctgtggtcctgatgggactcgacaagggctggccgatcagcaaaatggatctgggggtgccccttctggccctcggatgctattcccaggttaatcctctgaccctgacagctgccgtgctccttctgattacccactacgccatcatcggccccgggctgcaggcgaaggctacacgggaggcccagaaacggaccgctgccggaattatgaagaaccctacggtcgacggcatcatgacaattgatctcgaccccgtgatctatgattctaagttcgaaaaacagctgggccaggttatgcttctggtgctctgtgccgtccagctgctgctcatgcgcaccagctgggctctttgcgaggccctgaccctggcgacagggcctattaccacactctgggaaggatccccgggcaagttttggaatacgaccatcgccgtgtctatggctaacatcttccgggggagctacctggccggagctggccttgccttttccattatgaaaagcgtggggacaggaaagagaggcaccggctctcaaggggagacactgggagaaaaatggaagaagaaactcaatcagctgtcccgcaaggagttcgacctgtataaaaagagcggcatcaccgaggttgatcggacggaagcgaaagaggggctcaagagaggagaaattacccatcacgccgtctcccggggctctgctaaacttcagtggtttgtggagcgcaacatggtgatccccgaagggagagtcattgacctgggatgtggccggggcgggtggagctactattgcgccggactgaagaaggttacagaggtgcgcggctacaccaaagggggacctggccatgaggaacccgtgcctatgtccacatacgggtggaatatcgtcaagctcatgtctggaaaagatgtgttctatctgcccccggagaagtgtgacacccttctgtgcgatattggcgaaagctcccctagccccacagttgaggagtctagaaccatccgggtgctcaaaatggtcgaaccctggctgaagaacaatcagttctgtatcaaggtgctgaacccttacatgcccgctgttattgagcacctcgaacgccttcaaagaaaacacggcgggatgctggtgcggaatcctctgtcccgcaacagcacgcatgagatgtattggatctctaatggaacaggcaacattgtcgcctccgtgaatatggtgagcagactcctgcttaaccggtttaccatgacccacagacgcccgacaatcgaaaaggacgtcgatctgggggctggaacgcggcatgttaacgccgagcccgagacccctaatatggacgtgattggcgaaagaatcaaacgcatcaaggaggaacacaactctacatggcactacgacgatgagaatccctataaaacctgggcgtaccatgggagctatgaagtgaaggccacaggatccgcttctagcatgattaacggcgtcgtgaagctcctgaccaaaccttgggacgttgtgcccatggtcacacagatggccatgaccgatacgaccccgttcggccagcaacgggtgtttaaggagaaagttgacacaagaacccctcgctccatgcccgggacacggagagtgatgggaatcaccgctgagtggctgtggcgcacgctcggccggaataagaaacctagactgtgcacacgcgaagagttcaccaagaaggtccggacaaacgccgccatgggggcggtgtttaccgaagagaatcagtgggatagcgctaaagccgccgttgaagacgaggatttctggaaacttgtggacagagagcgcgaactgcacaaactcggaaagtgtggctcctgcgtctacaacatgatggggaaaagagagaagaaactgggcgaatttggaaaggctaagggctctcgggccatttggtacatgtggcttggggctcgctatctggagttcgaggccctcggatttctgaatgaagatcattggttcagcagagagaactcctactctggcgtggaaggggagggactgcacaaactcggctatatcctgcgggacattagcaagatccccgggggcgcgatgtacgccgatgacacggctggatgggacaccagaatcacagaagatgaccttcataatgaggagaaaattacccagcagatggatcctgaacaccggcaactggccaacgctatctttaagctcacatatcagaataaagtcgtgaaggttcagcgccccaccccgacaggcaccgtgatggacattatctccagaaaggatcagcgggggtctggacaagtcggcacgtacgggctgaacacattcaccaatatggaggcccagcttattcgccagatggaaggagagggcgtgctgagcaaagcggacctcgaaaaccctcatctgcccgagaagaaaatcacccagtggctggagacaaagggggtggaaagactcaaacggatggccatctccggcgatgactgcgttgtgaagcccattgatgaccgctttgctaacgccctgcttgctctgaatgatatgggaaaggtcagaaaagacatccctcaatggcagccgagcaagggctggcatgattggcaacaggtgcccttctgttctcaccatttccacgagctcattatgaaagacgggcggaagctggttgtgccttgccgcccccaagacgaacttatcggcagagcccggatttcccagggcgctgggtggagcctgcgcgagaccgcctgtctcggaaaagcgtatgcccagatgtggtctctgatgtactttcacagacgggatctgcgcctcgcttccaacgccatctgcagcgccgtccctgtgcattgggtccccacatctagaacgacctggtccattcacgctcatcaccaatggatgacaaccgaagacatgctgacagtgtggaatcgggtttggatcgaggataacccttggatggaggacaagacccccgtgacgacctgggaaaatgtcccgtaccttggcaagagagaggatcagtggtgtgggagcctgatcggcctcacatcccgcgccacctgggcgcagaacattcctacagctatccagcaagtgcggagcctgattggaaatgaagagttccttgactatatgccctctatgaaaagatttcgcaaggaggaagagagcgaaggcgccatctggtga

SEQ ID NO: 20794 - RNA, 9873 nt, synthetic construct
  misc_feature 1..9873: note = derived and/or modified CDS sequence (opt5) from DENV-3__FJ639800__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaagtgcagaattccgggggcaccagcatcttcgccggacatctgaagtgtcgcctcaaaatggacaagctggagcttaaaggcatgtcttacgctatgtgcacaaacacgtttgtcctgaagaaagaggtgtccgaaacccagcacgggacaattctcatcaaggttgagtacaagggagaagatgtgccctgtaaaatccctttcagcaccgaggacggccaagggaaggcccataacggaagactgattacagcgaatcccgtcgtgaccaaaaaggaggaacccgtgaacatcgaggctgaacctccgttcggcgagtccaatattgttatcgggattggcgataacgccctgcggatcaattggtataaaaagggatctagcatcggcaagatgtttgaagccacggctagaggggcccgccggatggctattcttggagacacagcctgggatttcggctccgtcgggggagtgctcaacagcctgggcaaaatggtgcaccagatctttgggtctgcgtacaccgccctgttctccggcgtcagctgggtgatgaagattggaatcggcgttctcctgacctggattgggcttaattctaaaaacacaagcatgtccttttcttgcatcgctattggaatcatcaccctgtatctcggcgccgtggtccaggctgacatggggtgtgtgattaattggaagggaaaagagctgaagtgcggcagcgggatcttcgttacaaacgaggtgcatacgtggaccgaacagtacaagtttcaagccgattcccccaaaagactggcgacagccattgctggcgcctgggagaatggagtctgtggcatccgcagcaccacacggatggaaaaccttctctggaagcagattgctaatgagctgaactatatcctgtgggaaaataacatcaaactcaccgtggttgtgggggacacgattggagtcctggagcagggcaagagaacccttacacctcagcccatggagctgaaatactcttggaagacctgggggaaagccaagatcgtgacagccgaaacccaaaactccagcttcattatcgatggacctaatacacccgagtgcccgtctgcttcccgcgcgtggaacgtgtgggaagtcgaggactatggctttggcgttttcaccacgaatatttggctcaagctgcgggaagtgtacacacagctgtgtgaccacagacttatgagcgccgctgtgaaagatgagcgcgccgtccacgccgacatggggtactggatcgagtcccagaagaacggatcttggaaactcgaaaaggctagcctgatcgaggtgaaaacctgcacctggcctaagtcccatacactgtggtctaatggcgttctcgaaagcgatatgattatccccaagtccctggccgggcctattagccagcacaactatcggcccggataccatacccaaacggcgggcccttggcaccttgggaaactggagctcgactttaattattgcgagggaacaaccgtggtcatcacagaaaactgtggcaccagaggcccctctctgcgcacaaccacggtgtccgggaagctgattcacgagtggtgctgtcggagctgcacccttccgcctctcagatacatgggagaagatggctgttggtatgggatggagatccggcccatctctgaaaaagaggagaatatggttaagtccctggtgagcgctggatctggcgaagtcgacaacttcacaatgggggtgctgtgcctcgccattctgtttgaggaagttatgcgcggaaaattcggcaagaagcatatgatcgccggcgtgttctttaccttcgtccttctgctcagcgggcagattacatggagagatatggctcacaccctgatcatgattggatccaatgccagcgaccggatgggcatgggggtgacgtacctggcgcttatcgctacatttaaaattcagcccttcctggccctcggatttttcctgagaaagctcacctctcgcgagaacctgcttctgggcgtggggctcgccatggctacaaccctgcaactgcctgaagatatcgagcagatggccaatggaatcgctcttggcctgatggccctcaaactgattacccagtttgagacatatcagctctggacggcgctgatctcccttacctgtagcaacacaattttcaccctgacagtcgcctggcggaccgctacgctcatcctggccggcgtttccctgcttccggtgtgccaatctagctccatgagaaagacagactggctgcccatgaccgtggctgccatgggggtccctcccctccctctgtttattttcaatctcaaagataccctgaagcgcagatcttggccccttaacgaaggagtgatggccgttggcctggtgagcatcctggcttcctctctcctgcggaacgacgtccctatggcggggccccttgtggccggaggcctgctcatcgcttgttacgttattacagggaccagcgccgatctgacagtggagaaggccgctgacgtcacgtgggaagaggaagccgagcagaccggagtgtcccataatctcatgatcacagtcgacgatgacggcaccatgcgcattaaagatgacgagacagaaaacatcctgaccgtgcttctgaagacggcgctgctcattgttagcggcatctttccgtactctatccctgctaccctgcttgtgtggcacacatggcagaaacagacccaaagatccggggtcctgtgggatgtgcccagccctcccgagacacagaaggccgaactcgaggagggagtttatcggattaaacagcagggcatcttcgggaagacccaagtgggagtcggcgtgcagaaagaaggggtgtttcatacaatgtggcacgttacgcgcggagccgtcctgacctacaatggcaagagactcgagccgaactgggcttctgtgaagaaagacctgatttcctatggcgggggatggcggcttagcgcccagtggcaaaagggcgaagaggtgcaggtcatcgcggtggaacctgggaaaaatcccaagaacttccagacaatgcctggaaccttccagaccacaacgggcgagattggggctatcgccctggattttaaacccggaacctctggctcccccattatcaatcgcgagggcaaggttgtggggctgtacggaaacggcgtcgtgacaaagaatgggggatatgttagcggcatcgcccaaaccaacgctgaacctgacgggccgacacccgagctcgaagaggaaatgttcaaaaagagaaatctgaccattatggatcttcaccctggctccggaaaaacgcggaagtacctgcccgccatcgtgcgcgaggctattaaaagacggctcagaacactgatcctcgcccctacccgcgtcgtggcggccgagatggaagaggctctgaagggccttcccattcggtatcagaccacagccaccaagagcgaacatacagggagagagatcgttgacctgatgtgccacgctacctttacgatgcgcctgctctctcctgtgcgggtcccgaactacaatctgatcattatggatgaagcccatttcacagaccccgccagcatcgctgcgagaggatacatttccacccgcgtgggcatgggggaggccgctgccatctttatgacagccacccctcccggaacggctgatgccttccctcagtctaacgcgcccattcaggacgaggaacgggacatcccggagagaagctggaattccggcaacgaatggatcaccgattttgctgggaaaacagtgtggttcgtcccttctattaaggccggcaacgacatcgccaattgtcttcgcaaaaacggaaagaaagttattcaactgagccggaagacctttgatacagagtatcagaagaccaaactcaatgactgggatttcgtggtgacaaccgacatctccgagatgggcgctaactttaaggccgatagagtcattgacccccggcgctgcctgaaacccgtgatcctgacggatgggcctgaaagagttattctcgcgggacccatgcctgtgacagccgcttctgccgctcagcggcgcggcagagtcgggcggaatccgcagaaggagaacgaccaatacatcttcaccggacagccccttaataacgatgaagaccacgcccattggaccgaggctaaaatgctgctggacaatatcaacacacctgaaggcattatccccgccctcttcgagcctgagagagaaaagagcgcggccattgatggggagtatcgcctgaagggcgaatcccggaaaacctttgtggagcttatgagacgcggagacctgcccgtttggctcgctcacaaggtggccagcgaaggcatcaaatacacagatcggaagtggtgcttcgacgggcagagaaataaccagattctggaggagaatatggatgtcgaaatctggacgaaagagggagaaaagaaaaagctgcgcccgcggtggctcgacgctagaacctattctgatcctcttgccctgaaggagtttaaagacttcgccgctggccgcaagtccatcgcgctggatctcgtgacagaaattgggagagtccccacccacctggcccatcggacacgcaacgctcttgacaatctggtgatgctccacaccagcgagcatggaggcaaagcctacagacacgccgttgaggaactgcctgagacgatggaaaccctgctccttctgggcctgatgatcctcctgacagggggagctatgctttttctgatttctggcaaggggatcggaaaaacctccattggcctcatctgtgtgatcgccagctccgggatgctgtggatggcggagattcccctgcaatggatcgcctctgctattgtgctcgagttctttatgatggtccttctgatccctgaacccgagaagcagcggacaccgcaggataaccaactggcctatgttgtgattggaatcctcaccctggctgccattatcgcggccaatgaaatgggccttctggagacgacaaagcgcgacctcggcatgagcaaagaacctggggtggtctcccccaccagctacctggatgtggacctgcaccccgcttctgcctggacactctacgctgttgccaccaccgtgatcacacctatgcttagacatacgattgagaactccaccgctaacgtcagcctggccgcgatcgccaatcaggctgtggtcctgatgggactcgacaagggctggccgatttctaaaatggatctgggggtgccccttctggccctcggatgctatagccaggttaaccctctgacactgaccgctgccgtgctccttctgatcacacactacgccattatcggccccgggctgcaggcgaaggctacccgggaggcccaaaaaagaacggctgccggaatcatgaagaatcctacagtcgacggcattatgaccatcgatctcgaccccgtgatttatgattccaagttcgaaaaacagctgggccaggttatgcttctggtgctctgtgccgtccagctgctgctcatgcgcacctcttgggctctttgcgaggccctgacactggcgaccgggcctatcacaacgctctgggaaggaagcccgggcaagttttggaacaccacaattgccgtgtccatggctaatatcttccgggggtcttacctggccggagctggccttgcctttagcatcatgaaatccgtggggaccggaaagagaggcacaggcagccaaggggagaccctgggagaaaaatggaagaagaaactcaaccagctgtctcgcaaggagttcgacctgtataaaaagtccggcattacggaggttgatcggaccgaagcgaaagaggggctcaagagaggagaaatcacacatcacgccgtcagccggggctccgctaaacttcagtggtttgtggagcgcaatatggtgattcccgaagggagagtcatcgacctgggatgtggccggggcgggtggtcttactattgcgccggactgaagaaggttaccgaggtgcgcggctacacaaaagggggacctggccatgaggaacccgtgcctatgagcacctacgggtggaacattgtcaagctcatgtccggaaaagatgtgttctatctgcccccggagaagtgtgacacacttctgtgcgatatcggcgaatctagcccttcccccaccgttgaggagagcagaacgattcgggtgctcaaaatggtcgaaccctggctgaagaataaccagttctgtatcaaggtgctgaatccttacatgcccacagttatcgagcacctcgaacgccttcaaagaaaacacggcgggatgctggtgcggaaccctctgtctcgcaattccacccatgagatgtattggattagcaacggatctggcaatatcgtcgcttccgtgaacatggtgagcagactcctgcttaaccggtttaccatgacacacagacgcccgacgattgaaaaggacgtcgatctgggggccggaacccggcatgttaatgctgagcccgagacacctaacatggacgtgatcggcgaaagaattaaacgcatcaaggaggaacacaattctacctggcactacgacgatgagaacccctataaaacatgggcctaccatgggagctatgaagtgaaggcgaccggatccgcctctagcatgatcaatggcgtcgtgaagctcctgacaaaaccttgggacgttgtgcccatggtcacccagatggctatgacggataccacaccgttcggccagcaacgggtgtttaaggagaaagttgacaccagaacacctcgctccatgcccgggacccggagagtgatgggaattacggccgagtggctgtggcgcacactcggccggaacaagaaacctagactgtgcacccgcgaagagttcacaaagaaggtccggaccaatgctgccatgggggccgtgtttacggaagagaaccagtgggatagcgcgaaagctgccgttgaagacgaggatttctggaagcttgtggacagagagcgcgaactgcacaaactcggaaagtgtggctcctgcgtctacaatatgatggggaaaagagagaagaaactgggcgaatttggaaaggccaagggctctcgggctatctggtacatgtggcttggggcccgctatctggagttcgaggctctcggatttctgaacgaagatcattggttcagcagagagaattcctactctggcgtggaaggggagggactgcacaaactcggctatattctgcgggacatcagcaagattcccgggggcgccatgtacgcggatgacaccgccggatgggacacaagaatcaccgaagatgaccttcataacgaggagaaaatcacacagcagatggatcctgaacaccggcaactggctaatgccatttttaagctcacctatcagaacaaagtcgtgaaggttcagcgccccacaccgaccggcacggtgatggacatcatttccagaaaggatcagcgggggtctggacaagtcggcacatacgggctgaataccttcaccaacatggaggctcagcttatccgccagatggaaggagagggcgtgctgagcaaagccgacctcgaaaaccctcacctgcccgagaagaaaattacacagtggctggagaccaagggggtggaaagactcaaacggatggcgatctccggcgatgactgcgttgtgaagcccatcgatgaccgctttgccaatgctctgcttgccctgaacgatatgggaaaggtcagaaaagacattcctcaatggcagccgagcaagggctggcatgattggcagcaggtgcccttctgttctcaccatttccacgagctcatcatgaaagacgggcggaagctggttgtgccttgccgcccccaagacgaacttattggaagagctcggatctcccagggcgccgggtggagcctgcgcgagacagcttgtctcggaaaagcctatgcgcagatgtggtctctgatgtactttcacagacgggatctgcgcctcgcctccaatgctatttgcagcgccgtccctgtgcattgggtccccacgtctagaaccacatggtccatccacgcccatcaccaatggatgaccacagaagacatgctgaccgtgtggaaccgggtttggattgaggataatccttggatggaggacaagacgcccgtgaccacatgggaaaacgtcccgtaccttggcaagagagaggatcagtggtgtgggagcctgatcggcctcacctcccgcgctacatgggcccagaatatccctaccgcgattcagcaagtgcggagcctgatcggaaacgaagagttccttgactatatgccctctatgaaaagatttcgcaaggaggaagagagcgaaggcgctatttggtga

SEQ ID NO: 20795 - RNA, 9873 nt, synthetic construct
  misc_feature 1..9873: note = derived and/or modified CDS sequence (opt5) from DENV-3__FJ639801__SS-prME
  source 1..9873: mol_type = other RNA
acaagcctgtgcctcatgatgatcctgcccgccgctcttgccttccacctgacatcccgggacggagagcctcggatgattgtggggaagaacgaacgcggaaaatctctcctgtttaagacggcgagcggcatcaatatgtgtacccttattgctatggatctgggggaaatgtgcgacgatacagtgacctacaaatgtccgcacatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacacgatcggagtgctggagcagggcaaacggacccttacacctcagcccatggagctgaagtactcttggaaaacctgggggaaggccaagattgtcacagccgaaacccaaaactccagcttcatcattgatggacctaatacacccgagtgcccgtctgcttccagagcgtggaacgtgtgggaagtggaggactatggctttggcgtcttcaccacgaatatctggctcaaactgcgcgaagtttacacacagctgtgtgaccaccggcttatgagcgccgctgtgaaggatgagagagccgtgcacgccgacatggggtactggatcgagtcccagaaaaacggatcttggaagctcgaaaaagctagcctgattgaggtcaagacctgcacctggcctaagtcccatacactgtggtctaatggcgtgctcgaaagcgatatgatcattcccaaatccctggccgggcctatcagccagcacaactatcgccccggataccatacccaaacggcgggcccttggcaccttgggaagctggagctcgactttaattattgcgagggaacaaccgttgtgattacagaaaactgtggcacccggggcccctctctgagaacaaccacggtctccgggaaactgatccacgagtggtgctgtcgcagctgcacccttccgcctctccggtacatgggagaagatggctgttggtatgggatggagatcagacccatttctgaaaaggaggagaatatggtgaaatccctggttagcgctggatctggcgaagtggacaacttcacaatgggggtcctgtgcctcgccatcctgtttgaggaagtgatgcggggaaagttcggcaagaaacatatgattgccggcgttttctttaccttcgtgcttctgctcagcgggcagatcacatggcgcgatatggctcacaccctgattatgatcggatccaatgccagcgacagaatgggcatgggggtcacgtacctggcgcttattgctacatttaagatccagcccttcctggccctcggatttttcctgcggaaactcacctctagagagaacctgcttctgggcgtggggctcgccatggctacaaccctgcaactgcctgaagatatcgagcagatggccaatggaattgctcttggcctgatggccctcaagctgatcacccagtttgagacatatcagctctggacggcgctgatttcccttacctgtagcaacacaatcttcaccctgacagtggcctggcgcaccgctacgctcattctggccggcgtctccctgcttccggtttgccaatctagctccatgcggaaaacagactggctgcccatgaccgtggctgccatgggggtgcctcccctccctctgtttatcttctctctcaaggataccctgaagagacgcagctggccccttaatgaaggagtcatggccgtgggcctggtttccatcctggcttctagcctcctgagaaacgacgtgcctatggcggggccccttgtcgccggaggcctgctcattgcttgttacgtgatcacagggacctccgccgatctgacagttgagaaagccgctgacgtgacgtgggaagaggaagccgagcagaccggagtcagccataacctcatgattacagtggacgatgacggcaccatgcggatcaaggatgacgagacagaaaatattctgaccgtccttctgaaaacggcgctgctcatcgtgtctggcatctttccgtactccattcctgctaccctgcttgtttggcacacatggcagaagcagacccaacgcagcggggtgctgtgggatgtcccctctcctcccgagacacagaaagccgaactcgaggagggagtgtatagaatcaagcagcagggcattttcgggaaaacccaagttggagtgggcgtccagaaggaaggggtgtttcatacaatgtggcacgtgacgcggggagccgttctgacctgcaacggcaagcgcctcgagccgaattgggcttccgtcaaaaaggacctgatcagctacggcgggggatggagactttctgcccagtggcaaaaaggcgaagaggtccaggtgattgcggtcgaacctgggaagaaccccaaaaatttccagacaatgcctggaaccttccagaccacaacgggcgagatcggggctattgccctggattttaagcccggaacctccggcagccccatcatcaaccgggagggcaaggtggttgggctgtatggaaatggcgtggtcaccaagaacgggggatacgtgtccggcattgcccaaaccaatgctgaacctgacgggccgacacccgagctcgaagaggaaatgttcaagaaacgcaacctgaccatcatggatcttcaccctggcagcggaaagacgagaaaatatctgcccgccattgttcgggaggctatcaagcgcagactccggacactgattctcgcccctaccagagtggtcgcggccgagatggaagaggctctgaagggccttcccatccgctaccagaccacagccaccaaatctgaacatacagggcgggagatcgtggacctgatgtgtcacgctacctttacgatgagactgctcagccctgttcgcgtgccgaattataacctgattatcatggatgaagcccatttcacagaccccgcctccattgctgcgcggggatacatctctaccagagtcggcatgggggaggccgctgccatttttatgacagccacccctcccggaacggctgatgccttccctcagagcaatgcgcccatccaggacgaggaacgcgacatcccggagcggtcctggaactctggcaatgaatggattaccgattttgctgggaagacagtgtggttcgtgcctagcatcaaagccggcaacgacattgccaactgccttagaaagaatggcaaaaaggtcatccaactgtcccgcaagacctttgatacagagtaccagaaaaccaagctcaacgactgggatttcgttgtgacaaccgacatttctgagatgggagctaattttaaagccgatcgggtgatcgaccccagacggtgcctgaagcccgtcattctgacggatgggcctgaacgcgtgatcctcgcgggacccatgcctgttacagccgctagcgccgctcagagacggggccgcgtggggagaaacccgcagaaagagaatgaccaatatatcttcaccggacagccccttaacaatgatgaagaccacgcccattggaccgaggctaagatgctgctggacaacattaatacacctgaaggcatcattcccgccctcttcgagcctgagcgggaaaagtccgcggccatcgatggggagtacagactgaaaggcgaaagccgcaagacctttgtcgagcttatgcggagaggagacctgcccgtgtggctcgctcacaaagttgcctctgaaggcattaagtatacagatcgcaaatggtgtttcgacgggcagcggaacaatcagatcctggaggagaacatggatgtggaaatctggacgaaggagggagagaagaagaagctgagaccgcgctggctcgacgctcggacctactccgatcctcttgccctgaaagagtttaaggacttcgccgctggcagaaaaagcattgcgctggatctcgtcacagaaatcgggcgcgtgcccacccacctggcccatagaacacggaatgctcttgacaacctggtcatgctccacacctctgagcatggaggcaaggcctatcgccacgccgtggaggaactgcctgagacgatggaaaccctgctccttctgggcctgatgattctcctgacagggggagctatgctttttctgatctccggcaaagggattggaaagaccagcatcggcctcatctgcgttattgcctcctctgggatgctgtggatggcggagatccccctgcaatggattgccagcgctatcgtgctcgagttctttatgatggtgcttctgattcctgaacccgagaagcagagaacaccgcaggataatcaactggcctacgtcgttatcggcattctcaccctggctgccacgatcgcggccaacgaaatgggccttctggagacaaccaaacgggacctcggcatgtccaaggaacctggggtggtgagccccacatcttatctggatgtcgacctgcaccccgcttccgcctggaccctctacgctgtggccaccacagttatcacgcctatgcttcgccataccattgagaatagcacagctaacgtgtctctggccgcgatcgccaaccaggctgtcgtgctgatgggactcgacaaaggctggccgattagcaagatggatctgggggtcccccttctggccctcggatgttactcccaggtgaatcctctgaccctgacagctgccgttctccttctgatcacccactatgccattatcggccccgggctgcaggcgaaagctacgagagaggcccaaaagcggacagctgccggaatcatgaagaaccctaccgtggacggcattatgaccatcgatctcgaccccgtcatttacgattctaaattcgaaaagcagctgggccaggtgatgcttctggttctctgcgccgtgcagctgctgctcatgagaacaagctgggctctttgtgaggccctgaccctggcgacagggcctatcacgaccctctgggaaggatccccgggcaaattttggaatacaaccattgccgtctctatggctaacatcttccgcgggagctatctggccggagctggccttgccttttccatcatgaaaagcgtggggacaggaaaacggggcaccggctctcaaggggagacgctgggagaaaagtggaagaaaagactcaatcagctgtcccgcaaggagttcgacctgtacaaaaagagcggcattaccgaggtggatcggacagaagcgaaagaggggctcaagagaggagaaatcacccatcacgccgtttcccggggctctgctaaacttcagtggtttgtcgagcgcaacatggtgattcccgaagggagagtgatcgacctgggatgcggccggggcgggtggagctattactgtgccggactgaagaaggtcacagaggttcgcggctataccaaagggggacctggccatgaggaacccgtgcctatgtccacatacgggtggaatattgtgaagctcatgtctggaaaagatgtcttctacctgcccccggagaagtgcgacacccttctgtgtgatatcggcgaaagctcccctagccccacggtggaggagtctagaacaattcgggttctcaaaatggtggaaccctggctgaagaacaatcagttctgcatcaaggtcctgaacccttatatgcccaccgtgatcgagcacctcgaacgccttcaaagaaaacacggcgggatgctggttcggaatcctctgtcccgcaacagcacccatgagatgtactggatttctaatggaacaggcaacatcgtggcttccgtcaatatggtgagcagactcctgcttaaccggtttacgatgacccacagacgcccgacaattgaaaaggacgtggatctgggggccggaacccggcatgtcaacgctgagcccgagacacctaatatggacgttatcggcgaaagaattaaacgcatcaaggaggaacacaactctacctggcactatgacgatgagaatccctacaaaacatgggcctatcatgggagctacgaagtgaaggcgaccggatccgcctctagcatgatcaacggcgtggtcaagctcctgacgaaaccttgggacgtggttcccatggtgacccagatggctatgacagataccacaccgttcggccagcaacgggtctttaaggagaaagtggacaccagaacgcctcgctccatgcccgggacacggagagttatgggaattaccgccgagtggctgtggcgcacactcggccggaataagaaacctagactgtgtacccgcgaagagttcacgaagaaggtgcggaccaacgctgccatgggggccgtctttacagaagagaatcagtgggatagcgcgaaagctgccgtggaagacgaggatttctggaaacttgttgacagagagcgcgaactgcacaaactcggaaagtgcggctcctgcgtgtataacatgatggggaaaagagagaagaaactgggcgaatttggaaaggccaagggctctcgggctatctggtacatgtggcttggggcccgctacctggagttcgaggctctcggatttctgaatgaagatcattggttcagcagagagaactcctattctggcgtcgaaggggagggactgcacaaactcggctacattctgcgggacatcagcaagattcccgggggcgccatgtatgcggatgacaccgccggatgggacacaagaatcaccgaagatgaccttcataatgaggagaaaatcacacagcagatggatcctgaacaccggcaactggctaacgccatttttaagctcacctaccagaataaagtggtcaaggtgcagcgccccacgccgacaggcaccgttatggacatcatttccagaaaggatcagcgggggtctggacaagtgggcacctatgggctgaacacattcaccaatatggaggctcagcttatccgccagatggaaggagagggcgtcctgagcaaagccgacctcgaaaaccctcatctgcccgagaagaaaattacacagtggctggagacgaagggggtggaaagactcaaacggatggcgatctccggcgatgactgtgtggttaagcccatcgatgaccgctttgccaacgctctgcttgccctgaatgatatgggaaaggtgagaaaagacattcctcaatggcagccgagcaagggctggcatgattggcagcaggtccccttctgctctcaccatttccacgagctcatcatgaaagacgggcggaagctggtggttccttgtcgcccccaagacgaacttattggacgggctcggatctcccagggcgccgggtggagcctgcgcgagaccgcttgcctcggaaaagcctacgcgcagatgtggtctctgatgtattttcacagacgggatctgcgcctcgcctccaacgctatttgtagcgccgtgcctgtccattgggtgcccacatctagaaccacatggtccatccacgcccatcaccaatggatgaccacggaagacatgctgaccgtctggaatcgggtgtggattgaggataacccttggatggaggacaagacacccgttaccacatgggaaaatgtgccgtaccttggcaagagagaggatcagtggtgcgggagcctgatcggcctcacctcccgcgctacgtgggcccagaacatccctacagcgattcagcaagtccggagcctgatcggaaatgaagagttccttgactacatgccctctatgaaaagatttcgcaaggaggaagagagcgaaggcgctatttggtga

SEQ ID NO: 20796 - RNA, 9873 nt, synthetic construct
  misc_feature 1..9873: note = derived and/or modified CDS sequence (opt5) from DENV-3__KF955471__SS-prME
  source 1..9873: mol_type = other RNA
accagcctgtgcctcatgatgatcctgcccgccgctcttgccttccacctgacatcccgggacggcgaacctcggatgattgtggggaagaatgaacgcggaaagtctctcctgtttaagacggcgagcggcatcaatatgtgtacccttattgctatggatctgggggagatgtgcgacgatacagtgacctacaaatgtccgcacatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggatacccggacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacatcattggagtgctggagcagggcaaacggacgcttacccctcagcccatggagctgaagtactcttggaaaacatgggggaaggccaagatcgtcaccgccgaaacacaaaactccagcttcattatcgatggacctaatacccccgagtgcccgtctgcttccagagcgtggaacgtgtgggaagtggaggactatggctttggcgtcttcacaaccaatatctggctcaaactgcgcgaagtttacacgcagctgtgtgaccaccggcttatgagcgccgctgtgaaggatgagagagccgtgcacgccgacatggggtactggattgagtcccagaaaaacggatcttggaagctcgaaaaagctagcctgatcgaggtcaagacatgcacctggcctaagtcccataccctgtggtctaatggcgtgctcgaaagcgatatgattatccccaaatccctggccgggcctattagccagcacaactatcgccccggataccatacacaaaccgcgggcccttggcaccttgggaagctggagctcgactttaattattgcgagggaacgacagttgtgatcaccgaaaactgtggcacacggggcccctctctgagaaccacaaccgtctccgggaaactgatccacgagtggtgctgtcgcagctgcacgcttccgcctctccggtacatgggagaagatggctgttggtatgggatggagattagacccatctctgaaaaggaggagaatatggtgaaatccctggttagcgctggatctggcgaagtggacaacttcaccatgggggtcctgtgcctcgccattctgtttgaggaagtgatgcggggaaagttcggcaagaaacatatgatcgccggcgttttctttacattcgtgcttctgctcagcgggcagattacctggcgcgatatggctcacacactgatcatgattggatccaatgccagcgacagaatgggcatgggggtcacctacctggcgcttatcgctacgtttaagatccagcccttcctggccctcggatttttcctgcggaaactcacatctagagagaacctgcttctgggcgtggggctcgccatggctaccacactgcaactgcctgaagatattgagcagatggccaatggaatcgctcttggcctgatggccctcaagctgattacccagtttgagacctatcagctctggacagcgctgatctcccttacgtgtagcaacaccattttcacactgaccgtggcctggcgcacagctaccctcatcctggccggcgtctccctgcttccggtttgccaatctagctccatgcggaaaacggactggctgcccatgacagtggctgccatgggggtgcctcccctccctctgtttatcttcaatctcaaggataccctgaagagacgctcttggccccttaacgaaggagtcatggccgtgggcctggttagcattctggcttcctctctcctgagaaacgacgtgcctatggcggggccccttgtcgccggaggcctgctcatcgcttgttacgtgattaccgggacaagcgccgatctgaccgttgagaaagccgctgacgtgacatgggaagaggaagccgagcagacgggagtctcccataatctcatgatcaccgtggacgatgacggcacaatgcggattaaggatgacgagaccgaaaacatcctgacagtccttctgaaaaccgcgctgctcatcgtgagcggcatttttccgtactctatccctgctacgctgcttgtttggcacacctggcagaagcagacacaacgctccggggtgctgtgggatgtccccagccctcccgagacccagaaagccgaactcgaggagggagtgtatagaattaagcagcagggcatcttcgggaaaacacaagttggagtgggcgtccagaaggaaggggtgtttcataccatgtggcacgtgacacggggagccgttctgacgtacaatggcaagcgcctcgagccgaactgggcttctgtcaaaaaggacctgatttcctatggcgggggatggagacttagcgcccagtggcaaaaaggcgaagaggtccaggtgatcgcggtcgaacctgggaagaatcccaaaaacttccagaccatgcctggaacattccagaccaccacaggcgagattggggctatcgccctggattttaagcccggaacgtctggctcccccatcattaatcgggagggcaaggtggttgggctgtacggaaacggcgtggtcaccaaaaatgggggatatgtgagcggcatcgcccaaacaaacgctgaacctgacgggccgacccccgagctcgaagaggaaatgttcaagaaacgcaatctgacaattatggatcttcaccctggctccggaaagaccagaaaatacctgcccgccatcgttcgggaggctattaagcgcagactccggacgctgatcctcgcccctacaagagtggtcgcggccgagatggaagaggctctgaagggccttcccatccgctatcagaccaccgccacaaaaagcgaacataccgggcgggagattgtggacctgatgtgccacgctacatttaccatgagactgctctctcctgttcgcgtgccgaactacaatctgatcattatggatgaagcccatttcacggaccccgccagcatcgctgcgcggggatacatttccacaagagtcggcatgggggaggccgctgccatctttatgaccgccacacctcccggaaccgctgatgccttccctcagtctaacgcgcccatccaggacgaggaacgcgacattccggagcggagctggaactccggcaacgaatggatcacggattttgctgggaagaccgtgtggttcgtgccttctattaaagccggcaacgacatcgccaattgtcttagaaagaacggcaaaaaggtcattcaactgagccgcaagacatttgataccgagtatcagaaaacaaagctcaatgactgggatttcgttgtgaccacagacatctccgagatgggagctaactttaaagccgatcgggtgattgaccccagacggtgcctgaagcccgtcatcctgaccgatgggcctgaacgcgtgatcctcgcgggacccatgcctgttacggccgcttctgccgctcagagacggggccgcgtggggagaaatccgcagaaagagaacgaccaatacattttcacaggacagccccttaataacgatgaagaccacgcccattggaccgaggctaagatgctgctggacaatatcaacacccctgaaggcattatccccgccctcttcgagcctgagcgggaaaagagcgcggccattgatggggagtatagactgaaaggcgaatcccgcaagacatttgtcgagcttatgcggagaggagacctgcccgtgtggctcgctcacaaagttgccagcgaaggcatcaagtacaccgatcgcaaatggtgcttcgacgggcagcggaataaccagatcctggaggagaatatggatgtggaaatttggacaaaggagggagagaagaagaagctgagaccgcgctggctcgacgctcggacgtattctgatcctcttgccctgaaagagtttaaggacttcgccgctggcagaaaatccatcgcgctggatctcgtcaccgaaattgggcgcgtgcccacacacctggcccatagaacccggaacgctcttgacaatctggtcatgctccacacaagcgagcatggaggcaaggcctaccgccacgccgtggaggaactgcctgagaccatggaaacgctgctccttctgggcctgatgatcctcctgaccgggggagctatgctttttctgatttctggcaaagggatcggaaagacatccatcggcctcatttgtgttatcgccagctccgggatgctgtggatggcggagattcccctgcaatggatcgcctctgctattgtgctcgagttctttatgatggtgcttctgatccctgaacccgagaagcagagaaccccgcaggataaccaactggcctatgtcgttattggaatcctcacactggctgccatcattgcggccaatgaaatgggccttctggagaccacgaaacgggacctcggcatgagcaaggaacctggggtggtgtcccccacaagctacctggatgtcgacctgcaccccgcttctgcctggaccctctacgctgtggccacaaccgttatcacccctatgcttcgccatacaattgagaactccacggctaacgtgagcctggccgcgatcgccaatcaggctgtcgtgctgatgggactcgacaaaggctggccgatttctaagatggatctgggggtcccccttctggccctcggatgctatagccaggtgaaccctctgaccctgacagctgccgttctccttctgatcacccactacgccatcattggccccgggctgcaggcgaaagctacaagagaggcccaaaagcggaccgctgccggaatcatgaagaatcctacggtggacggcattatgacaatcgatctcgaccccgtcatttatgattccaaattcgaaaagcagctgggccaggtgatgcttctggttctctgtgccgtgcagctgctgctcatgagaacctcttgggctctttgcgaggccctgaccctggcgacagggcctatcaccacactctgggaaggaagcccgggcaaattttggaacacgaccatcgccgtctccatggctaatattttccgcgggtcttacctggccggagctggccttgcctttagcatcatgaagtccgtggggacaggaaaacggggcaccggcagccaaggggagacactgggagaaaagtggaagaaaaagctcaaccagctgtctagaaaagagttcgacctgtataagaaatccggcattaccgaggtggatcgcacggaagcgaaggaggggctcaaacggggagaaatcacccatcacgccgttagcagaggctccgctaaacttcagtggtttgtcgagcggaatatggtgattcccgaagggcgcgtgatcgacctgggatgtggcagaggcgggtggtcttactattgcgccggactgaagaaagtcacagaggttcggggctacaccaaagggggacctggccatgaggaacccgtgcctatgagcacatacgggtggaacattgtgaaactcatgtccggaaaggatgtcttctatctgcccccggagaaatgtgacacccttctgtgcgatatcggcgaatctagcccttcccccacagtggaggagagccgcaccatcagagttctcaagatggtggaaccctggctgaagaataaccagttctgtattaaagtcctgaatccttacatgcccacggtgatcgagcacctcgaacggcttcaacgcaagcacggcgggatgctggttagaaaccctctgtctagaaattccacacatgagatgtattggattagcaacggatctggcaatatcgtggcttccgtcaacatggtgagccgcctcctgcttaacagatttaccatgacccaccggagaccgacaattgaaaaagacgtggatctgggggccggaacgcgccatgtcaatgctgagcccgagacccctaacatggacgttatcggcgaacggatcaagagaattaaagaggaacacaattctacatggcactacgacgatgagaacccctataagacctgggcctaccatgggagctatgaagtgaaggcgacaggatccgcctctagcatgatcaatggcgtggtcaaactcctgaccaagccttgggacgtggttcccatggtgacacagatggctatgaccgatacgaccccgttcggccagcaacgcgtctttaaagagaaggtggacacacggacccctagatccatgcccgggacacgccgggttatgggaattaccgccgagtggctgtggagaacgctcggccgcaacaaaaagcctcggctgtgcacaagagaagagttcaccaagaaagtgcgcacaaatgctgccatgggggccgtctttaccgaagagaaccagtgggatagcgcgaaggctgccgtggaagacgaggatttctggaaacttgttgaccgggagagagaactgcacaagctcggaaaatgtggctcctgcgtgtacaatatgatggggaagcgcgagaaaaagctgggcgaatttggaaaggccaaaggctctagagctatctggtacatgtggcttggggcccggtatctggagttcgaggctctcggatttctgaacgaagatcattggttcagccgcgaaaattcctactctggcgtcgagggggagggactgcacaagctcggctatattctgagagacatcagcaaaatccccgggggcgccatgtacgcggatgacacggccggatgggacacccggattacagaagatgaccttcataacgaggagaagatcacccagcagatggatcctgaacacagacaactggctaatgccatttttaaactcacatatcagaacaaggtggtcaaggtgcagcggcccaccccgacaggcaccgttatggacatcatttcccgcaaagatcagagagggtctggacaagtgggcacgtacgggctgaatacattcaccaacatggaggctcagcttatccggcagatggaaggagagggcgtcctgagcaaggccgacctcgaaaaccctcatctgcccgagaaaaagatcacccagtggctggagacaaaaggggtggaacgcctcaagagaatggcgatttccggcgatgactgcgtggttaagcccatcgatgaccggtttgccaatgctctgcttgccctgaacgatatgggaaaagtgcgcaaggacattcctcaatggcagccgagcaaaggctggcatgattggcagcaggtccccttctgttctcaccatttccacgagctcatcatgaaggacgggagaaaactggtggttccttgccggccccaagacgaacttattggacgcgctagaatctcccagggcgccgggtggagcctgcgggagaccgcttgtctcggaaaggcctatgcgcagatgtggtctctgatgtactttcaccgcagagatctgcggctcgcctccaatgctatttgcagcgccgtgcctgtccattgggtgcccacatctcgcacgacctggtccatccacgcccatcaccaatggatgacaaccgaagacatgctgacagtctggaacagagtgtggatcgaggataatccttggatggaggacaagacccccgttacgacctgggaaaacgtgccgtaccttggcaaacgggaggatcagtggtgtgggagcctgattggcctcacatccagagctacctgggcccagaatatccctacagcgattcagcaagtccgcagcctgatcggaaacgaagagttccttgactatatgccctctatgaagcggtttagaaaagaggaagagagcgaaggcgctatttggtga

SEQ ID NO: 20797 - RNA, 9873 nt, synthetic construct
  misc_feature 1..9873: note = derived and/or modified CDS sequence (opt5) from DENV-3__FJ639803__SS-prME
  source 1..9873: mol_type = other RNA
accagcctgtgcctcatgatgatcctgcccgccgctcttgccttccacctgacatcccgggacggcgaacctcggatgattgtggggaagaatgaacgcggaaagtctctcctgtttaagacggcgagcggcatcaatatgtgtacccttattgctatggatctgggggagatgtgcgacgatacagtgacctacaaatgtccgcacatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggatacccggacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacatcattggagtgctggagcagggcaaacggacgcttacccctcagcccatggagctgaagtactcttggaaaacatgggggaaggccaagatcgtcaccgccgaaacacaaaactccagcttcattatcgatggacctaatacccccgagtgcccgtctgcttccagagcgtggaacgtgtgggaagtggaggactatggctttggcgtcttcacaaccaatatctggctcaaactgcgcgaagtttacacgcagctgtgtgaccaccggcttatgagcgccgctgtgaaggatgagagagccgtgcacgccgacatggggtactggattgagtcccagaaaaacggatcttggaagctcgaaaaagctagcctgatcgaggtcaagacatgcacctggcctaagtcccataccctgtggtctaatggcgtgctcgaaagcgatatgattatccccaaatccctggccgggcctattagccagcacaactatcgccccggataccatacacaaaccgcgggcccttggcaccttgggaagctggagctcgactttaattattgcgagggaacgacagttgtgatcaccgaaaactgtggcacacggggcccctctctgagaaccacaaccgtctccgggaaactgatccacgagtggtgctgtcgcagctgcacgcttccgcctctccggtacatgggagaagatggctgttggtatgggatggagattagacccatctctgaaaaggaggagaatatggtgaaatccctggttagcgctggatctggcgaagtggacaacttcaccatgggggtcctgtgcctcgccattctgtttgaggaagtgatgcggggaaagttcggcaagaaacatatgatcgccggcgttttctttacattcgtgcttctgctcagcgggcagattacctggcgcgatatggctcacacactgatcatgattggatccaatgccagcgacagaatgggcatgggggtcacctacctggcgcttatcgctacgtttaagatccagcccttcctggccctcggatttttcctgcggaaactcacatctagagagaacctgcttctgggcgtggggctcgccatggctaccacactgcaactgcctgaagatattgagcagatggccaatggaatcgctcttggcctgatggccctcaagctgattacccagtttgagacctatcagctctggacagcgctgatctcccttacgtgtagcaacaccattttcacactgaccgtggcctggcgcacagctaccctcatcctggccggcgtctccctgcttccggtttgccaatctagctccatgcggaaaacggactggctgcccatgacagtggctgccatgggggtgcctcccctccctctgtttatcttcaatctcaaggataccctgaagagacgctcttggccccttaacgaaggagtcatggccgtgggcctggttagcattctggcttcctctctcctgagaaacgacgtgcctatggcggggccccttgtcgccggaggcctgctcatcgcttgttacgtgattaccgggacaagcgccgatctgaccgttgagaaagccgctgacgtgacatgggaagaggaagccgagcagacgggagtctcccataatctcatgatcaccgtggacgatgacggcacaatgcggattaaggatgacgagaccgaaaacatcctgacagtccttctgaaaaccgcgctgctcatcgtgagcggcatttttccgtactctatccctgctacgctgcttgtttggcacacctggcagaagcagacacaacgctccggggtgctgtgggatgtccccagccctcccgagacccagaaagccgaactcgaggagggagtgtatagaattaagcagcagggcatcttcgggaaaacacaagttggagtgggcgtccagaaggaaggggtgtttcataccatgtggcacgtgacacggggagccgttctgacgtacaatggcaagcgcctcgagccgaactgggcttctgtcaaaaaggacctgatttcctatggcgggggatggagacttagcgcccagtggcaaaaaggcgaagaggtccaggtgatcgcggtcgaacctgggaagaatcccaaaaacttccagaccatgcctggaacattccagaccaccacaggcgagattggggctatcgccctggattttaagcccggaacgtctggctcccccatcattaatcgggagggcaaggtggttgggctgtacggaaacggcgtggtcaccaaaaatgggggatatgtgagcggcatcgcccaaacaaacgctgaacctgacgggccgacccccgagctcgaagaggaaatgttcaagaaacgcaatctgacaattatggatcttcaccctggctccggaaagaccagaaaatacctgcccgccatcgttcgggaggctattaagcgcagactccggacgctgatcctcgcccctacaagagtggtcgcggccgagatggaagaggctctgaagggccttcccatccgctatcagaccaccgccacaaaaagcgaacataccgggcgggagattgtggacctgatgtgccacgctacatttaccatgagactgctctctcctgttcgcgtgccgaactacaatctgatcattatggatgaagcccatttcacggaccccgccagcatcgctgcgcggggatacatttccacaagagtcggcatgggggaggccgctgccatctttatgaccgccacacctcccggaaccgctgatgccttccctcagtctaacgcgcccatccaggacgaggaacgcgacattccggagcggagctggaactccggcaacgaatggatcacggattttgctgggaagaccgtgtggttcgtgccttctattaaagccggcaacgacatcgccaattgtcttagaaagaacggcaaaaaggtcattcaactgagccgcaagacatttgataccgagtatcagaaaacaaagctcaatgactgggatttcgttgtgaccacagacatctccgagatgggagctaactttaaagccgatcgggtgattgaccccagacggtgcctgaagcccgtcatcctgaccgatgggcctgaacgcgtgatcctcgcgggacccatgcctgttacggccgcttctgccgctcagagacggggccgcgtggggagaaatccgcagaaagagaacgaccaatacattttcacaggacagccccttaataacgatgaagaccacgcccattggaccgaggctaagatgctgctggacaatatcaacacccctgaaggcattatccccgccctcttcgagcctgagcgggaaaagagcgcggccattgatggggagtatagactgaaaggcgaatcccgcaagacatttgtcgagcttatgcggagaggagacctgcccgtgtggctcgctcacaaagttgccagcgaaggcatcaagtacaccgatcgcaaatggtgcttcgacgggcagcggaataaccagatcctggaggagaatatggatgtggaaatttggacaaaggagggagagaagaagaagctgagaccgcgctggctcgacgctcggacgtattctgatcctcttgccctgaaagagtttaaggacttcgccgctggcagaaaatccatcgcgctggatctcgtcaccgaaattgggcgcgtgcccacacacctggcccatagaacccggaacgctcttgacaatctggtcatgctccacacaagcgagcatggaggcaaggcctaccgccacgccgtggaggaactgcctgagaccatggaaacgctgctccttctgggcctgatgatcctcctgaccgggggagctatgctttttctgatttctggcaaagggatcggaaagacatccatcggcctcatttgtgttatcgtgagctccgggatgctgtggatggccgagattcccctgcaatggatcgcgtctgccattgtgctcgagttctttatgatggtccttctgatccctgaacccgagaagcagagaaccccgcaggataaccaactggcttatgttgtgattggaatcctcacactggccgctatcattgccgcgaatgaaatgggccttctggagaccacgaaacgggacctcggcatgagcaaggaacctggggtggtctcccccacaagctacctggatgtggacctgcaccccgcctctgcttggaccctctacgccgttgctacaaccgtgatcacccctatgcttcgccatacaattgagaactccacggccaacgtcagcctggctgccatcgcgaatcaggccgtggtcctgatgggactcgacaaaggctggccgatttctaagatggatctgggggtgccccttctggctctcggatgctatagccaggttaaccctctgaccctgacagccgctgtgctccttctgatcacccactacgccatcattggccccgggctgcaggccaaagcgacaagagaggctcaaaagcggaccgccgctggaatcatgaagaatcctacggtcgacggcattatgacaatcgatctcgaccccgtgatttatgattccaaattcgaaaagcagctgggccaggttatgcttctggtgctctgtgccgtccagctgctgctcatgagaacctcttgggccctttgcgaggctctgaccctggccacagggcctatcaccacactctgggaaggaagcccgggcaaattttggaacacgaccatcgcggtgtccatggccaatattttccgcgggtcttacctggctggagccggccttgcttttagcatcatgaagtccgtggggacaggaaaacggggcaccggcagccaaggggagacactgggagaaaagtggaagaaaaagctcaaccagctgtctagaaaagagttcgacctgtataagaaatccggcattaccgaggttgatcgcacggaagccaaggaggggctcaaacggggagaaatcacccatcacgcggtcagcagaggctccgccaaacttcagtggtttgtggagcggaatatggtgattcccgaagggcgcgtcatcgacctgggatgtggcagaggcgggtggtcttactattgcgctggactgaagaaagttacagaggtgcggggctacaccaaagggggacctggccatgaggaacccgtgcctatgagcacatacgggtggaacattgtcaaactcatgtccggaaaggatgtgttctatctgcccccggagaaatgtgacacccttctgtgcgatatcggcgaatctagcccttcccccacagttgaggagagccgcaccatcagagtgctcaagatggtcgaaccctggctgaagaataaccagttctgtattaaagtgctgaatccttacatgcccacggttatcgagcacctcgaacggcttcaacgcaagcacggcgggatgctggtgagaaaccctctgtctagaaattccacacatgagatgtattggattagcaacggatctggcaatatcgtcgcctccgtgaacatggtgagccgcctcctgcttaacagatttaccatgacccaccggagaccgacaattgaaaaagacgtcgatctgggggctggaacgcgccatgttaatgccgagcccgagacccctaacatggacgtgatcggcgaacggatcaagagaattaaagaggaacacaattctacatggcactacgacgatgagaacccctataagacctgggcttaccatgggagctatgaagtgaaggccacaggatccgcgtctagcatgatcaatggcgtcgtgaaactcctgaccaagccttgggacgttgtgcccatggtcacacagatggccatgaccgatacgaccccgttcggccagcaacgcgtgtttaaagagaaggttgacacacggacccctagatccatgcccgggacacgccgggtgatgggaattaccgctgagtggctgtggagaacgctcggccgcaacaaaaagcctcggctgtgcacaagagaagagttcaccaagaaagtccgcacaaatgccgctatgggggccgtgtttaccgaagagaaccagtgggatagcgccaaggcggctgttgaagacgaggatttctggaaacttgtggaccgggagagagaactgcacaagctcggaaaatgtggctcctgcgtctacaatatgatggggaagcgcgagaaaaagctgggcgaatttggaaaggccaaaggctctagagccatctggtacatgtggcttggggctcggtatctggagttcgaggccctcggatttctgaacgaagatcattggttcagccgcgaaaattcctactctggcgtggagggggagggactgcacaagctcggctatattctgagagacatcagcaaaatccccgggggcgctatgtacgccgatgacacggcgggatgggacacccggattacagaagatgaccttcataacgaggagaagatcacccagcagatggatcctgaacacagacaactggccaatgctatttttaaactcacatatcagaacaaggtcgtgaaggttcagcggcccaccccgacaggcaccgtgatggacatcatttcccgcaaagatcagagagggtctggacaagtcggcacgtacgggctgaatacattcaccaacatggaggcccagcttatccggcagatggaaggagagggcgtgctgagcaaggctgacctcgaaaaccctcatctgcccgagaaaaagatcacccagtggctggagacaaaaggggtggaacgcctcaagagaatggccatttccggcgatgactgcgttgtgaagcccatcgatgaccggtttgcgaatgccctgcttgctctgaacgatatgggaaaagtccgcaaggacattcctcaatggcagccgagcaaaggctggcatgattggcaacaggtgcccttctgttctcaccatttccacgagctcatcatgaaggacgggagaaaactggttgtgccttgccggccccaagacgaacttattggacgcgccagaatctcccagggcgctgggtggagcctgcgggagaccgcctgtctcggaaaggcttatgcccagatgtggtctctgatgtactttcaccgcagagatctgcggctcgcgtccaatgccatttgcagcgctgtccctgtgcattgggtccccacatctcgcacgacctggtccatccacgcccatcaccaatggatgacaaccgaagacatgctgacagtgtggaacagagtttggatcgaggataatccttggatggaggacaagacccccgtgacgacctgggaaaacgtcccgtaccttggcaaacgggaggatcagtggtgtgggagcctgattggcctcacatccagagccacctgggctcagaatatccctacagccattcagcaagtgcgcagcctgatcggaaacgaagagttccttgactatatgccctctatgaagcggtttagaaaagaggaagagagcgaaggcgcgatttggtga

SEQ ID NO: 20798 - RNA, 9873 nt, synthetic construct
  misc_feature 1..9873: note = derived and/or modified CDS sequence (opt5) from DENV-3__FJ639804__SS-prME
  source 1..9873: mol_type = other RNA
accagcctgtgcctcatgatgatcctgcccgccgctcttgccttccacctgacgtcccgggacggcgaacctcggatgattgtggggaagaacgaacgcggaaagtctctcctgtttaagacggcgagcggcatcaatatgtgtacccttattgctatggatctgggggagatgtgcgacgatacagtgacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacatcattggagtgctggagcagggcaaacggacgcttacccctcagcccatggagctgaagtactcttggaaaacatgggggaaggccaagatcgtcaccgccgaaacacaaaactccagcttcattatcgatggacctaatacccccgagtgcccgtctgcttccagagcgtggaacgtgtgggaagtggaggactatggctttggcgtcttcacaaccaatatctggctcaaactgcgcgaagtttacacgcagctgtgtgaccaccggcttatgagcgccgctgtgaaggatgagagagccgtgcacgccgacatggggtactggattgagtcccagaaaaacggatcttggaagctcgaaaaagctagcctgatcgaggtcaagacatgcacctggcctaagtcccataccctgtggtctaatggcgtgctcgaaagcgatatgattatccccaaatccctggccgggcctattagccagcacaactatcgccccggataccatacacaaaccgcgggcccttggcaccttgggaagctggagctcgactttaattattgcgagggaacgacagttgtgatcaccgaaaactgtggcacacggggcccctctctgagaaccacaaccgtctccgggaaactgatccacgagtggtgctgtcgcagctgcacgcttccgcctctccggtacatgggagaagatggctgttggtatgggatggagattagacccatctctgaaaaggaggagaatatggtgaaatccctggttagcgctggatctggcgaagtggacaacttcaccatgggggtcctgtgcctcgccattctgtttgaggaagtgatgcggggaaagttcggcaagaaacatatgatcgccggcgttttctttacattcgtgcttctgctcagcgggcagattacctggcgcgatatggctcacacactgatcatgattggatccaatgccagcgacagaatgggcatgggggtcacctacctggcgcttatcgctacgtttaagatccagcccttcctggccctcggatttttcctgcggaaactcacatctagagagaacctgcttctgggcgtggggctcgccatggctaccacactgcaactgcctgaagatattgagcagatggccaatggaatcgctcttggcctgatggccctcaagctgattacccagtttgagacctatcagctctggacagcgctgatctcccttacgtgtagcaacaccattttcacactgaccgtggcctggcgcacagctaccctcatcctggccggcgtctccctgcttccggtttgccaatctagctccatgcggaaaacggactggctgcccatgacagtggctgccatgggggtgcctcccctccctctgtttatcttctctctcaaggataccctgaagagacgcagctggccccttaatgaaggagtcatggccgtgggcctggtttccattctggcttctagcctcctgagaaacgacgtgcctatggcggggccccttgtcgccggaggcctgctcatcgcttgttacgtgattaccgggacatccgccgatctgaccgttgagaaagccgctgacgtgacatgggaagaggaagccgagcagacgggagtcagccataacctcatgatcaccgtggacgatgacggcacaatgcggattaaggatgacgagaccgaaaatatcctgacagtccttctgaaaaccgcgctgctcatcgtgtctggcatttttccgtactccatccctgctacgctgcttgtttggcacacctggcagaagcagacacaacgcagcggggtgctgtgggatgtcccctctcctcccgagacccagaaagccgaactcgaggagggagtgtatagaattaagcagcagggcatcttcgggaaatcccaagttggagtgggcgtccagaaggaaggggtgtttcatacaatgtggcacgtgacccggggagccgttctgacatacaacggcaagcgcctcgagccgaattgggctagcgtcaaaaaggacctgatttcttatggcgggggatggagactttccgcccagtggcaaaaaggcgaagaggtccaggtgatcgcggtcgaacctgggaagaaccccaaaaatttccagacgatgcctggaaccttccagacaaccaccggcgagattggggctatcgccctggattttaagcccggaacaagcggctcccccatcattaaccgggagggcaagatcgtggggctgtacggaaatggcgttgtgacgaaaaacgggggatatgtcagcggcattgcccaaaccaatgctgaacctgacgggccgacacccgagctcgaagaggaaatgttcaagaaacgcaacctgaccatcatggatcttcaccctggctctggaaagacaagaaaatacctgcccgccattgtgcgggaggctatcaagcgcagactccggaccctgatcctcgcccctacgagagttgtggcggccgagatggaagaggctctgaagggccttcccattcgctatcagacaaccgccaccaaaagcgaacatacagggcgggagatcgtcgacctgatgtgccacgctacctttacaatgagactgctctcccctgtgcgcgttccgaattacaacctgattatcatggatgaagcccatttcaccgaccccgcctctattgctgcgcggggatacatcagcacgagagtgggcatgggggaggccgctgccatctttatgacagccacccctcccggaacagctgatgccttccctcagtccaatgcgcccattcaggacgaggaacgcgacatcccggagcggtcttggaacagcggcaatgaatggattaccgattttgctgggaagacggtctggttcgtgccttccatcaaagccggcaacgacattgccaactgtcttagaaagaatggcaaaaaggtgatccaactgtctcgcaagacctttgatacagagtatcagaaaaccaagctcaacgactgggatttcgtcgttacaaccgacattagcgagatgggagctaattttaaagccgatcgggtgatcgaccccagacggtgcctgaagcccgtgatcctgacagatgggcctgaacgcgtcattctcgcgggacccatgcctgtgaccgccgcttccgccgctcagagacggggccgcgttgggagaaacccgcagaaagagaatgaccaatacatcttcacgggacagccccttaacaatgatgaagaccacgcccattggacagaggctaagatgctgctggacaacattaatacccctgaaggcatcattcccgccctcttcgagcctgagcgggaaaagagcgcggccatcgatggggagtatagactgaaaggcgaatctcgcaagacctttgtggagcttatgcggagaggagacctgcccgtctggctcgctcacaaagtggcctccgaaggcatcaagtacacagatcgcaaatggtgcttcgacgggcagcggaacaatcagattctggaggagaacatggatgttgaaatctggaccaaggagggagagaagaagaagctgagaccgcgctggctcgacgctcggacatatagcgatcctcttgccctgaaagagtttaaggacttcgccgctggcagaaaatctattgcgctggatctcgtgacggaaatcgggcgcgtccccacccacctggcccatagaacacggaatgctcttgacaacctggtgatgctccacacctccgagcatggaggcaaggcctaccgccacgccgtcgaggaactgcctgagacaatggaaaccctgctccttctgggcctgatgattctcctgacagggggagctatgctttttctgatcagcggcaaagggatcggaaagacctccattggcctcatctgtgtgattgcctctagcgggatgctgtggatggcggagatccccctgcaatggattgcctccgctatcgttctcgagttctttatgatggtgcttctgattcctgaacccgagaagcagagaacaccgcaggataatcaactggcctatgtggtcatcggaatcctcaccctggctgccacaattgcggccaacgaaatgggccttctggagaccacgaaacgggacctcggcatgagcaaggaacctggggttgtgtctcccacatcctacctggatgtggacctgcaccccgctagcgcctggaccctctacgctgtcgccacaaccgtgatcacccctatgcttcgccatacaattgaaaattctacggctaacgttagcctggccgcgatcgccaaccaggctgtggtcctgatgggactcgacaaaggctggccgatttccaagatggatctgggggtgccccttctggccctcggatgctattctcaggtcaatcctctgaccctgacagctgccgtgctccttctgatcacccactacgccatcattggccccgggctgcaggcgaaagctacaagagaggcccaaaagcggaccgctgccggaatcatgaagaaccctacggttgacggcattatgacaatcgatctcgaccccgtgatttatgatagcaaattcgaaaagcagctgggccaggtcatgcttctggtgctctgtgccgttcagctgctgctcatgagaacctcctgggctctttgcgaggccctgaccctggcgacagggcctatcaccacactctgggaaggatctccgggcaaattttggaatacgaccatcgccgtgagcatggctaacattttccgcgggtcctacctggccggagctggccttgcctttagcatcatgaagtctgtcgggacaggaaaacggggcaccggctcccaaggggagacactgggagaaaagtggaagaaaaagctcaatcagctgagcagaaaagagttcgacctgtataagaaatccggcattaccgaggtggatcgcacggaagcgaaggaggggctcaaacggggagaaatcacccatcacgccgtgtctagaggcagcgctaaacttcagtggtttgttgagcggaacatggtcattcccgaagggcgcgtgatcgacctgggatgtggcagaggcgggtggtcctactattgcgccggactgaagaaagtgacagaggtccggggctacaccaaagggggacctggccatgaggaacccgttcctatgtctacatacgggtggaatattgtgaaactcatgagcggaaaggatgtgttctatctgcccccggagaaatgtgacacccttctgtgcgatatcggcgaatccagcccttctcccacagtcgaggagtcccgcaccatcagagtgctcaagatggttgaaccctggctgaagaacaatcagttctgtattaaagtgctgaacccttacatgcccacggtcatcgagcacctcgaacggcttcaacgcaagcacggcgggatgctggtgagaaatcctctgagccggaactctacacatgagatgtattggatttccaatggaaccggcaacatcgttgctagcgtgaatatggtctctcgcctcctgcttaacagatttaccatgacataccggagaccgacgattgaaaaagacgtggatctgggggccggaacccgccacgtgaacgctgagcccgagacacctaatatggacgtcatcggcgaacggatcgagagaattaaggaagaacacaacagcacctggcactatgacgatgaaaatccctacaaaacatgggcctatcacgggtcctacgaggttaaggcgaccggatctgccagctccatgatcaacggcgtggtgaagctcctgacaaaaccttgggacgtcgtgcccatggttacccagatggctatgacggataccacaccgttcggccagcaacgcgtgtttaaggagaaagtcgacacccggattcctagaagcatgcccgggacacgccgggtgatgggaatcaccgccgaatggctgtggagaacgctcggccgcaataagaaacctcggctgtgcacaagagaggagttcaccaagaaggttcgcacaaacgctgccatgggggccgtgtttaccgaggaaaatcagtgggattccgcgaaagctgccgtcgaggacgaggatttctggaaacttgtggaccgggaaagagagctgcataaactcggaaagtgtggctcttgcgtttacaacatgatggggaaacgcgaaaagaaactgggcgagtttggaaaggccaagggcagcagagctatttggtatatgtggcttggggcccggtacctggagttcgaagctctcggatttctgaatgaggatcactggttctcccgcgaaaactcttatagcggcgtggagggggaaggactgcataaactcggctacatcctgagagacatctccaagattcccgggggcgccatgtatgcggatgacacggccggatgggacacccggatcacagaggatgaccttcacaatgaggagaagattacccagcagatggatcctgagcatagacaactggctaacgccatctttaagctcacataccagaataaagtcgtgaaggtccagcggcccaccccgacaggcaccgtgatggacattatctctcgcaaggatcagagagggagcggacaagttggcacgtatgggctgaacacattcaccaatatggaagctcagcttatccggcagatggagggagaaggcgtgctgtccaaagccgacctcgagaaccctcatctgcccgagaagaaaattacccagtggctggaaacaaagggggtcgagcgcctcagacggatggcgatcagcggcgatgactgcgtggtgaaacccattgatgaccgctttgccaacgctctgcttgccctgaatgatatgggaaaggttagaaaggacatccctcaatggcagccgtctaaaggctggcacgattggcaacaggtgcccttctgttcccatcacttccatgaactcattatgaaggacgggcggaaactggtcgtgccttgccgcccccaagacgagcttatcggacgggctcggattagccagggcgccgggtggtctctgcgcgaaaccgcttgtctcggaaaggcctacgcgcagatgtggtccctgatgtactttcacagacgggatctgcgcctcgccagcaacgctatctgctctgccgttcctgtgcactgggtccccacatccagaacgacctggagcatccatgcccaccatcaatggatgacaaccgaggacatgctgacagtgtggaatcgggtctggattgaggataacccttggatggaagacaaaacccccgtgacgacctgggagaatgttccgtatcttggcaagagagaagatcagtggtgtgggtccctgatcggcctcacaagccgcgctacctgggcccagaacattcctacagcgatccagcaagtgcggtctctgattggaaatgaggagttccttgactacatgcccagcatgaagagatttcgcaaagaagaggaatccgagggcgctatctggtga

SEQ ID NO: 20799 - RNA, 9873 nt, synthetic construct
  misc_feature 1..9873: note = derived and/or modified CDS sequence (opt5) from DENV-3__FJ639805__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccagaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctcggggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacatcattggagtgctggagcagggcaaacggacgcttacccctcagcccatggagctgaagtactcttggaaaacatgggggaaggccaagatcgtcaccgccgaaacacaaaactccagcttcattatcgatggacctaatacccccgagtgcccgtctgcttccagagcgtggaacgtgtgggaagtggaggactatggctttggcgtcttcacaaccaatatctggctcaaactgcgcgaagtttacacgcagctgtgtgaccaccggcttatgagcgccgctgtgaaggatgagagagccgtgcacgccgacatggggtactggattgagtcccagaaaaacggatcttggaagctcgaaaaagctagcctgatcgaggtcaagacatgcacctggcctaagtcccataccctgtggtctaatggcgtgctcgaaagcgatatgattatccccaaatccctggccgggcctattagccagcacaactatcgccccggataccatacacaaaccgcgggcccttggcaccttgggaagctggagctcgactttaattattgcgagggaacgacagttgtgatcaccgaaaactgtggcacacggggcccctctctgagaaccacaaccgtctccgggaaactgatccacgagtggtgctgtcgcagctgcacgcttccgcctctccggtacatgggagaagatggctgttggtatgggatggagattagacccatctctgaaaaggaggagaatatggtgaaatccctggttagcgctggatctggcgaagtggacaacttcaccatgggggtcctgtgcctcgccattctgtttgaggaagtgatgcggggaaagttcggcaagaaacatatgatcgccggcgttttccttacatttgtgctgctcctgagcgggcagattacctggcgcgatatggctcacacactgatcatgattggatccaatgccagcgacagaatgggcatgggggtcacctaccttgcgctgatcgctacgttcaagatccagccctttctcgccctgggattctttctccggaaactgacatctagagagaaccttctgctcggcgtggggctggccatggctaccacactgcaacttcctgaagatattgagcagatggccaatggaatcgctctgggcctcatggccctgaagctcattacccagttcgagacctatcagctgtggacagcgcttatctccctgacgtgtagcaacaccatttttacactcaccgtggcctggcgcacagctaccctgatcctggccggcgtctcccttctgccggtttgccaatctagctccatgcggaaaacggactggctccccatgacagtggctgccatgggggtgcctcccctgcctctcttcatctttaatctgaaggatacccttagacgcagatcttggcccctgaacgaaggagtcatggccgtgggcctggttagcattctcgcttcctctctgcttcggaacgacgtgcctatggcggggcccctggtcgccggaggcctcctgatcgcttgttacgtgattaccgggacaagcgccgatctcaccgttgagaaggccgctgacgtgacatgggaagaggaagccgagcagacgggagtctcccataatctgatgatcaccgtggacgatgacggcacaatgcgcattaaagatgacgagaccgaaaacatccttacagtcctgctgaagaccgcgctcctgatcgtgagcggcattttcccgtactctatccctgctacgcttctggtttggcacacctggcagaaacagacacaaagatccggggtgctctgggatgtccccagccctcccgagacccagaaggccgaactggaggagggagtgtatcggattaaacagcagggcatctttgggaagacacaagttggagtgggcgtccagaaagaaggggtgttccataccatgtggcacgtgacacgcggagccgttctcacgtacaatggcaagagactggagccgaactgggcttctgtcaagaaagaccttatttcctatggcgggggatggcggctgagcgcccagtggcaaaagggcgaagaggtgcaggtgatcgcggtcgaacctgggaaaaatcccaagaactttcagaccatgcctggaacattccagaccaccacaggcgagattggggctatcgccctggatttcaaacccggaacgtctggctcccccatcattaatcgcgagggcaaggtggttgggctctacggaaacggcgtggtcaccaagaatgggggatatgtgagcggcatcgcccaaacaaacgctgaacctgacgggccgacccccgagctggaagaggaaatgtttaaaaagagaaatcttacaattatggatctgcaccctggctccggaaaaacccggaagtacctccccgccatcgttcgcgaggctattaaaagacggctgagaacgctcatcctggcccctacacgcgtggtcgcggccgagatggaagaggctcttaagggcctgcccatccggtatcagaccaccgccacaaagagcgaacataccgggagagagattgtggacctgatgtgccacgctacattcaccatgcgcctcctgtctcctgttcgggtgccgaactacaatcttatcattatggatgaagcccattttacggaccccgccagcatcgctgcgagaggatacatttccacacgcgtcggcatgggggaggccgctgccatcttcatgaccgccacacctcccggaaccgctgatgcctttcctcagtctaacgcgcccatccaggacgaggaacgggacattccggagagaagctggaattccggcaacgaatggatcacggatttcgctgggaaaaccgtgtggtttgtgccttctattaaggccggcaacgacatcgccaattgtctgcgcaaaaacggaaagaaagtcattcaactcagccggaagacattcgataccgagtatcagaagacaaaactgaatgactgggattttgttgtgaccacagacatctccgagatgggcgctaacttcaaggccgatagagtgattgacccccggcgctgcctgaaacccgtcatcctcaccgatgggcctgaaagagtgatccttgcgggacccatgcctgttacggccgcttctgccgctcagcggcgcggcagagtggggcggaatccgcagaaggagaacgaccaatacatttttacaggacagcccctgaataacgatgaagaccacgcccattggaccgaggctaaaatgctgctcgacaatatcaacacccctgaaggcattatccccgccctgttcgagcctgagagagaaaagagcgcggccattgatggggagtatcgccttaagggcgaatcccggaaaacattcgtcgagctgatgagacgcggagacctccccgtgtggctggctcacaaggttgccagcgaaggcatcaaatacaccgatcggaagtggtgctttgacgggcagagaaataaccagatcctggaggagaatatggatgtggaaatttggacaaaagagggagaaaagaaaaagctccgcccgcggtggcttgacgctagaacgtattctgatcctctggccctgaaggagttcaaagactttgccgctggccgcaagtccatcgcgctcgatctggtcaccgaaattgggagagtgcccacacaccttgcccatcggacccgcaacgctctggacaatctcgtcatgctgcacacaagcgagcatggaggcaaagcctacagacacgccgtggaggaactgcctgagaccatggaaacgctccttctgctgggcctcatgatcctgcttaccgggggagctatgctgttcctcatttctggcaaggggctgggaaaaacatccatcggcctgatctgtgttattgccagctccgggatgctctggatggcggagatcccccttcaatggattgcctctgctatcgtgctggagtttttcatgatggtgctgctcattcctgaacccgagaagcagcggaccccgcaggataaccaactggcctatgtcgttatcggaattcttacactggctgccatcatcgcggccaatgaaatgggcctcctggagaccacgaagcgcgacctgggcatgagcaaagaacctggggtggtgtcccccacaagctacctcgatgtcgaccttcaccccgcttctgcctggaccctgtacgctgtggccacaaccgttattacccctatgctgagacatacaatcgagaactccacggctaacgtgagcctcgccgcgattgccaatcaggctgtcgtgctgatgggacttgacaagggctggccgatctctaaaatggatctgggggtccccctcctggccctgggatgctatagccaggtgaaccctctcacccttacagctgccgttctgctgctcattacccactacgccatcatcggccccgggctgcaggcgaaggctacacgggaggcccaaaaaagaaccgctgccggaattatgaagaatcctacggtggacggcatcatgacaattgatcttgaccccgtcatctatgattccaagtttgaaaaacagctgggccaggtgatgctcctggttctgtgtgccgtgcagctccttctgatgcgcacctcttgggctctgtgcgaggccctcaccctggcgacagggcctattaccacactttgggaaggaagcccgggcaagttctggaacacgaccatcgccgtctccatggctaatatctttcgggggtcttacctggccggagctggcctcgccttcagcattatgaaatccgtggggacaggaaagagaggcaccggcagccaaggggagacactgggagaaaaatggaagaagaaactgaaccagctctctcgcaaggagtttgacctttataaaaagtccggcatcaccgaggtggatcggacggaagcgaaagaggggctgaagagaggagaaattacccatcacgccgttagccggggctccgctaaactgcagtggttcgtcgagcgcaatatggtgatccccgaagggagagtgattgacctcggatgtggccggggcgggtggtcttactattgcgccggactgaagaaggtcacagaggttcgcggctacaccaaagggggacctggccatgaggaacccgtgcctatgagcacatacgggtggaacatcgtgaagcttatgtccggaaaagatgtcttttatctgcccccggagaagtgtgacaccctcctgtgcgatattggcgaatctagcccttcccccacagtggaggagagcagaaccatccgggttctgaaaatggtggaaccctggctcaagaataaccagttctgtatcaaggtccttaatccttacatgcccacggtgattgagcacctggaacgcctgcaaagaaaacacggcgggatgctcgttcggaaccctctgtctcgcaattccacacatgagatgtattggatcagcaacggaaccggcaatattgtggcttctgtcaacatggtgtccagacttctgctcaaccggttcaccatgacacacagacgcccgacgatcgaaaaggacgtggatctgggggccggaacccggcatgtcaatgctgagcccgagacacctaacatggacgttattggcgaaagaatcaaacgcatcaaggaggaacacaatagcacctggcactacgacgatgagaacccctataaaacatgggcctaccatgggtcttatgaagtgaaggcgaccggaagcgcctcctctatgattaatggcgtggtcaagctgctcacaaaaccttgggacgtggttcccatggtgatccagatggctatgaccgatacgaccccgtttggccagcaacgggtcttcaaggagaaagtggacacaagaacccctcgcagcatgcccgggacacggagagttatgggaattaccgccgagtggctgtggcgcacgcttggccggaacaagaaacctagactgtgcacacgcgaagagtttaccaagaaggtgcggacaaatgctgccatgggggccgtcttcaccgaagagaaccagtgggattccgcgaaagctgccgtggaagacgaggatttttggaagctcgttgacagagagcgcgaactgcacaaacttggaaagtgtggcagctgcgtgtacaatatgatggggaaaagagagaagaaactgggcgaattcggaaaggccaagggctcccgggctatctggtacatgtggctcggggcccgctatctggagtttgaggctctgggattcctcaacgaagatcattggttttctagagagaatagctactccggcgtcgaaggggagggactgcacaaacttggctatattctgcgggacatctctaagatccccgggggcgccatgtacgcggatgacacggccggatgggacaccagaattacagaagatgacctccataacgaggagaaaatcacccagcagatggatcctgaacaccggcaactggctaatgccattttcaagcttacatatcagaacaaagtggtcaaggtgcagcgccccaccccgacaggcaccgttatggacatcattagcagaaaggatcagcgggggtccggacaagtgggcacgtacgggctgaatacatttaccaacatggaggctcagctcatccgccagatggaaggagagggcgtcctgtctaaagccgacctggaaaaccctcacctccccgagaagaaaatcacccagtggctggagacaaagggggtggaaagacttaaacggatggcgattagcggcgatgactgcgtggttaagcccatcgatgaccgcttcgccaatgctctgctcgccctgaacgatatgggaaaggtgagaaaagacattcctcaatggcagccgtccaagggctggcatgattggcagcaggtccccttttgtagccaccatttccacgagcttatcatgaaagacgggcggaagctggtggttccttgccgcccccaagacgaactcattggaagagctcggatctctcagggcgccgggtggtccctgcgcgagaccgcttgtctgggaaaagcctatgcgcagatgtggagcctcatgtacttccacagacgggatctgcgccttgcctctaatgctatttgctccgccgtgcctgtccattgggtgcccacaagcagaacgacctggtctatccacgcccatcaccaatggatgacaaccgaagacatgctgacagtctggaaccgggtgtggatcgaggataatccttggatggaggacaagacccccgttacgacctgggaaaacgtgccgtacctcggcaagagagaggatcagtggtgtgggtccctgattggccttacaagccgcgctacctgggcccagaatatccctacagcgattcagcaagtccggtccctgatcggaaacgaagagtttctcgactatatgcccagcatgaaaagattccgcaaggaggaagagtctgaaggcgctatttggtga

SEQ ID NO: 20800 - RNA, 9873 nt, synthetic construct
  misc_feature 1..9873: note = derived and/or modified CDS sequence (opt5) from DENV-3__FJ639807__SS-prME
  source 1..9873: mol_type = other RNA
acaagcctgtgcctcatgatgatcctgcccgccgctcttgccttccacctgacatcccgggacggagagcctcggatgattgtggggaagaacgaacgcggaaaatctctcctgtttaagacggcgagcggcatcaatatgtgtacccttattgctatggatctgggggaaatgtgcgacgatacagtgacctacaaatgtccgcacatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacacgatcggagtgctggagcagggcaaacggacccttacacctcagcccatggagctgaagtactcttggaaaacctgggggaaggccaagattgtcacagccgaaacccaaaactccagcttcatcattgatggacctaatacacccgagtgcccgtctgcttccagagcgtggaacgtgtgggaagtggaggactatggctttggcgtcttcaccacgaatatctggctcaaactgcgcgaagtttacacacagctgtgtgaccaccggcttatgagcgccgctgtgaaggatgagagagccgtgcacgccgacatggggtactggatcgagtcccagaaaaacggatcttggaagctcgaaaaagctagcctgattgaggtcaagacctgcacctggcctaagtcccatacactgtggtctaatggcgtgctcgaaagcgatatgatcattcccaaatccctggccgggcctatcagccagcacaactatcgccccggataccatacccaaacggcgggcccttggcaccttgggaagctggagctcgactttaattattgcgagggaacaaccgttgtgattacagaaaactgtggcacccggggcccctctctgagaacaaccacggtctccgggaaactgatccacgagtggtgctgtcgcagctgcacccttccgcctctccggtacatgggagaagatggctgttggtatgggatggagatcagacccatttctgaaaaggaggagaatatggtgaaatccctggttagcgctggatctggcgaagtggacaacttcacaatgggggtcctgtgcctcgccatcctgtttgaggaagtgatgcggggaaagttcggcaagaaacatatgattgccggcgttttctttaccttcgtgcttctgctcagcgggcagatcacatggcgcgatatggctcacaccctgattatgatcggatccaatgccagcgacagaatgggcatgggggtcacgtacctggcgcttattgctacatttaagatccagcccttcctggccctcggatttttcctgcggaaactcacctctagagagaacctgcttctgggcgtggggctcgccatggctacaaccctgcaactgcctgaagatatcgagcagatggccaatggaattgctcttggcctgatggccctcaagctgatcacccagtttgagacatatcagctctggacggcgctgatttcccttacctgtagcaacacaatcttcaccctgacagtggcctggcgcaccgctacgctcattctggccggcgtctccctgcttccggtttgccaatctagctccatgcggaaaacagactggctgcccatgaccgtggctgccatgggggtgcctcccctccctctgtttatcttctctctcaaggataccctgaagagacgcagctggccccttaatgaaggagtcatggccgtgggcctggtttccatcctggcttctagcctcctgagaaacgacgtgcctatggcggggccccttgtcgccggaggcctgctcattgcttgttacgtgatcacagggacctccgccgatctgacagttgagaaagccgctgacgtgacgtgggaagaggaagccgagcagaccggagtcagccataacctcatgattacagtggacgatgacggcaccatgcggatcaaggatgacgagacagaaaatattctgaccgtccttctgaaaacggcgctgctcatcgtgtctggcatctttccgtactccattcctgctaccctgcttgtttggcacacatggcagaagcagacccaacgcagcggggtgctgtgggatgtcccctctcctcccgagacacagaaagccgaactcgaggagggagtgtatagaatcaagcagcagggcattttcgggaaaacccaagttggagtgggcgtccagaaggaaggggtgtttcatacaatgtggcacgtgacgcggggagccgttctgacctacaacggcaagcgcctcgagccgaattgggcttccgtcaaaaaggacctgatcagctatggcgggggatggagactttctgcccagtggcaaaaaggcgaagaggtccaggtgattgcggtcgaacctgggaagaaccccaaaaatttccagacaatgcctggaaccttccagaccacaacgggcgagatcggggctattgccctggattttaagcccggaacctccggcagccccatcatcaaccgggagggcaaggtggttgggctgtacggaaatggcgtggtcaccaagaacgggggatatgtgtccggcattgcccaaaccaatgctgaacctgacgggccgacacccgagctcgaagaggaaatgttcaagaaacgcaacctgaccatcatggatcttcaccctggcagcggaaagacgagaaaatacctgcccgccattgttcgggaggctatcaagcgcagactccggacactgattctcgcccctaccagagtggtcgcggccgagatggaagaggctctgaagggccttcccatccgctatcagaccacagccaccaaatctgaacatacagggcgggagatcgtggacctgatgtgccacgctacctttacgatgagactgctcagccctgttcgcgtgccgaattacaacctgattatcatggatgaagcccatttcacagaccccgcctccattgctgcgcggggatacatctctaccagagtcggcatgggggaggccgctgccatttttatgacagccacccctcccggaacggctgatgccttccctcagagcaatgcgcccatccaggacgaggaacgcgacatcccggagcggtcctggaactctggcaatgaatggattaccgattttgctgggaagacagtgtggttcgtgcctagcatcaaagccggcaacgacattgccaactgtcttagaaagaatggcaaaaaggtcatccaactgtcccgcaagacctttgatacagagtatcagaaaaccaagctcaacgactgggatttcgttgtgacaaccgacatttctgagatgggagctaattttaaagccgatcgggtgatcgaccccagacggtgcctgaagcccgtcattctgacggatgggcctgaacgcgtgatcctcgcgggacccatgcctgttacagccgctagcgccgctcagagacggggccgcgtggggagaaacccgcagaaagagaatgaccaatacatcttcaccggacagccccttaacaatgatgaagaccacgcccattggaccgaggctaagatgctgctggacaacattaatacacctgaaggcatcattcccgccctcttcgagcctgagcgggaaaagtccgcggccatcgatggggagtatagactgaaaggcgaaagccgcaagacctttgtcgagcttatgcggagaggagacctgcccgtgtggctcgctcacaaagttgcctctgaaggcattaagtacacagatcgcaaatggtgcttcgacgggcagcggaacaatcagatcctggaggagaacatggatgtggaaatctggacgaaggagggagagaagaagaagctgagaccgcgctggctcgacgctcggacctattccgatcctcttgccctgaaagagtttaaggacttcgccgctggcagaaaaagcattgcgctggatctcgtcacagaaatcgggcgcgtgcccacccacctggcccatagaacacggaatgctcttgacaacctggtcatgctccacacctctgagcatggaggcaaggcctaccgccacgccgtggaggaactgcctgagacgatggaaaccctgctccttctgggcctgatgattctcctgacagggggagctatgctttttctgatctccggcaaagggattggaaagaccagcatcggcctcatctgtgttattgcctcctctgggatgctgtggatggcggagatccccctgcaatggattgccagcgctatcgtgctcgagttctttatgatggtgcttctgattcctgaacccgagaagcagagaacaccgcaggataatcaactggcctatgtcgttatcggcattctcaccctggctgccacgatcgcggccaacgaaatgggccttctggagacaaccaaacgggacctcggcatgtccaaggaacctggggtggtgagccccacatcttacctggatgtcgacctgcaccccgcttccgcctggaccctctacgctgtggccaccacagttatcacgcctatgcttcgccataccattgagaatagcacagctaacgtgtctctggccgcgatcgccaaccaggctgtcgtgctgatgggactcgacaaaggctggccgattagcaagatggatctgggggtcccccttctggccctcggatgctattcccaggtgaatcctctgaccctgacagctgccgttctccttctgatcacccactacgccattatcggccccgggctgcaggcgaaagctacgagagaggcccaaaagcggacagctgccggaatcatgaagaaccctaccgtggacggcattatgaccatcgatctcgaccccgtcatttatgattctaaattcgaaaagcagctgggccaggtgatgcttctggttctctgtgccgtgcagctgctgctcatgagaacaagctgggctctttgcgaggccctgaccctggcgacagggcctatcacgaccctctgggaaggatccccgggcaaattttggaatacaaccattgccgtctctatggctaacatcttccgcgggagctacctggccggagctggccttgccttttccatcatgaaaagcgtggggacaggaaaacggggcaccggctctcaaggggagacgctgggagaaaagtggaagaaaagactcaatcagctgtcccgcaaggagttcgacctgtataaaaagagcggcattaccgaggtggatcggacagaagcgaaagaggggctcaagagaggagaaatcacccatcacgccgtttcccggggctctgctaaacttcagtggtttgtcgagcgcaacatggtgattcccgaagggagagtgatcgacctgggatgtggccggggcgggtggagctactattgcgccggactgaagaaggtcacagaggttcgcggctacaccaaagggggacctggccatgaggaacccgtgcctatgtccacatacgggtggaatattgtgaagctcatgtctggaaaagatgtcttctatctgcccccggagaagtgtgacacccttctgtgcgatatcggcgaaagctcccctagccccacggtggaggagtctagaacaattcgggttctcaaaatggtggaaccctggctgaagaacaatcagttctgtatcaaggtcctgaacccttacatgcccaccgtgatcgagcacctcgaacgccttcaaagaaaacacggcgggatgctggttcggaatcctctgtcccgcaacagcacccatgagatgtattggatttctaatggaacaggcaacatcgtggcttccgtcaatatggtgagcagactcctgcttaaccggtttacgatgacccacagacgcccgacaattgaaaaggacgtggatctgggggccggaacccggcatgtcaacgctgagcccgagacacctaatatggacgttatcggcgaaagaattaaacgcatcaaggaggaacacaactctacctggcactacgacgatgagaatccctataaaacatgggcctaccatgggagctatgaagtgaaggcgaccggatccgcctctagcatgatcaacggcgtggtcaagctcctgacgaaaccttgggacgtggttcccatggtgacccagatggctatgacagataccacaccgttcggccagcaacgggtctttaaggagaaagtggacaccagaacgcctcgctccatgcccgggacacggagagttatgggaattaccgccgagtggctgtggcgcacactcggccggaataagaaacctagactgtgcacccgcgaagagttcacgaagaaggtgcggaccaacgctgccatgggggccgtctttacagaagagaatcagtgggatagcgcgaaagctgccgtggaagacgaggatttctggaaacttgttgacagagagcgcgaactgcacaaactcggaaagtgtggctcctgcgtgtacaacatgatggggaaaagagagaagaaactgggcgaatttggaaaggccaagggctctcgggctatctggtacatgtggcttggggcccgctatctggagttcgaggctctcggatttctgaatgaagatcattggttcagcagagagaactcctactctggcgtcgaaggggagggactgcacaaactcggctatattctgcgggacatcagcaagattcccgggggcgccatgtacgcggatgacaccgccggatgggacacaagaatcaccgaagatgaccttcataatgaggagaaaatcacacagcagatggatcctgaacaccggcaactggctaacgccatttttaagctcacctatcagaataaagtggtcaaggtgcagcgccccacgccgacaggcaccgttatggacatcatttccagaaaggatcagcgggggtctggacaagtgggcacctacgggctgaacacattcaccaatatggaggctcagcttatccgccagatggaaggagagggcgtcctgagcaaagccgacctcgaaaaccctcatctgcccgagaagaaaattacacagtggctggagacgaagggggtggaaagactcaaacggatggcgatctccggcgatgactgcgtggttaagcccatcgatgaccgctttgccaacgctctgcttgccctgaatgatatgggaaaggtgagaaaagacattcctcaatggcagccgagcaagggctggcatgattggcagcaggtccccttctgttctcaccatttccacgagctcatcatgaaagacgggcggaagctggtggttccttgccgcccccaagacgaacttattggacgggctcggatctcccagggcgccgggtggagcctgcgcgagaccgcttgtctcggaaaagcctatgcgcagatgtggtctctgatgtactttcacagacgggatctgcgcctcgcctccaacgctatttgcagcgccgtgcctgtccattgggtgcccacatctagaaccacatggtccatccacgcccatcaccaatggatgaccacggaagacatgctgaccgtctggaatcgggtgtggattgaggataacccttggatggaggacaagacacccgttaccacatgggaaaatgtgccgtaccttggcaagagagaggatcagtggtgtgggagcctgatcggcctcacctcccgcgctacgtgggcccagaacatccctacagcgattcagcaagtccggagcctgatcggaaatgaagagttccttgactatatgccctctatgaaaagatttcgcaaggaggaagagagcgaaggcgctatttggtga

SEQ ID NO: 20801 - RNA, 9873 nt, synthetic construct
  misc_feature 1..9873: note = derived and/or modified CDS sequence (opt5) from DENV-3__FJ639810__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccagaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctcggggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacacagggtgtgtcatcaattggaaaggaaaggagctgaagtgcggcagcgggattttcgtgacgaacgaggttcatacctggacagaacagtacaaatttcaagccgattcccccaagcggctggcgaccgccatcgctggcgcctgggagaatggagtgtgtggcattagaagcacaacccgcatggaaaaccttctctggaaacagatcgctaatgagctgaactatatcctgtgggaaaataacattaagctcacggtcgtggttggggacatcattggagtgctggagcagggcaaacggacccttacacctcagcccatggagctgaagtactcttggaaaacctgggggaaggccagaatcgtcacagccgaaacccaaaactccagcttcattatcgatggacctaatacacccgagtgcccgaacacctctcgcgcttggaatgtgtgggaagtggaggactatggctttggcgtcttcacgacaaacatctggctcaagctgcgggaagtttacacccagctgtgtgaccacagacttatgtccgcggccgtgaaagatgagcgcgctgtgcacgccgacatggggtactggattgagagccagaagaatggatcctggaaactcgaaaaggcctctctgatcgaggtcaaaacctgcacatggcctaagagccataccctgtggtccaacggcgtgctcgaatctgatatgattatccccaagagcctggctgggcctatttcccagcacaattatcggcccggataccatacgcaaacagccggcccttggcaccttgggaaactggagctcgactttaactattgcgagggaaccacagttgtgatcaccgaaaattgtggcacaagaggccccagcctgcgcaccacgaccgtctctgggaagctgatccacgagtggtgctgtcggtcctgcacacttccgcctctcagatacatgggagaagatggctgttggtatgggatggagattcggcccatcagcgaaaaagaggagaacatggtgaagtctctggtttccgcgggaagcggcgaagtggacaatttcaccatgggggtcctgtgcctcgctattctgtttgaggaagtgatgcgcggaaaattcggcaagaagcatatgatcgccggcgttcttttcacatttgtgctgctcctgtctgggcagattacctggagagatatggcccacacgctgatcatgattggaagcaacgcttccgaccggatgggcatgggggtcacataccttgccctgatcgcgaccttcaaaatccagccctttctcgctctgggattctttctcagaaagctgacaagccgcgagaatcttctgctcggcgtggggctggccatggccaccaccctgcaacttcctgaagatattgagcagatggctaacggaatcgccctgggcctcatggctctgaaactcattacacagttcgagacgtatcagctgtggaccgcccttatctctctgacatgttccaataccatttttacactcaccgtggcgtggcggacggccacactgatcctggctggcgtcagccttctgccggtttgccaatcctctagcatgagaaagaccgactggctccccatgaccgtggccgctatgggggtgcctcccctgcctctcttcatcttttgtctgaaagatacacttaagcgcagatcctggcccctgaacgaaggagtcatggccgtgggcctggtttctattctcgccagctccctgcttcggaacgacgtgcctatggctgggcccctggtcgcgggaggcctcctgatcgcctgctacgtgattaccgggacatctgctgatctcacggttgagaaggccgccgacgtgacctgggaagaggaagctgagcagacaggagtcagccataatctgatgatcaccgtggacgatgacggcacaatgcgcattaaagatgacgagaccgaaaacatccttacggtcctgctgaagaccgccctcctgatcgtgtccggcattttcccgtacagcatccctgcgacacttctggtttggcacacctggcagaaacagacacaaagatctggggtgctctgggatgtcccctcccctcccgagacccagaaggctgaactggaggagggagtgtatcggattaaacagcagggcatctttgggaagacacaagttggagtgggcgtccagaaagaaggggtgttccatacgatgtggcacgtgacccgcggagccgttctcacatacaatggcaagagactggagccgaactgggccagcgtcaagaaagaccttatttcttatggcgggggatggcggctgtccgctcagtggcaaaagggcgaagaggtgcaggtgatcgccgtcgaacctgggaaaaatcccaagaactttcagaccatgcctggaaccttccagacaacgaccggcgagattggggcgatcgctctggatttcaaacccggaacaagcggctctcccatcattaatcgcgagggcaaggtggttgggctctacggaaacggcgtggtcaccaagaatgggggatatgtgtccggcatcgcccaaacaaacgccgaacctgacgggccgacccccgagctggaagaggaaatgtttaaaaagagaaatcttacgattatggatctgcaccctggcagcggaaaaacacggaagtacctccccgctatcgttcgcgaggccattaaaagacggctgagaaccctcatcctggctcctacccgcgtggtcgccgcggagatggaagaggcccttaagggcctgcccatccggtatcagacaaccgctacaaagtccgaacataccgggagagagattgtggacctgatgtgtcacgccacgttcacaatgcgcctcctgagccctgttcgggtgccgaactacaatcttatcattatggatgaagctcattttaccgaccccgcctctatcgccgctagaggatacattagcacacgcgtcggcatgggggaggcggccgctatcttcatgaccgccacgcctcccggaaccgccgatgcttttcctcagtccaacgcccccatccaggacgaggaacgggacattccggagagatcttggaatagcggcaacgaatggatcacagatttcgcggggaaaaccgtgtggtttgtgccttccattaaggctggcaacgacatcgccaattgcctgcgcaaaaacggaaagaaagtcattcaactctctcggaagacattcgataccgagtatcagaagacaaaactgaatgactgggattttgttgtgaccacggacatcagcgagatgggcgccaacttcaaggctgatagagtgattgacccccggcgctgcctgaaacccgtcatcctcacagatgggcctgaaagagtgatccttgccggacccatgcctgttaccgcggcctccgctgcccagcggcgcggcagagtggggcggaatccgcagaaggagaacgaccaatacatttttaccggacagcccctgaataacgatgaagaccacgctcattggacagaggccaaaatgctgctcgacaatatcaacacccctgaaggcattatgcccgctctgttcgagcctgagagagaaaagtctgccgcgatcgatggggagtatcgccttaagggcgaaagccggaaaacattcgtcgagctgatgagacgcggagacctccccgtgtggctggcccacaaggttgcttccgaaggcattaaatacacggatcggaagtggtgttttgacgggcagagaaataaccagatcctggaggagaatatggatgtggaaatctggaccaaagagggagaaaagaaaaagctccgcccgcggtggcttgacgccagaacatatagcgatcctctggctctgaaggagttcaaagactttgccgccggccgcaagtctattgctctcgatctggtcaccgaaatcgggagagtgcccacacaccttgcgcatcggacccgcaacgccctggacaatctcgtcatgctgcacacgtccgagcatggaggcaaagcttacagacacgccgtggaggaactgcctgagaccatggaaacactccttctgctgggcctcatgattctgcttaccgggggagccatgctgttcctcatcagcggcaaggggattggaaaaacatctatcggcctgatctgcgttattgcttccagcgggatgctgtggatggccgagatccccctccaatggattgcgtccgccatcgtgcttgagtttttcatgatggtgctgctgattcctgaacccgagaagcagcggaccccgcaggataaccaactcgcttatgtcgttatcggaattctgacgcttgccgctatcatcgccgcgaatgaaatgggcctgctcgagacaaccaagcgcgacctgggcatgtctaaagaacctggggtggtgagccccacatcctacctggatgtcgacctccaccccgccagcgcttggaccctttacgccgtggctaccacagttattacgcctatgctgagacataccatcgagaactctacagccaacgtgtccctggctgccattgcgaatcaggccgtcgtgctcatgggactggacaagggctggccgatcagcaaaatggatcttggggtccccctgctcgctctgggatgttattctcaggtgaaccctctgaccctcacagccgctgttcttctgctgattacccactacgccatcatcggccccgggctccaggccaaggcgacgcgggaggctcaaaaaagaacagccgctggaattatgaagaatcctaccgtggacggcatcatgaccattgatctggaccccgtcatctatgatagcaagtttgaaaaacagcttggccaggtgatgctgctcgttctgtgcgccgtgcagctgctccttatgcgcacatcctgggccctgtgtgaggctctgaccctcgccacagggcctattacgaccctgtgggaaggatctccgggcaagttctggaacacaaccatcgcggtcagcatggccaatatctttcgggggtcctaccttgctggagccggcctggctttctctattatgaaaagcgtggggacaggaaagagaggcaccggctcccaaggggagacgctcggagaaaaatggaagaagaaactgaaccagctgagccgcaaggagtttgacctctataaaaagtctggcatcaccgaggtggatcggacagaagccaaagaggggcttaagagaggagaaattacccatcacgcggtttcccggggcagcgccaaactgcagtggttcgtcgagcgcaatatggtgatccccgaagggagagtgattgacctgggatgcggccggggcgggtggtcctactattgtgctggactcaagaaggtcacagaggttcgcggctacaccaaagggggacctggccatgaggaacccgtgcctatgtctacatacgggtggaacatcgtgaagctgatgagcggaaaagatgtcttttatcttcccccggagaagtgcgacaccctgctctgtgatattggcgaatcctctcctagccccacggtggaggagtccagaacaatccgggttctgaaaatggtggaaccctggctgaagaataaccagttctgcatcaaggtcctcaatccttacatgcccgccgtgattgagcaccttgaacgcctgcaaagaaaacacggcgggatgctggttcggaaccctctcagccgcaattctacccatgagatgtattggatctccaacggaaccggcaatattgtggctagcgtcaacatggtgtctagactgcttctgaaccggttcacaatgacgcacagacgcccgaccatcgaaaaggacgtggatctcggggccggaacacggcatgtcaatgctgagcccgagacccctaacatggacgttattggcgaaagaatcaaacgcatcaaggaggaacacaattccacatggcactacgacgatgagaacccctataaaacctgggcctaccatgggagctatgaagtgaaggcgacaggatctgccagctccatgattaatggcgtggtcaagctgctgaccaaaccttgggacgtggttcccatggtgacgcagatggctatgaccgatacaaccccgtttggccagcaacgggtcttcaaggagaaagtggacacaagaacccctcgctctatgcccgggacgcggagagttatgggaatcacagccgagtggctctggcgcaccctgggccggaacaagaaacctagactttgtacacgcgaagagtttaccaagaaggtgcggacgaatgctgccatgggggccgtcttcaccgaagagaaccagtgggatagcgcgaaagctgccgtggaagacgaggatttttggaagctggttgacagagagcgcgaactccacaaactgggaaagtgcggctcctgcgtgtacaatatgatggggaaaagagagaagaaacttggcgaattcggaaaggccaagggcagccgggctatttggtacatgtggctgggggcccgctatctcgagtttgaggctctgggattcctgaacgaagatcattggttttccagagagaattcttacagcggcgtcgaaggggagggactccacaaactgggctatatccttcgggacatttccaagatccccgggggcgccatgtacgcggatgacacagccggatgggacaccagaatcacagaagatgacctgtataacgaggagaaaattacccagcagatggatcctgaacatcggcaactcgctaatgccatcttcaagctgacataccagaacaaagtggtcaaggtgcagcgccccaccccgacgggcacagttatggacattatctctagaaaggatcagcgggggagcggacaagtgggcacctatgggcttaatacctttacaaacatggaggctcagctgattcgccagatggaaggagagggcgtcctctccaaagccgacctggaaaaccctcacctgcccgagaagaaaatcacccagtggctcgagacaaagggggtggaaagactgaaacggatggcgatctctggcgatgactgtgtggttaagcccattgatgaccgcttcgccaatgctcttctggccctcaacgatatgggaaaggtgagaaaagacatccctcaatggcagccgagcaagggctggcacgattggcagcaggtccccttttgctcccatcacttccatgagctgattatgaaagacgggcggaagcttgtggttccttgtcgcccccaagacgaactgatcggaagagctcggattagccagggcgccgggtggtctctccgcgagacggcttgcctgggaaaagcctacgcgcagatgtggtccctgatgtacttccacagacgggatctccgcctggccagcaatgctatctgttctgccgtgcctgtccactgggtgcccacctccagaacaacctggagcattcatgcccaccatcaatggatgacaaccgaagacatgcttacggtctggaaccgggtgtggatcgaggataatccttggatggaggacaagacccccgttacaacctgggaaaacgtgccgtatctgggcaagagagaggatcagtggtgcgggtctctcatcggcctgacatcccgcgctacctgggcccagaatattcctacggcgatccagcaagtccggagccttattggaaacgaagagtttctggactacatgccctccatgaaaagattccgcaaggaggaagagagcgaaggcgctatctggtga

SEQ ID NO: 20802 - RNA, 9873 nt, synthetic construct
  misc_feature 1..9873: note = derived and/or modified CDS sequence (opt5) from DENV-3__FJ639816__SS-prME
  source 1..9873: mol_type = other RNA
accagcctgtgcctcatgatgatcctgcccgccacacttgctttccacctgacgtccagagacggcgagcctcggatgattgtggggaagaacgaacgcggaaaatctctcctgtttaagaccgccagcggcatcaatatgtgtacacttattgcgatggatctgggggagatgtgcgacgataccgtcacatacaaatgtccgcatatcaccgaagttgagcccgaagacattgattgctggtgtaacctcacatccacctgggtgacgtatggaacctgcaatcaggctggcgagcacagacgggacaagcgctctgtggccctggcccctcatgtcgggatgggactggatacaagaacccaaacatggatgagcgctgagggcgcctggcggcaggtggaaaaagttgagacctgggctctccgccaccccggcttcacgatcctggccctttttctggcgcattacatcgggacatccctcacccagaaggtggtcattttcatcctgcttatgctggtgacaccttctatgaccatgagatgtgttggagtgggcaaccgggactttgtcgaagggctcagcggagccacctgggtggatgtggtcctggagcacggcgggtgcgttacaacgatggctaagaataaacccaccctggacattgagctccagaagacagaagccacccaactggctacacttcgcaaactgtgtatcgagggaaagattaccaacatcacgacagattccagatgccctacccagggcgaagccgtgctcccggaggaacaggaccagaattatgtgtgtaaacacacctacgtcgatcggggctgggggaacggatgcggcctgttcgggaagggaagccttgtgacatgcgcgaagtttcaatgtctggagcccattgagggcaaagttgtgcagtatgaaaatctcaagtacaccgtcatcatcacagtgcatacgggggaccagcaccaggttggaaacgagacccaaggcgtgacagccgaaattacccctcaggcttctacaaccgaggccatcctgcccgaatatggcacgctggggctcgagtgctcccctcgcaccggactggacttcaatgagatgattcttctgacaatgaaaaacaaggcttggatggtccatagacagtggtttttcgatctccccctgccgtggaccagcggcgccacaaccgaaacgcctacatggaatcggaaagagcttctggtgacctttaagaacgcccacgctaaaaagcaagaagtcgtggttctcgggtctcaggagggagcgatgcacacagccctgaccggcgctaccgaaatccagaattccgggggcacaagcattttcgccggacatctgaagtgtcgcctcaaaatggacaagctggagcttaaaggcatgtcttacgccatgtgcacgaacacctttgtgctgaagaaagaggtctccgaaacacagcacgggaccatcctcatcaaggtggagtacaagggagaagatgttccctgtaaaattcctttcagcacagaggacgagcaaggcaaggctcataacgggagactgatcaccgccaatcccgtggtcacgaaaaaggaagagcccgtgaacattgaagcggagcctccgttcggagaatccaatatcgtgattggcatcggggataacgctctgaaaatcaattggtataagaagggctctagcattggaaaaatgtttgaggccacagcccggggcgctagacgcatggccatccttggggacaccgcttgggatttcggatccgttggcggggtcctcaacagcctgggaaagatggtgcaccagatttttggctctgcctacaccgcgctgttctccggggtgagctgggtcatgaaaatcggcattggagtgctcctgacatggatcggccttaattctaagaacaccagcatgtccttttcttgcattgccatcgggatcattacactgtatctcggagctgttgtgcaggccgacatgggctgtgtcatcaattggaaagggaaggagctgaagtgcggaagcggcattttcgtgacgaacgaagttcatacctggacagagcagtacaaatttcaagctgattcccccaagcggctggccaccgcgatcgccggggcttgggaaaatggcgtgtgtggaattagaagcacaacccgcatggagaaccttctctggaaacagatcgccaatgaactgaactatatcctgtgggagaataacattaagctcacggtcgtggttggcgacatcattggggtgctggagcagggaaaacggacccttacacctcagcccatggaactgaagtactcttggaaaacctggggcaaggctagaatcgtcacagccgagacccaaaactccagcttcattatcgatgggcctaatacacccgaatgcccgtctgcctcccgcgcttggaacgtgtgggaggtggaagactatggatttggcgtcttcaccacgaatatctggctcaagctgcgggaggtttacacacagctgtgtgaccacagacttatgagcgcggccgtgaaagatgagcgcgctgtgcacgccgacatgggctactggattgaatcccagaagaacgggtcttggaaactcgagaaggccagcctgatcgaagtcaaaacctgcacctggcctaagtcccatacactgtggtctaatggagtgctcgagagcgatatgattatccccaagtccctggctggccctattagccagcacaactatcggcccgggtaccatacccaaacggccggaccttggcaccttggcaaactggagctcgactttaattattgcgaagggacaaccgttgtgatcacagagaactgtggaaccagaggcccctctctgcgcacaaccacggtctccggcaagctgatccacgaatggtgctgtcggagctgcacccttccgcctctcagatacatgggggaggatggatgttggtatggcatggaaattcggcccatctctgagaaagaggaaaatatggtgaagtccctggttagcgcggggtctggagaggtggacaacttcacaatgggcgtcctgtgcctcgctattctgtttgaagaggtgatgcgcgggaaattcggaaagaagcatatgatcgccggcgttttctttaccttcgtgcttctgctcagcggccagattacatggagagatatggcccacaccctgatcatgattgggtccaatgctagcgaccggatgggaatgggcgtcacgtacctggcccttatcgcgacatttaaaatccagcccttcctggctctcgggtttttcctgagaaagctcacctctcgcgaaaacctgcttctgggagtgggcctcgccatggccacaaccctgcaactgcctgaggatattgagcagatggctaatgggatcgcccttggactgatggctctcaaactgattacccagtttgaaacatatcagctctggacggccctgatctcccttacctgtagcaacacaattttcaccctgacagtggcgtggcggaccgccacgctcatcctggctggcgtctccctgcttccggtttgccaatctagctccatgagaaagacagactggctgcccatgaccgtggccgctatgggcgtgcctcccctccctctgtttatcttctctctcaaagataccctgaagcgcagaagctggccccttaatgagggggtcatggccgtgggactggtttccattctggcctctagcctcctgcggaacgacgtgcctatggctggcccccttgtcgcggggggactgctcatcgcctgttacgtgattacaggcacctccgctgatctgacagttgaaaaggccgccgacgtgacgtgggaggaagaggctgagcagaccggggtcagccataacctcatgatcacagtggacgatgacggaaccatgcgcattaaagatgacgaaacagagaatatcctgaccgtccttctgaagacggccctgctcatcgtgtctggcatttttccgtactccatccctgcgaccctgcttgtttggcacacatggcagaaacagacccaaagaagcggcgtgctgtgggatgtcccctctcctcccgaaacacagaaggctgagctcgaggaaggggtgtatcggattaaacagcagggaatcttcggcaagacccaagttggggtgggagtccagaaagagggcgtgtttcatacaatgtggcacgtgacgcgcggggccgttctgacctacaacggaaagagactcgaaccgaattgggcctccgtcaagaaagacctgattagctatggcggcgggtggcggctttctgctcagtggcaaaagggagaggaagtgcaggtgatcgccgtcgagcctggcaaaaaccccaagaatttccagacaatgcctgggaccttccagaccacaacgggagagattggcgcgatcgctctggattttaaacccgggacctccggaagccccatcattaaccgcgaaggcaagatcgtgggcctgtacgggaatggagttgtgacaaagaacggcgggtatgtctccggaattgcccaaaccaatgccgagcctgacggcccgacacccgaactcgaggaagagatgttcaaaaagagaaacctgaccatcatggatcttcaccctgggagcggcaaaacgcggaagtacctgcccgctattgtgcgcgaggccatcaaaagacggctcagaacactgatcctcgctcctacccgcgttgtggccgcggaaatggaggaagccctgaagggacttcccattcggtatcagaccacagctaccaagtctgagcatacaggcagagaaatcgtcgacctgatgtgccacgccacctttacgatgcgcctgctcagccctgtgcgggttccgaattacaacctgattatcatggatgaggctcatttcacagaccccgcctccattgccgctagagggtacatctctacccgcgtgggaatgggcgaggcggccgctatctttatgacagccacccctcccgggacggccgatgctttccctcagagcaatgcccccattcaggacgaagagcgggacatcccggaaagatcctggaactctggaaatgagtggattaccgattttgcgggcaaaacagtctggttcgtgcctagcatcaaggctgggaacgacattgccaactgtcttcgcaaaaatggcaagaaagtgatccaactgtcccggaagacctttgatacagagtatcagaagaccaaactcaacgactgggatttcgtcgttacaaccgacatttctgaaatgggagccaattttaaggctgatagagtgatcgacccccggcgctgcctgaaacccgtgatcctgacggatggccctgagagagtcattctcgccgggcccatgcctgtgacagcggccagcgctgcccagcggcgcggaagagttggccggaacccgcagaaggaaaatgaccaatacatcttcaccgggcagccccttaacaatgatgaggaccacgctcattggaccgaagccaaaatgctgctggacaacattaatacacctgagggaatcattcccgctctcttcgagcctgaaagagagaagtccgccgcgatcgatggcgaatatcgcctgaagggggagagccggaaaacctttgtggaacttatgagacgcggcgacctgcccgtctggctcgcccacaaggtggcttctgagggaatcaaatacacagatcggaagtggtgcttcgacggccagagaaacaatcagattctggaggaaaacatggatgttgagatctggacgaaagaaggggagaagaaaaagctgcgcccgcggtggctcgacgccagaacctattccgatcctcttgctctgaaggaatttaaagacttcgccgccggacgcaagagcattgctctggatctcgtgacagagatcggcagagtccccacccacctggcgcatcggacacgcaatgcccttgacaacctggtgatgctccacacctctgagcatgggggaaaagcttacagacacgccgtcgaagagctgcctgaaacgatggagaccctgctccttctgggcctgatgattctcctgacaggcggggccatgctttttctgatctccggaaagggcatcgggaaaaccagcattggactcatctgtgtgattgcttcctctggcatgctgtggatggccgagatccccctgcaatggattgcgagcgccatcgttctcgaattctttatgatggtgcttctgattcctgagcccgaaaagcagcggacaccgcaggataatcaactggcttatgtggtcatcgggatcctcaccctggccgctacgattgccgcgaacgagatgggacttctggaaacaaccaagcgcgacctcggcatgtccaaagagcctggcgttgtgagccccacatcttacctggatgtggacctgcaccccgcctccgcttggaccctctacgccgtcgctaccacagtgatcacgcctatgcttagacataccattgagaatagcacagccaacgtttctctggctgccatcgcgaaccaggccgtggtcctgatggggctcgacaagggatggccgattagcaaaatggatctgggcgtgccccttctggctctcgggtgctattcccaggtcaatcctctgaccctgacagccgctgtgctccttctgatcacccactacgccatcattggacccggcctgcaggccaaggcgacgcgggaagctcaaaaaagaacagccgctgggatcatgaagaaccctaccgttgacggaattatgaccatcgatctcgaccccgtgatttatgattctaagttcgagaaacagctgggccaggtcatgcttctggtgctctgtgccgttcagctgctgctcatgcgcacaagctgggccctttgcgaagctctgaccctggccacaggccctatcacgaccctctgggaggggtccccgggaaagttttggaatacaaccatcgcggtgtctatggccaacattttccggggcagctacctggctggggccggacttgctttttccgtcatgaaaagcgtgggcacagggaagagaggaaccggctctcaaggcgaaacgctgggggagaaatggaagaagaaactcaatcagctgtcccgcaaggagttcgacctgtataaaaagagcggaatcaccgaagtggatcggacagaggccaaagaaggcctcaagagaggggagattacccatcacgcggtttcccggggatctgccaaacttcagtggtttgtcgaacgcaacatggtgatccccgagggcagagtgattgacctggggtgtggacggggcggctggagctactattgcgctgggctgaagaaggtcacagaggttcgcggatacaccaaaggcgggcctggacatgaagagcccgtgcctatgtccacatacggctggaatatcgtgaagctcatgtctgggaaagatgtcttctatctgcccccggaaaagtgtgacacccttctgtgcgatattggagagagctcccctagccccacggtggaggaatctagaacaatccgggttctcaaaatggtggagccctggctgaagaacaatcagttctgtatcaaggtcctgaacccttacatgcccaccgtgattgaacacctcgagcgccttcaaagaaaacacggcggcatgctggttcggaatcctctgtcccgcaacagcacccatgaaatgtattggatctctaatgggacaggaaacattgtggcctccgtcaatatggtgagcagactcctgcttaaccggtttacgatgacccacagacgcccgacaatcgagaaggacgtggatctgggcgctgggacccggcatgtcaacgccgagcccgaaacacctaatatggacgttattggagagagaatcaaacgcatcaaggaagagcacaactctacctggcactacgacgatgaaaatccctataaaacatgggcttaccatggcagctatgaggtgaaggccaccgggtccgcgtctagcatgattaacggagtggtcaagctcctgacgaaaccttgggacgtggttcccatggtgacccagatggccatgacagataccacaccgttcggccagcaacgggtctttaaggagaaagtggacaccagaacgcctcgctccatgcccggcacacggagagttatggggatcaccgctgaatggctgtggcgcacactcggacggaataagaaacctagactgtgcacccgcgaggaattcacgaagaaggtgcggaccaacgccgctatgggcgccgtctttacagaggaaaatcagtgggatagcgccaaagcggctgtggaggacgaggatttctggaagcttgttgacagagaacgcgagctgcacaaactcgggaagtgtggatcctgcgtgtacaacatgatgggcaaaagagaaaagaaactgggggagtttggcaaggccaagggatctcgggccatttggtacatgtggcttggcgctcgctatctggagttcgaagccctcgggtttctgaatgaggatcattggttcagcagagaaaactcctactctggagtcgagggcgaagggctgcacaaactcggatatatcctgcgggacattagcaagatccccggcggggctatgtacgccgatgacaccgcgggctgggacacaagaatcaccgaggatgaccttcataatgaggaaaaaattacacagcagatggatcctgagcaccggcaactggccaacgctatctttaagctcacctatcagaataaagtggtcaaggtgcagcgccccacgccgacaggaaccgttatggacattatctccagaaaggatcagcggggctctgggcaagtgggaacctacggcctgaacacattcaccaatatggaagcccagcttattcgccagatggagggggaaggagtcctgagcaaagctgacctcgagaaccctcacctgcccgagaagaaaatcacacagtggctggaaacgaagggcgtggagagactcaaacggatggccatctccggggatgactgcgtggttaagcccattgatgaccgctttgcgaacgccctgcttgctctgaatgatatgggcaaggtgagaaaagacatccctcaatggcagccgagcaagggatggcatgattggcagcaggtccccttctgttctcaccatttccacgaactcattatgaaagacggccggaagctggtggttccttgccgcccccaagacgagcttatcgggagagcccggatttcccagggagctggctggagcctgcgcgaaaccgcctgtctcgggaaagcttatgcccagatgtggtctctgatgtactttcacagacgggatctgcgcctcgcgtccaacgccatctgcagcgctgtgcctgtccattgggtgcccacatctagaaccacatggtccattcacgcccatcaccaatggatgaccacggaggacatgctgaccgtctggaatcgggtgtggatcgaggataacccttggatggaagacaagacacccgttaccacatgggagaatgtgccgtaccttggaaagagagaagatcagtggtgtggcagcctgatcgggctcacctcccgcgccacgtgggctcagaacattcctacagccatccagcaagtccggagcctgattggcaatgaggagttccttgactatatgccctctatgaaaagatttcgcaaggaagaggaaagcgagggagcgatctggtga

SEQ ID NO: 20803 - RNA, 9873 nt, synthetic construct
  misc_feature 1..9873: note = derived and/or modified CDS sequence (opt5) from DENV-3__FJ639817__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacgtgaccacggattccagatgccctacacagggcgaagcggtgctcccggaggaacaggaccagaattatgtctgtaaacacacctacgtggatcggggctgggggaacggatgcggcctgttcgggaagggaagccttgttacctgcgccaagtttcaatgtctggagcccatcgagggcaaagtggtccagtatgaaaatctcaagtacacagtgattatcaccgttcatacaggggaccagcaccaggtgggaaacgagacgcaaggcgtcaccgctgaaatcacacctcaggcctctaccacagaggctattctgcccgaatatggcaccctggggctcgagtgctcccctcgcacgggactggacttcaatgagatgatccttctgaccatgaaaaacaaggcctggatggtgcatagacagtggtttttcgatctccccctgccgtggacaagcggcgccaccacagaaacccctacgtggaatcggaaagagcttctggtcacatttaagaacgctcacgcgaaaaagcaagaagtggttgtgctcgggtctcaggagggagccatgcacaccgctctgacaggcgccaccgaaattcagaattccgggggcaccagcatcttcgccggacatctgaagtgtcgcctcaaaatggacaagctggagcttaaaggcatgtcttacgctatgtgcacaaacacgtttgtcctgaagaaagaggtgtccgaaacccagcacgggacaattctcatcaaggttgagtacaagggagaagatgtgccctgtaaaatccctttcagcaccgaggacggccaagggaaggcccataacggaagactgattacagcgaatcccgtcgtgaccaaaaaggaggaacccgtgaacatcgaggctgaacctccgttcggcgagtccaatattgttatcgggattggcgataacgccctgaaaatcaattggtataagaagggatctagcatcggcaaaatgtttgaagccacggctcggggggccagacgcatggctattcttggagacacagcctgggatttcggctccgtcgggggagtgctcaacagcctgggcaagatggtgcaccagatctttgggtctgcgtacaccgccctgttctccggcgtcagctgggtgatgaaaattggaatcggcgttctcctgacctggattgggcttaattctcggaacacaagcatgtccttttcttgcatcgctattggaatcatcaccctgtatctcggcgccgtggtccaggctgacatggggtgtgtgattaattggaagggaaaagagctgaagtgcggcagcgggatcttcgttacaaacgaggtgcatacgtggaccgaacagtacaagtttcaagccgattcccccaaaagactggcgacagccattgctggcgcctgggagaatggagtctgtggcatccgcagcaccacacggatggaaaaccttctctggaagcagattgctaatgagctgaactatatcctgtgggaaaataacatcaaactcaccgtggttgtgggggacattatcggagtcctggagcagggcaagagaacgcttacccctcagcccatggagctgaaatactcttggaagacatgggggaaagccaagattgtgaccgccgaaacacaaaactccagcttcatcattgatggacctaatacccccgagtgcccgtctgcttcccgcgcgtggaacgtgtgggaagtcgaggactatggctttggcgttttcacaaccaatatctggctcaagctgcgggaagtgtacacgcagctgtgtgaccacagacttatgagcgccgctgtgaaagatgagcgcgccgtccacgccgacatggggtactggatcgagtcccagaagaacggatcttggaaactcgaaaaggctagcctgattgaggtgaaaacatgcacctggcctaagtcccataccctgtggtctaatggcgttctcgaaagcgatatgatcattcccaagtccctggccgggcctatcagccagcacaactatcggcccggataccatacacaaaccgcgggcccttggcaccttgggaaactggagctcgactttaattattgcgagggaacgacagtggtcattaccgaaaactgtggcacaagaggcccctctctgcgcaccacaaccgtgtccgggaagctgatccacgagtggtgctgtcggagctgcacgcttccgcctctcagatacatgggagaagatggctgttggtatgggatggagatccggcccatttctgaaaaagaggagaatatggttaagtccctggtgagcgctggatctggcgaagtcgacaacttcaccatgggggtgctgtgcctcgccatcctgtttgaggaagttatgcgcggaaaattcggcaagaagcatatgattgccggcgtgttctttacattcgtccttctgctcagcgggcagatcacctggagagatatggctcacacactgattatgatcggatccaatgccagcgaccggatgggcatgggggtgacctacctggcgcttattgctacgtttaaaatccagcccttcctggccctcggatttttcctgagaaagctcacatctcgcgagaacctgcttctgggcgtggggctcgccatggctaccacactgcaactgcctgaagatatcgagcagatggccaatggaattgctcttggcctgatggccctcaaactgatcacccagtttgagacctatcagctctggacagcgctgatttcccttacgtgtagcaacaccatcttcacactgaccgtcgcctggcggacagctaccctcattctggccggcgtttccctgcttccggtgtgccaatctagctccatgagaaagacggactggctgcccatgacagtggctgccatgggggtccctcccctccctctgtttatcttctctctcaaagataccctgaagcgcagaagctggccccttaatgaaggagtgatggccgttggcctggtgtccatcctggcttctagcctcctgcggaacgacgtccctatggcggggccccttgtggccggaggcctgctcattgcttgttacgttatcaccgggacatccgccgatctgaccgtggagaaggccgctgacgtcacatgggaagaggaagccgagcagacgggagtgagccataacctcatgattaccgtcgacgatgacggcacaatgcgcatcaaagatgacgagaccgaaaatattctgacagtgcttctgaagaccgcgctgctcatcgtttctggcatctttccgtactccattcctgctacgctgcttgtgtggcacacctggcagaaacagacacaaagaagcggggtcctgtgggatgtgccctctcctcccgagacccagaaggccgaactcgaggagggagtttatcggatcaaacagcagggcattttcgggaagacacaagtgggagtcggcgtgcagaaagaaggggtgtttcataccatgtggcacgttacacgcggagccgtcctgacgtacaacggcaagagactcgagccgaattgggcttccgtgaagaaagacctgatcagctatggcgggggatggcggctttctgcccagtggcaaaagggcgaagaggtgcaggtcattgcggtggaacctgggaaaaaccccaagaatttccagaccatgcctggaacattccagaccaccacaggcgagatcggggctattgccctggattttaaacccggaacgtccggcagccccatcatcaaccgcgagggcaaggttgtggggctgtacggaaatggcgtcgtgaccaagaacgggggatatgtttccggcattgcccaaacaaatgctgaacctgacgggccgacccccgagctcgaagaggaaatgttcaaaaagagaaacctgacaatcatggatcttcaccctggcagcggaaaaacccggaagtacctgcccgccattgtgcgcgaggctatcaaaagacggctcagaacgctgattctcgcccctacacgcgtcgtggcggccgagatggaagaggctctgaagggccttcccatccggtatcagaccaccgccacaaagtctgaacataccgggagagagatcgttgacctgatgtgccacgctacatttaccatgcgcctgctcagccctgtgcgggtcccgaattacaacctgattatcatggatgaagcccatttcacggaccccgcctccattgctgcgagaggatacatctctacacgcgtgggcatgggggaggccgctgccatttttatgaccgccacacctcccggaaccgctgatgccttccctcagagcaatgcgcccatccaggacgaggaacgggacatcccggagagatcctggaactctggcaatgaatggattacggattttgctgggaaaaccgtgtggttcgtccctagcatcaaggccggcaacgacattgccaactgtcttcgcaaaaatggaaagaaagttatccaactgtcccggaagacatttgataccgagtatcagaagacaaaactcaacgactgggatttcgtggtgaccacagacatttctgagatgggcgctaattttaaggccgatagagtcatcgacccccggcgctgcctgaaacccgtgattctgaccgatgggcctgaaagagttatcctcgcgggacccatgcctgtgacggccgctagcgccgctcagcggcgcggcagagtcgggcggaacccgcagaaggagaatgaccaatacatcttcacaggacagccccttaacaatgatgaagaccacgcccattggaccgaggctaaaatgctgctggacaacattaatacccctgaaggcatcattcccgccctcttcgagcctgagagagaaaagtccgcggccatcgatggggagtatcgcctgaagggcgaaagccggaaaacatttgtggagcttatgagacgcggagacctgcccgtttggctcgctcacaaggtggcctctgaaggcattaaatacaccgatcggaagtggtgcttcgacgggcagagaaacaatcagatcctggaggagaacatggatgtcgaaatctggacaaaagagggagaaaagaaaaagctgcgcccgcggtggctcgacgctagaacgtattccgatcctcttgccctgaaggagtttaaagacttcgccgctggccgcaagagcattgcgctggatctcgtgaccgaaatcgggagagtccccacacacctggcccatcggacccgcaatgctcttgacaacctggtgatgctccacacatctgagcatggaggcaaagcctacagacacgccgttgaggaactgcctgagaccatggaaacgctgctccttctgggcctgatgattctcctgaccgggggagctatgctttttctgatctccggcaaggggattggaaaaacaagcatcggcctcatctgtgtgattgcctcctctgggatgctgtggatggcggagatccccctgcaatggattgccagcgctatcgtgctcgagttctttatgatggtccttctgattcctgaacccgagaagcagcggaccccgcaggataatcaactggcctatgttgtgatcggaattctcacactggctgccatcatcgcggccaacgaaatgggccttctggagaccacgaagcgcgacctcggcatgtccagagaacctggggtggtcagccccacatcttacctggatgtggacctgcaccccgcttccgcctggaccctctacgctgttgccacaaccgtgattacccctatgcttcggcatacaatcgagaatagcacggctaacgtctctctggccgcgattgccaaccaggctgtggtcctgatgggactcgacaaaggctggccgatcagcaagatggatctgggggtgccccttctggccctcggatgctattcccaggttaatcctctgaccctgacagctgccgtgctccttctgattacccactacgccatcatcggccccgggctgcaggcgaaagctacaagagaggcccaaaagcgcaccgctgccggaattatgaaaaaccctacggtcgacggcatcatgacaattgatctcgaccccgtgatctatgattctaagttcgaaaagcagctgggccaggttatgcttctggtgctctgtgccgtccagctgctgctcatgcggaccagctgggctctttgcgaggccctgaccctggcgacagggcctattaccacactctgggaaggatccccgggcaaattttggaatacgaccatcgccgtgtctatggctaacatcttcagagggagctacctggccggagctggccttgccttttccattatgaagagcgtggggacaggaaaacgcggcaccggctctcaaggggagacactgggagaaaagtggaaaaagaagctcaatcagctgtcccggaaagagttcgacctgtataagaaaagcggcatcaccgaggttgatagaacggaagcgaaggaggggctcaaacggggagaaattacccatcacgccgtctcccgcggctctgctaagcttcagtggtttgtggagagaaacatggtgatccccgaagggcgggtcattgacctgggatgtggccgcggcgggtggagctactattgcgccggactgaaaaaggttacagaggtgagaggctacaccaaggggggacctggccatgaggaacccgtgcctatgtccacatacgggtggaatatcgtcaaactcatgtctggaaaggatgtgttctatctgcccccggagaaatgtgacacccttctgtgcgatattggcgaaagctcccctagccccacagttgaggagtctcggaccatccgcgtgctcaagatggtcgaaccctggctgaaaaacaatcagttctgtatcaaggtgctgaacccttacatgcccgctgttattgagcacctcgaaagacttcaacggaagcacggcgggatgctggtgcgcaatcctctgtccagaaacagcacgcatgagatgtattggatctctaatggaacaggcaacattgtcgcctccgtgaatatggtgagccggctcctgcttaacagatttaccatgacccaccgccggccgacaatcgaaaaagacgtcgatctgggggctggaacgagacatgttaacgccgagcccgagacccctaatatggacgtgattggcgaacgcatcaagcggatcaaagaggaacacaactctacatggcactacgacgatgagaatccctataagacctgggcgtaccatgggagctatgaagtgaaagccacaggatccgcttctagcatgattaacggcgtcgtgaagctcctgaccaagccttgggacgttgtgcccatggtcacacagatggccatgaccgatacgaccccgttcggccagcaaagagtgtttaaagagaaggttgacacacgcacccctcggtccatgcccgggacaagacgcgtgatgggaatcaccgctgagtggctgtggcggacgctcggcagaaataaaaagcctcgcctgtgcacacgggaagagttcaccaaaaaggtcagaacaaacgccgccatgggggcggtgtttaccgaagagaatcagtgggatagcgctaaggccgccgttgaagacgaggatttctggaaacttgtggaccgcgagagagaactgcacaagctcggaaaatgtggctcctgcgtctacaacatgatggggaagcgggagaaaaagctgggcgaatttggaaaagctaagggctctcgcgccatttggtacatgtggcttggggctagatatctggagttcgaggccctcggatttctgaatgaagatcattggttcagccgggagaactcctactctggcgtggaaggggagggactgcacaagctcggctatatcctgagagacattagcaaaatccccgggggcgcgatgtacgccgatgacacggctggatgggacacccggatcacagaagatgaccttcataatgaggagaagattacccagcagatggatcctgaacaccgccaactggccaacgctatctttaaactcacatatcagaataaggtcgtgaaagttcagagacccaccccgacaggcaccgtgatggacattatctcccggaaggatcagcgcgggtctggacaagtcggcacgtacgggctgaacacattcaccaatatggaggcccagcttattagacagatggaaggagagggcgtgctgagcaaggcggacctcgaaaaccctcacctgcccgagaaaaagatcacccagtggctggagacaaaaggggtggaacggctcaagcgcatggccatctccggcgatgactgcgttgtgaaacccattgatgacagatttgctaacgccctgcttgctctgaatgatatgggaaaggtccggaaggacatccctcaatggcagccgagcaaaggctggcatgattggcagcaggtgcccttctgttctcaccatttccacgagctcattatgaaggacgggcgcaaactggttgtgccttgcagaccccaagacgaacttatcggacgggcccgcatttcccagggcgctgggtggagcctgagagagaccgcctgtctcggaaaggcgtatgcccagatgtggtctctgatgtactttcaccggcgcgatctgagactcgcttccaacgccatctgcagcgccgtccctgtgcattgggtccccacatctcggacgacctggtccattcacgctcatcaccaatggatgacaaccgaagacatgctgacagtgtggaatagagtttggatcgaggataacccttggatggaggacaaaacccccgtgacgacctgggaaaatgtcccgtaccttggcaagcgcgaggatcagtggtgtgggagcctgatcggcctcacatcccgggccacctgggcgcagaacattcctacagctatccagcaagtgagaagcctgattggaaatgaagagttccttgactatatgccctctatgaagcgctttcggaaagaggaagagagcgaaggcgccatctggtga

SEQ ID NO: 20804 - RNA, 9873 nt, synthetic construct
  misc_feature 1..9873: note = derived and/or modified CDS sequence (opt5) from DENV-3__FJ639825__SS-prME
  source 1..9873: mol_type = other RNA
acaagcctctgcctcatgatgatcctgcccgccgctcttgccttccacctgacatcccgggacggcgaacctcggatgattgtggggaagaacgaacgcggaaagtctctcctgtttaagacggcgagcggcatcaatatgtgtacccttattgctatggatctgggggaaatgtgcgacgatacagtgacctacaaatgtccgcatatcacagaagttgaacccgaagacattgattgctggtgtaacctcacctccacatgggtgacctatggaacgtgcaatcaggccggcgaacaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggattacaagggagaggacgttccctgtaaaattcctttcagcaccgaagatggccaagggaaggcccataacggaagactgatcacagcgaatcccgtggtcaccaaaaaggaggagcccgtgaacattgaagctgagcctccgttcggcgaatccaatatcgtgattgggatcggcgacaacgccctgaaaatcaattggtataagaagggatctagcattggcaaaatgtttgaggccacggctagaggggccagacgcatggctatccttggagatacagcctgggacttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgatacagggtgtgtcatcaattggaaaggaaaggaactgaagtgcggcagcgggattttcgtgacgaacgaggttcatacctggacagagcagtacaaatttcaagccgactcccccaagcggctggcgaccgccatcgctggcgcctgggaaaatggagtgtgtggcattagaagcacaacccgcatggagaaccttctctggaaacagatcgctaatgaactgaactatatcctgtgggagaataacattaagctcacggtcgtggttggggatatcattggagtgctggaacagggcaaacggacccttacacctcagcccatggagctgaagtactcttggaaaacctgggggaaggccaagatcgtcacagccgagacccaaaactccagcttcattatcgacggacctaatacacccgaatgcccgtctgcttccagagcgtggaacgtgtgggaggtggaagactatggctttggcgtcttcaccacgaatatctggctcaaactgcgcgaggtttacacacagcagtgtgatcaccggctgatgagcgccgctgtgaaggacgaaagagccgtgcacgccgatatggggtactggattgagtcccagaaaaacggatcttggaaacttgagaaagctagcctcatcgaagtcaagacctgcacctggcctaagtcccatacactgtggtctaatggcgtgctggagagcgacatgattatccccaaatccctcgccgggcctattagccaacacaactatcgccccggataccatacccagacggcgggcccttggcacctggggaaacttgaactggattttaattattgcgagggaacaaccgttgtgatcacagagaactgtggcacccggggcccctctctcagaacaaccacggtctccgggaaactgatccacgaatggtgctgtcgcagctgcaccctgccgcctcttcggtacatgggagaggacggctgttggtatgggatggaaattagacccatctctgagaaggaagagaatatggtgaaatccctcgttagcgctggatctggcgaggtggataacttcacaatgggggtcctgtgcctggccattctctttgaagaggtgatgcggggaaagttcggcaagaaacatatgatcgccggcgttttctttaccttcgtgctgcttctgagcgggcagattacatggcgcgacatggctcacaccctcatcatgattggatccaatgccagcgatagaatgggcatgggggtcacgtacctggcgctgatcgctacatttaagatccaacccttccttgccctgggatttttcctccggaaactgacctctagagaaaacctcctgcttggcgtggggctggccatggctacaaccctccagctgcctgaggacattgaacagatggccaatggaatcgctctgggccttatggccctgaagctcattacccagtttgagacatatcaactgtggacggcgctcatctccctgacctgtagcaacacaattttcacccttacagtggcctggcgcaccgctacgctgatcctcgccggcgtctccctgctgccggtttgccagtctagctccatgcggaaaacagattggcttcccatgaccgtggctgccatgggggtgcctcccctgcctctctttatcttctctctgaaggacaccctcaagagacgcagctggcccctgaatgagggagtcatggccgtgggccttgtttccattctggcttctagcctgctcagaaacgatgtgcctatggcggggcccctggtcgccggaggccttctgatcgcttgttacgtgattacagggacctccgccgacctcacagttgaaaaagccgctgacgtgacgtgggaggaagaggccgaacagaccggagtcagccataacctgatgatcacagtggatgacgatggcaccatgcggattaaggacgatgagacagagaatatcctcaccgtcctgcttaaaacggcgctgctgatcgtgtctggcatttttccgtactccatccctgctaccctcctggtttggcacacatggcagaagcaaacccagcgcagcggggtgctttgggacgtcccctctcctcccgaaacacagaaagccgagctggaagagggagtgtatagaattaagcagcaaggcatcttcgggaaaacccaggttggagtgggcgtccagaaggagggggtgtttcatacaatgtggcacgtgacgcggggagccgttctcacctacaacggcaagcgcctggaaccgaattgggcttccgtcaaaaaggatctcattagctatggcgggggatggagactgtctgcccaatggcagaaaggcgaggaagtccaggtgatcgcggtcgagcctgggaagaaccccaaaaatttccagacaatgcctggaaccttccaaaccacaacgggcgaaattggggctatcgcccttgactttaagcccggaacctccggcagccccatcattaaccgggagggcaaggtggttgggctgtacggaaatggcgtggtcaccaagaacgggggatatgtgtccggcatcgcccagaccaatgctgagcctgatgggccgacacccgaactggaggaagagatgttcaagaaacgcaacctcaccattatggacctgcaccctggcagcggaaagacgagaaaataccttcccgccatcgttcgggaagctattaagcgcagactgcggacactcatcctggcccctaccagagtggtcgcggccgagatggaggaagctctcaagggcctgcccatccgctatcagaccacagccaccaaatctgagcatacagggcgggaaattgtggatcttatgtgccacgctacctttacgatgagactgctgagccctgttcgcgtgccgaattacaacctcatcattatggacgaggcccatttcacagatcccgcctccatcgctgcgcggggatacatttctaccagagtcggcatgggggaagccgctgccatctttatgacagccacccctcccggaacggctgacgccttccctcagagcaatgcgcccatccaagacgaggagcgcgatattccggaacggtcctggaactctggcaatgagtggatcaccgactttgctgggaagacagtgtggttcgtgcctagcattaaagccggcaacgatatcgccaactgtctgagaaagaatggcaaaaaggtcattcagctttcccgcaagacctttgacacagaatatcagaaaaccaagctgaacgattgggacttcgttgtgacaaccgatatctctgagatgggagctaattttaaagccgaccgggtgattgatcccagacggtgcctcaagcccgtcatcctgacggacgggcctgagcgcgtgatcctggcgggacccatgcctgttacagccgctagcgccgctcagagacggggccgcgtggggagaaacccgcaaaaagaaaatgatcagtacattttcaccggacagcccctcaacaatgacgaggaccacgcccattggaccgaagctaagatgcttctggataacatcaatacacctgagggcattatccccgccctgttcgaacctgagcgggagaagtccgcggccattgacggggaatatagactcaaaggcgagagccgcaagacctttgtcgaactgatgcggagaggagatcttcccgtgtggctggctcacaaagttgcctctgagggcatcaagtacacagaccgcaaatggtgcttcgatgggcagcggaacaatcaaatcctcgaagagaacatggacgtggagatttggacgaaggaaggagagaaaaagaagctgagaccgcgctggctggatgctcggacctattccgaccctctcgcccttaaagaatttaaggatttcgccgctggcagaaaaagcatcgcgctggacctggtcacagagattgggcgcgtgccctctcacctcgcccatagaacccggaatgctctggataaccttgtcatgctgcacacatccgaacatggaggcaaggcctaccgccacgccgtggaggagctccctgaaaccatggagacgctgctgctccttggcctgatgatcctgctcaccgggggagctatgctgtttcttattagcggcaaagggatcggaaagacatccatcggcctgatttgtgttatcgcctctagcgggatgctctggatggcggaaattcccctgcagtggatcgcctccgctattgtgctggagttctttatgatggtgctccttatccctgagcccgaaaagcagagaaccccgcaagacaatcagctggcctatgtcgttattggaatcctgacactcgctgccatcattgcggccaacgagatgggcctgcttgaaaccacgaaacgggatctgggcatgagcaaggagcctggggtggtgtctcccacatcctacctcgacgtcgacctgcaccccgctagcgcctggaccctgtacgctgtggccacaaccgttatcacccctatgctccgccatacaattgaaaattctacggctaacgtgagccttgccgcgatcgccaaccaggctgtcgtgctgatgggactggataaaggctggccgatttccaagatggacctcggggtccccctgcttgccctgggatgctattctcaggtgaatcctctcaccctgacagctgccgttctgctccttatcacccactacgccatcattggccccgggctgcaagcgaaagctacaagagaggcccagaagcggaccgctgccggaatcatgaagaaccctacggtggatggcattatgacaatcgacctggatcccgtcatttatgacagcaaattcgagaagcagctcggccaggtgatgctgcttgttctgtgtgccgtgcaactcctgctgatgagaacctcctgggctctctgcgaagcccttaccctggcgacagggcctatcaccacactgtgggagggatctccgggcaaattttggaatacgaccatcgccgtcagcatggctaacattttccgcgggtcctacctcgccggagctggcctggcctttagcatcatgaagtctgtggggacaggaaaacggggcaccggctcccagggggaaacacttggagagaagtggaagaaaaagctgaatcagctcagcagaaaagagttcgatctgtataagaaatccggcattaccgaggtggaccgcacggaggcgaaggaagggctgaaacggggagagatcacccatcacgccgtttctagaggcagcgctaagctccagtggtttgtcgaacggaacatggtgattcccgaggggcgcgtgatcgatcttggatgtggcagaggcgggtggtcctactattgcgccggactgaagaaagtcacagaagttcggggctacaccaaagggggacctggccatgaggagcccgtgcctatgtctacatacgggtggaatattgtgaaactgatgagcggaaaggacgtcttctatctgcccccggaaaaatgtgataccctgctttgcgacatcggcgagtccagcccttctcccacagtggaagagtcccgcaccatcagagttctgaagatggtggagccctggctcaagaacaatcaattctgtattaaagtcctgaacccttacatgcccacggtgatcgaacacctggagcggctccagcgcaagcacggcgggatgcttgttagaaatcctctgagccggaactctacacatgaaatgtattggatttccaatggaaccggcaacatcgtggctagcgtcaatatggtgtctcgcctgctcctgaacagatttaccatgacacaccggagaccgacgattgagaaagatgtggaccttggggccggaacccgccatgtcaacgctgaacccgagacacctaatatggacgttatcggcgagcggatcaagagaattaaagaagaacacaacagcacctggcactacgatgacgaaaatccctataagacatgggcctaccatgggtcctatgaggtgaaggcgaccggatctgccagctccatgatcaacggcgtggtcaaactgctcacaaagccttgggatgtggttcccatggtgacccagatggctatgacggacaccacaccgttcggccaacagcgcgtctttaaagaaaaggtggatacccggacacctagaagcatgcccgggacccgccgggttatgggaattacggccgagtggctgtggagaacactgggccgcaataaaaagcctcggctctgcaccagagaggagttcacaaagaaagtgcgcaccaacgctgccatgggggccgtctttacggaggaaaatcagtgggactccgcgaaggctgccgtggaggatgaagacttctggaaactggttgatcgggagagagagcttcacaagctgggaaaatgtggctcttgcgtgtacaacatgatggggaagcgcgagaagaagctcggcgagtttggaaaggccaaaggcagcagagctatctggtacatgtggctgggggcccggtatcttgagttcgaggctctgggatttctcaatgaggaccattggttctcccgcgaaaactcttacagcggcgtcgagggggaaggactgcacaagctgggctatattctcagagatatctccaaaatccccgggggcgccatgtacgcggacgacaccgccggatgggatacacggattaccgaggacgatctgcataatgaagagaagatcacacagcaaatggaccctgagcacaaacagcttgctaacgccatttttaagctgacctatcagaataaggtggtcaaagtgcagagacccacaccgaccggcacggttatggatatcatttctcggaaggaccaacgcgggagcggacaggtgggcacatacgggctcaacaccttcaccaatatggaagctcagctgatcagacagatggagggagaaggcgtcctttccaaagccgatctggagaaccctcacctccccgaaaagaaaatcacacaatggctggagaccaagggggtggagcggctgaagcgcatggcgattagcggcgacgattgcgtggttaaacccatcgacgatagatttgccaacgctctcctggcccttaatgacatgggaaaggtgcggaaagatattcctcagtggcagccgtctaagggctggcatgactggcagcaagtccccttctgttcccaccatttccacgaactgatcatgaaagacgggcgcaagctcgtggttccttgcagaccccaggatgagctgattggacgggctcgcatcagccagggcgccgggtggtctcttagagaaacagcttgtctgggaaaggcctatgcgcaaatgtggtccctcatgtactttcaccggcgcgacctgagactggccagcaacgctatttgctctgccgtgcctgtccattgggtgcccacgtcccggaccacatggagcatccacgcccatcaccagtggatgaccacagaggatatgctcaccgtctggaatcgcgtgtggatcgaagacaacccttggatggaggataaaacgcccgttaccacatgggagaatgtgccgtacctgggcaagagagaagaccagtggtgtgggtcccttattggcctgaccagccgggctacatgggcccagaacatccctaccgcgattcaacaggtcagatctctcatcggaaatgaggagttcctggattatatgcccagcatgaaacgctttcggaaggaggaggaatccgagggcgctatttggtga

SEQ ID NO: 20805 - RNA, 9873 nt, synthetic construct
  misc_feature 1..9873: note = derived and/or modified CDS sequence (opt5) from DENV-3__FJ639826__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccagaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctcggggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacacagggtgtgtcatcaattggaaaggaaaggagctgaagtgcggcagcgggattttcgtgacgaacgaggttcatacctggacagaacagtacaaatttcaagccgattcccccaagcggctggcgaccgccatcgctggcgcctgggagaatggagtgtgtggcattagaagcacaacccgcatggaaaaccttctctggaaacagatcgctaatgagctgaactatatcctgtgggaaaataacattaagctcacggtcgtggttggggacatcattggagtgctggagcagggcaaacggacccttacacctcagcccatggagctgaagtactcttggaaaacctgggggaaggccagaatcgtcacagccgaaacccaaaactccagcttcattatcgatggacctaatacacccgagtgcccgaacacctctcgcgcttggaatgtgtgggaagtggaggactatggctttggcgtcttcacgacaaacatctggctcaagctgcgggaagtttacacccagctgtgtgaccacagacttatgtccgcggccgtgaaagatgagcgcgctgtgcacgccgacatggggtactggattgagagccagaagaatggatcctggaaactcgaaaaggcctctctgatcgaggtcaaaacctgcacatggcctaagagccataccctgtggtccaacggcgtgctcgaatctgatatgattatccccaagagcctggctgggcctatttcccagcacaattatcggcccggataccatacgcaaacagccggcccttggcaccttgggaaactggagctcgactttaactattgcgagggaaccacagttgtgatcaccgaaaattgtggcacaagaggccccagcctgcgcaccacgaccgtctctgggaagctgatccacgagtggtgctgtcggtcctgcacacttccgcctctcagatacatgggagaagatggctgttggtatgggatggagattcggcccatcagcgaaaaagaggagaacatggtgaagtctctggtttccgcgggaagcggcgaagtggacaatttcaccatgggggtcctgtgcctcgctattctgtttgaggaagtgatgcgcggaaaattcggcaagaagcatatgatcgccggcgttttctttacattcgtgcttctgctctctgggcagattacctggagagatatggcccacacgctgatcatgattggaagcaacgctacagaccggatgggcatgggggtcacctacctggcccttatcgcgacatttaaaatccagcccttcctggctctcggatttttcctgagaaagctcacctcccgcgagaatctgcttctgggcgtggggctcgccatggccaccacactgcaactgcctgaagatattgagcagatggctaacggaatcgcccttggcctgatggctctcaaactgattacgcagtttgagacctatcagctctggacagccctgatcagccttacctgttctaatacaattttcaccctgacggtggcgtggcggacagccaccctcatcctggctggcgtctccctgcttccggtttgccaaagctcctctatgagaaagaccgactggctgcccatgacagtggccgctatgggggtgcctcccctccctctgtttatcttcagcctcaaagataccctgaagcgcagatcctggccccttaacgaaggagtcatggccgtgggcctggtttctattctggccagctccctcctgcggaacgacgtgcctatggctgggccccttgtcgcgggaggcctgctcatcgcctgttacgtgattacagggacgtctgctgatctgaccgttgagaaggccgccgacgtgacatgggaagaggaagctgagcagaccggagtcagccataatctcatgatcacagtggacgatgacggcaccatgcgcattaaagatgacgagacggaaaacatcctgaccgtccttctgaagacagccctgctcatcgtgtccggcatttttccgtacagcatccctgcgaccctgcttgtttggcacacatggcagaaacagacccaaagatctggggtgctgtgggatgtcccctcccctcccgagacacagaaggctgaactcgaggagggagtgtatcggattaaacagcagggcatcttcgggaagacgcaagttggagtgggcgtccagaaagaaggggtgtttcataccatgtggcacgtgacacgcggagccgttctgacctacaatggcaagagactcgagccgaactgggccagcgtcaagaaagacctgatttcttatggcgggggatggcggctttccgctcagtggcaaaagggcgaagaggtgcaggtgatcgccgtcgaacctgggaaaaatcccaagaacttccagaccatgcctggaacattccagacgaccacaggcgagattggggcgatcgctctggattttaaacccggaaccagcggctctcccatcattaatcgcgagggcaaggtggttgggctgtacggaaacggcgtggtcacaaagaatgggggatatgtgtccggcatcgcccaaaccaacgccgaacctgacgggccgacgcccgagctcgaagaggaaatgttcaaaaagagaaatctgacaattatggatcttcaccctggcagcggaaaaacccggaagtacctgcccgctatcgttcgcgaggccattaaaagacggctcagaaccctgatcctcgctcctacacgcgtggtcgccgcggagatggaagaggccctgaagggccttcccatccggtatcagaccacagctaccaagtccgaacatacggggagagagattgtggacctgatgtgccacgccacatttaccatgcgcctgctcagccctgttcgggtgccgaactacaatctgatcattatggatgaagctcatttcacagaccccgcctctatcgccgctagaggatacattagcacccgcgtcggcatgggggaggcggccgctatctttatgacggccacccctcccggaacagccgatgctttccctcagtccaacgcccccatccaggacgaggaacgggacattccggagagatcttggaatagcggcaacgaatggatcaccgattttacagggaaaaccgtgtggttcgtgccttccattaaggcgggcaacgacatcgctaattgtcttcgcaaaaacggaaagaaagtcattcaactgtctcggaagacatttgataccgagtatcagaagacgaaactcaatgactgggatttcgttgtgacaaccgacatcagcgagatgggcgccaactttaaggccgatagagtgattgacccccggcgctgcctgaaacccgtcatcctgaccgatgggcctgaaagagtgatcctcgctggacccatgcctgttacagccgcgtccgccgctcagcggcgcggcagagtggggcggaatccgcagaaggagaacgaccaatacattttcaccggacagccccttaataacgatgaagaccacgcccattggacagaggctaaaatgctgctggacaatatcaacacgcctgaaggcattatccccgccctcttcgagcctgagagagaaaagtctgctgccattgatggggagtatcgcctgaagggcgaaagccggaaaacctttgtcgagcttatgagacgcggagacctgcccgtgtggctcgcgcacaaggttgcctccgaaggcatcaaatacacagatcggaagtggtgcttcgacgggcagagaaataaccagatcctggaggagaatatggatgtggaaatttggaccaaagagggagaaaagaaaaagctgcgcccgcggtggctcgacgctagaacatatagcgatcctcttgccctgaaggagtttaaagacttcgctgccggccgcaagtctatcgccctggatctcgtcaccgaaattgggagagtgcccacgcacctggctcatcggacccgcaacgcgcttgacaatctggtcatgctccacacatccgagcatggaggcaaagcctacagacacgctgtggaggaactgcctgagaccatggaaacactgctccttctgggcctgatgatcctcctgaccgggggagccatgctttttctgattagcggcaaggggatcggaaaaacgtctatcggcctcatttgtgttatcgcctccagcgggatgctgtggatggctgagattcccctgcaatggatcgcctccgcgattgtgctcgagttctttatgatggtgcttctgatccctgaacccgagaagcagcggacaccgcaggataaccaactggcctatgtcgttattggaatcctcaccctggctgccatcattgctgccaatgaaatgggccttctggagacaaccaagcgcgacctcggcatgtctaaagaacctggggtggtgagccccacctcctacctggatgtcgacctgcaccccgcgagcgcctggacactctacgctgtggccacgaccgttatcacacctatgcttagacataccattgagaactctacagctaacgtgtccctggccgctatcgccaatcaggcggtcgtgctgatgggactcgacaagggctggccgattagcaaaatggatctgggggtcccccttctggccctcggatgctattctcaggtgaaccctctgaccctgacggctgccgttctccttctgatcacacactacgctatcattggccccgggctgcaggccaaggccacccgggaggcgcaaaaaagaaccgctgccggaatcatgaagaatcctacagtggacggcattatgaccatcgatctcgaccccgtcatttatgatagcaagttcgaaaaacagctgggccaggtgatgcttctggttctctgtgctgtgcagctgctgctcatgcgcacatcctgggccctttgcgaggccctgacgctggctaccgggcctatcacaaccctctgggaaggatctccgggcaagttttggaacacaaccatcgccgtcagcatggcgaatattttccgggggtcctacctggccggagctggccttgccttttctatcatgaaaagcgtggggacgggaaagagaggcaccggctcccaaggggagacactgggagaaaaatggaagaagaaactcaaccagctgagccgcaaggagttcgacctgtataaaaagtctggcattaccgaggtggatcggacagaagctaaagaggggctcaagagaggagaaatcacccatcacgccgtttcccggggcagcgcgaaacttcagtggtttgtcgagcgcaatatggtgattcccgaagggagagtgatcgacctgggatgtggccggggcgggtggtcctactattgcgccggactgaagaaggtcacagaggttcgcggctacaccaaagggggacctggccatgaggaacccgtgcctatgtctacgtacgggtggaacattgtgaagctcatgagcggaaaagatgtcttctatctgcccccggagaagtgtgacacacttctgtgcgatatcggcgaatcctctcctagccccaccgtggaggagtccagaaccatccgggttctcaaaatggtggaaccctggctgaagaataaccagttctgtattaaggtcctgaatccttacatgcccgctgtgatcgagcacctcgaacgccttcaaagaaaacacggcgggatgctggttcggaaccctctgagccgcaattctacacatgagatgtattggatttccaacggaacgggcaatatcgtggccagcgtcaacatggtgtctagactcctgcttaaccggtttaccatgacacacagacgcccgaccattgaaaaggacgtggatctgggggctggaacacggcatgtcaatgccgagcccgagacccctaacatggacgttatcggcgaaagaatcaaacgcattaaggaggaacacaattccacatggcactacgacgatgagaacccctataaaacctgggcttaccatgggagctatgaagtgaaggccacgggatctgcgagctccatgatcaatggcgtggtcaagctcctgaccaaaccttgggacgtggttcccatggtgacacagatggccatgaccgatacaaccccgttcggccagcaacgggtctttaaggagaaagtggacacgagaacacctcgctctatgcccgggacccggagagttatggagattacagctgaatggctgtggcgcaccctcggacggaacaagaaacctagactgtgcacgcgcgaggaattcaccaagaaggtgcggacaaatgccgctatgggcgccgtctttaccgaggaaaaccagtgggatagcgccaaagcggctgtggaggacgaggatttctggaagcttgttgacagagaacgcgagctgcacaaactcgggaagtgtggatcctgcgtgtacaatatgatgggcaaaagagaaaagaaactgggggagtttggcaaggccaagggaagccgggccatctggtacatgtggcttggcgctcgctatctggagttcgaagccctcgggtttctgaacgaggatcattggttctccagagaaaattcttacagcggagtcgagggcgaagggctgcacaaactcggatatattctgcgggacatctccaagatccccggcggggctatgtacgccgatgacacagcgggctgggacaccagaattacagaggatgaccttcataacgaggaaaaaatcacccagcagatggatcctgagcaccggcaactggccaatgctatttttaagctcacgtatcagaacaaagtggtcaaggtgcagcgccccacaccgaccggaaccgttatggacatcatttctagaaaggatcagcggggcagcgggcaagtgggaacatacggcctgaataccttcacaaacatggaagcccagcttatccgccagatggagggggaaggagtcctgtccaaagctgacctcgagaaccctcacctgcccgagaagaaaatcacgcagtggctggaaaccaagggcgtggagagactcaaacggatggccatttctggggatgactgcgtggttaagcccatcgatgaccgctttgcgaatgccctgcttgctctgaacgatatgggcaaggtgagaaaagacattcctcaatggcagccgagcaagggatggcatgattggcagcaggtccccttctgttcccaccatttccacgaactcatcatgaaagacggccggaagctggtggttccttgccgcccccaagacgagcttattgggagagcccggatcagccagggagctggctggtctctgcgcgaaacagcctgtctcgggaaagcttatgcccagatgtggtccctgatgtactttcacagacgggatctgcgcctcgcgagcaatgccatttgctctgctgtgcctgtccattgggtgcccacctccagaacaacctggagcatccacgcccatcaccaatggatgacgaccgaggacatgctgacagtctggaaccgggtgtggatcgaggataatccttggatggaagacaagacccccgttacaacctgggagaacgtgccgtaccttggaaagagagaagatcagtggtgtggctctctgattgggctcacgtcccgcgccacatgggctcagaatatccctaccgccattcagcaagtccggagcctgatcggcaacgaggagttccttgactatatgccctccatgaaaagatttcgcaaggaagaggaaagcgagggagcgatttggtga

SEQ ID NO: 20806 - RNA, 9873 nt, synthetic construct
  misc_feature 1..9873: note = derived and/or modified CDS sequence (opt5) from DENV-3__FJ810416__SS-prME
  source 1..9873: mol_type = other RNA
accagcctgtgcctcatgatgatcctgcccgccgctcttgccttccacctgacgtcccgggacggcgaacctcggatgattgtggggaagaacgaacgcggaaagtctctcctgtttaagacggcgagcggcatcaatatgtgtacccttattgctatggatctgggggagatgtgcgacgatacagtgacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacatcattggagtgctggagcagggcaaacggacgcttacccctcagcccatggagctgaagtactcttggaaaacatgggggaaggccaagatcgtcaccgccgaaacacaaaactccagcttcattatcgatggacctaatacccccgagtgcccgtctgcttccagagcgtggaacgtgtgggaagtggaggactatggctttggcgtcttcacaaccaatatctggctcaaactgcgcgaagtttacacgcagctgtgtgaccaccggcttatgagcgccgctgtgaaggatgagagagccgtgcacgccgacatggggtactggattgagtcccagaaaaacggatcttggaagctcgaaaaagctagcctgatcgaggtcaagacatgcacctggcctaagtcccataccctgtggtctaatggcgtgctcgaaagcgatatgattatccccaaatccctggccgggcctattagccagcacaactatcgccccggataccatacacaaaccgcgggcccttggcaccttgggaagctggagctcgactttaattattgcgagggaacgacagttgtgatcaccgaaaactgtggcacacggggcccctctctgagaaccacaaccgtctccgggaaactgatccacgagtggtgctgtcgcagctgcacgcttccgcctctccggtacatgggagaagatggctgttggtatgggatggagattagacccatctctgaaaaggaggagaatatggtgaaatccctggttagcgctggatctggcgaagtggacaacttcaccatgggggtcctgtgcctcgccattctgtttgaggaagtgatgcggggaaagttcggcaagaaacatatgatcgccggcgttttctttacattcgtgcttctgctcagcgggcagattacctggcgcgatatggctcacacactgatcatgattggatccaatgccagcgacagaatgggcatgggggtcacctacctggcgcttatcgctacgtttaagatccagcccttcctggccctcggatttttcctgcggaaactcacatctagagagaacctgcttctgggcgtggggctcgccatggctaccacactgcaactgcctgaagatattgagcagatggccaatggaatcgctcttggcctgatggccctcaagctgattacccagtttgagacctatcagctctggacagcgctgatctcccttacgtgtagcaacaccattttcacactgaccgtggcctggcgcacagctaccctcatcctggccggcgtctccctgcttccggtttgccaatctagctccatgcggaaaacggactggctgcccatgacagtggctgccatgggggtgcctcccctccctctgtttatcttctctctcaaggataccctgaagagacgcagctggccccttaatgaaggagtcatggccgtgggcctggtttccattctggcttctagcctcctgagaaacgacgtgcctatggcggggccccttgtcgccggaggcctgctcatcgcttgttacgtgattaccgggacatccgccgatctgaccgttgagaaagccgctgacgtgacatgggaagaggaagccgagcagacgggagtcagccataacctcatgatcaccgtggacgatgacggcacaatgcggattaaggatgacgagaccgaaaatatcctgacagtccttctgaaaaccgcgctgctcatcgtgtctggcatttttccgtactccatccctgctacgctgcttgtttggcacacctggcagaagcagacacaacgcagcggggtgctgtgggatgtcccctctcctcccgagacccagaaagccgaactcgaggagggagtgtatagaattaagcagcagggcatcttcgggaaaacacaagttggagtgggcgtccagaaggaaggggtgtttcataccatgtggcacgtgacacggggagccgttctgacgtacaacggcaagcgcctcgagccgaattgggcttccgtcaaaaaggacctgattagctatggcgggggatggagactttctgcccagtggcaaaaaggcgaagaggtccaggtgatcgcggtcgaacctgggaagaaccccaaaaatttccagaccatgcctggaacattccagaccaccacaggcgagattggggctatcgccctggattttaagcccggaacgtccggcagccccatcattaaccgggagggcaaggtggttgggctgtacggaaatggcgtggtcaccaaaaacgggggatatgtgtccggcatcgcccaaacaaatgctgaacctgacgggccgacccccgagctcgaagaggaaatgttcaagaaacgcaacctgacaattatggatcttcaccctggcagcggaaagaccagaaaatacctgcccgccatcgttcgggaggctattaagcgcagactccggacgctgatcctcgcccctacaagagtggtcgcggccgagatggaagaggctctgaagggccttcccatccgctatcagaccaccgccacaaaatctgaacataccgggcgggagattgtggacctgatgtgccacgctacatttaccatgagactgctcagccctgttcgcgtgccgaattacaacctgatcattatggatgaagcccatttcacggaccccgcctccatcgctgcgcggggatacatttctacaagagtcggcatgggggaggccgctgccatctttatgaccgccacacctcccggaaccgctgatgccttccctcagagcaatgcgcccatccaggacgaggaacgcgacattccggagcggtcctggaactctggcaatgaatggatcacggattttgctgggaagaccgtgtggttcgtgcctagcattaaagccggcaacgacatcgccaactgtcttagaaagaatggcaaaaaggtcattcaactgtcccgcaagacatttgataccgagtatcagaaaacaaagctcaacgactgggatttcgttgtgaccacagacatctctgagatgggagctaattttaaagccgatcgggtgattgaccccagacggtgcctgaagcccgtcatcctgaccgatgggcctgaacgcgtgatcctcgcgggacccatgcctgttacggccgctagcgccgctcagagacggggccgcgtggggagaaacccgcagaaagagaatgaccaatacattttcacaggacagccccttaacaatgatgaagaccacgcccattggaccgaggctaagatgctgctggacaacatcaatacccctgaaggcattatccccgccctcttcgagcctgagcgggaaaagtccgcggccattgatggggagtatagactgaaaggcgaaagccgcaagacatttgtcgagcttatgcggagaggagacctgcccgtgtggctcgctcacaaagttgcctctgaaggcatcaagtacaccgatcgcaaatggtgcttcgacgggcagcggaacaatcagatcctggaggagaacatggatgtggaaatttggacaaaggagggagagaagaagaagctgagaccgcgctggctcgacgctcggacgtattccgatcctcttgccctgaaagagtttaaggacttcgccgctggcagaaaaagcatcgcgctggatctcatgaccgaaattgggcgcgtcccctctcacctggcccatagaacacggaatgctcttgacaacctggtgatgctccacacctccgagcatggaggcaaggcctaccgccacgccgtcgaggaactgcctgagacaatggaaaccctgctccttctgggcctgatgatcctcctgacagggggagctatgctttttctgattagcggcaaagggatcggaaagacctccatcggcctcatttgtgtgatcgcctctagcgggatgctgtggatggcggagattcccctgcaatggatcgcctccgctattgttctcgagttctttatgatggtgcttctgatccctgaacccgagaagcagagaacaccgcaggataatcaactggcctatgtggtcattggaatcctcaccctggctgccatcattgcggccaacgaaatgggccttctggagacaaccaaacgggacctcggcatgagcaaggaacctggggttgtgtctcccacgtcctacctggatgtggacctgcaccccgctagcgcctggacactctacgctgtcgccaccacagtgatcacccctatgcttcgccataccattgaaaattctacagctaacgttagcctggccgcgatcgccaaccaggctgtggtcctgatgggactcgacaaaggctggccgatttccaagatggatctgggggtgccccttctggccctcggatgctattctcaggtcaatcctctgacgctgaccgctgccgtgctccttctgatcacacactacgccatcattggccccgggctgcaggcgaaagctaccagagaggcccaaaagcggacagctgccggaatcatgaagaaccctaccgttgacggcattatgacgatcgatctcgaccccgtgatttatgatagcaaattcgagaagcagctgggccaggtcatgcttctggtgctctgtgccgttcagctgctgctcatgagaacatcctgggctctttgcgaggccctgaccctggcgaccgggcctatcacaaccctctgggaaggatctccgggcaaattttggaatacaacgatcgccgtgagcatggctaacattttccgcgggtcctacctggccggagctggccttgcctttagcatcatgaagtctgtcgggaccggaaaacggggcacaggctcccaaggggagaccctgggagaaaagtggaagaaaaagctcaatcagctgagcagaaaagagttcgacctgtataagaaatccggcattacagaggtggatcgcaccgaagcgaaggaggggctcaaacggggagaaatcacgcatcacgccgtgtctagaggcagcgctaaacttcagtggtttgttgagcggaacatggtcattcccgaagggcgcgtgatcgacctgggatgtggcagaggcgggtggtcctactattgcgccggactgaagaaagtgaccgaggtccggggctacacaaaagggggacctggccatgaggaacccgttcctatgtctacctacgggtggaatattgtgaaactcatgagcggaaaggatgtgttctatctgcccccggagaaatgtgacacacttctgtgcgatatcggcgaatccagcccttctcccaccgtcgaggagtcccgcacaatcagagtgctcaagatggttgaaccctggctgaagaacaatcagttctgtattaaagtgctgaacccttacatgcccaccgtcgtggagcacctcgaacggcttcaacgcaagcacggcgggatgctggttagaaatcctctgagccggaactctacgcatgagatgtattggatctccaatggaacaggcaacattgtggctagcgtcaatatggtgtctcgcctcctgcttaacagatttaccatgacccaccggagaccgacaatcgaaaaagacgtggatctgggggccggaacgcgccatgtcaacgctgagcccgagacccctaatatggacgttattggcgaacggatcaagagaatcaaagaggaacacaacagcacatggcactacgacgatgagaatccctataagacctgggcctaccatgggtcctatgaagtgaaggcgacaggatctgccagctccatgattaacggcgtggtcaaactcctgaccaagccttgggacgtggttcccatggtgacacagatggctatgaccgatacgaccccgttcggccagcaacgcgtctttaaagagaaggtggacacacggacccctagaagcatgcccgggacacgccgggttatgggaatcaccgccgagtggctgtggagaacgctcggccgcaataaaaagcctcggctgtgcacaagagaagagttcaccaagaaagtgcgcacaaacgctgccatgggggccgtctttaccgaagagaatcagtgggattccgcgaaggctgccgtggaagacgaggatttctggaaacttgttgaccgggagagagaactgcacaagctcggaaaatgtggctcttgcgtgtacaacatgatggggaagcgcgagaaaaagctgggcgaatttggaaaggccaaaggcagcagagctatttggtacatgtggcttggggcccggtatctggagttcgaggctctcggatttctgaatgaagatcattggttctcccgcgagaactcttacagcggcgtcgaaggggagggactgcacaagctcggctatatcctgagagacatttccaaaatccccgggggcgccatgtacgcggatgacacggccggatgggacacccggatcacagaagatgaccttcataatgaggagaagattacccagcagatggatcctgaacacagacaactggctaacgccatctttaaactcacatatcagaataaggtggtcaaggtgcagcggcccaccccgacaggcaccgttatggacattatctctcgcaaagatcagagagggagcggacaagtgggcacgtacgggctgaacacattcaccaatatggaggctcagcttattcggcagatggaaggagagggcgtcctgtccaaggccgacctcgaaaaccctcgcctgcccgagaaaaagatcacccagtggctggagacaaaaggggtggaaagactcaagcggatggcgatcagcggcgatgactgcgtggttaagcccattgatgaccgctttgccaacgctctgcttgccctgaatgatatgggaaaagtgagaaaggacatccctcaatggcagccgtctaaaggctggcacgattggcagcaggtccccttctgttcccatcacttccatgagctcattatgaaggacgggcggaaactggtggttccttgccgcccccaagacgaacttatcggacgggctcggattagccagggcgccgggtggtctctgcgcgagaccgcttgtctcggaaaggcctatgcgcagatgtggtccctgatgtactttcacagacgggatctgcgcctcgccagcaacgctatctgctctgccgtgcctgtccactgggtgcccacatccagaacgacctggagcattcatgcccaccatcaatggatgacaaccgaagacatgctgacagtctggaatcgggtgtggatcgaggataacccttggatggaggacaagacccccatcacgacctgggaaaatgttccgtaccttggcaaaagagaggatcagtggtgtgggtccctgattggcctcacaagccgcgctacctgggcccagaacatccctacagcgattcagcaagtgcggtctctgatcggaaatgaagagttccttgactatatgcccagcatgaagagatttcgcaaagaggaagagtccgaaggcgctatttggtga

SEQ ID NO: 20807 - RNA, 9873 nt, synthetic construct
  misc_feature 1..9873: note = derived and/or modified CDS sequence (opt5) from DENV-3__GQ252678__SS-prME
  source 1..9873: mol_type = other RNA
accagcctgtgcctcatgatgatcctgcccgccgctcttgccttccacctgacatcccgggacggcgagcctcggatgattgtggggaagaacgaacgcggaaagtctctcctgtttaagacggcgagcggcatcaatatgtgtacccttattgctatggatctgggggaaatgtgcgacgatacagtgacctacaagtgtccgcatatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacatcattggagtgctggagcagggcaaacggacgcttacccctcagcccatggagctgaagtactcttggaaaacatgggggaaggccaagatcgtcaccgccgaaacacaaaactccagcttcattatcgatggacctaatacccccgagtgcccgtctgcttccagagcgtggaacgtgtgggaagtggaggactatggctttggcgtcttcacaaccaatatctggctcaaactgcgcgaagtttacacgcagctgtgtgaccaccggcttatgagcgccgctgtgaaggatgagagagccgtgcacgccgacatggggtactggattgagtcccagaaaaacggatcttggaagctcgaaaaagctagcctgatcgaggtcaagacatgcacctggcctaagtcccataccctgtggtctaatggcgtgctcgaaagcgatatgattatccccaaatccctggccgggcctattagccagcacaactatcgccccggataccatacacaaaccgcgggcccttggcaccttgggaagctggagctcgactttaattattgcgagggaacgacagttgtgatcaccgaaaactgtggcacacggggcccctctctgagaaccacaaccgtctccgggaaactgatccacgagtggtgctgtcgcagctgcacgcttccgcctctccggtacatgggagaagatggctgttggtatgggatggagattagacccatctctgaaaaggaggagaatatggtgaaatccctggttagcgctggatctggcgaagtggacaacttcaccatgggggtcctgtgcctcgccattctgtttgaggaagtgatgcggggaaagttcggcaagaaacatatgatcgccggcgttttctttacattcgtgcttctgctcagcgggcagattacctggcgcgatatggctcacacactgatcatgattggatccaatgccagcgacagaatgggcatgggggtcacctacctggcgcttatcgctacgtttaagatccagcccttcctggccctcggatttttcctgcggaaactcacatctagagagaacctgcttctgggcgtggggctcgccatggctaccacactgcaactgcctgaagatattgagcagatggccaatggaatcgctcttggcctgatggccctcaagctgattacccagtttgagacctatcagctctggacagcgctgatctcccttacgtgtagcaacaccattttcacactgaccgtggcctggcgcacagctaccctcatcctggccggcgtctccctgcttccggtttgccaatctagctccatgcggaaaacggactggctgcccatgacagtggctgccatgggggtgcctcccctccctctgtttatcttctctctcaaggataccctgaagagacgcagctggccccttaatgaaggagtcatggccgtgggcctggtttccattctggcttctagcctcctgagaaacgacgtgcctatggcggggccccttgtcgccggaggcctgctcatcgcttgttacgtgattaccgggacatccgccgatctgaccgttgagaaagccgctgacgtgacatgggaagaggaagccgagcagacgggagtcagccataacctcatgatcaccgtggacgatgacggcacaatgcggattaaggatgacgagaccgaaaatatcctgacagtccttctgaaaaccgcgctgctcatcgtgtctggcatttttccgtactccatccctgctacgctgcttgtttggcacacctggcagaagcagacacaacgcagcggggtgctgtgggatgtcccctctcctcccgagacccagaaagccgaactcgaggagggagtgtatagaattaagcagcagggcatcttcgggaaaacacaagttggagtgggcgtccagaaggaaggggtgtttcataccatgtggcacgtgacacggggagccgttctgacgcacaacggcaagcgcctcgagccgaattgggcttccgtcaaaaaggacctgattagctacggcgggggatggagactttctgcccagtggcaaaaaggcgaagaggtccaggtgatcgcggtcgaacctgggaagaaccccaaaaatttccagaccatgcctggaacattccagaccaccacaggcgagattggggctatcgccctggattttaagcccggaacgtccggcagccccatcattaaccgggagggcaaggtggttgggctgtatggaaatggcgtggtcaccaaaaacgggggatacgtgtccggcatcgcccaaacaaatgctgaacctgacgggccgacccccgagctcgaagaggaaatgttcaagaaacgcaacctgacaattatggatcttcatcctggcagcggaaagaccagaaaatatctgcccgccatcgttcgggaggctattaagcgcagactccggacgctgatcctcgcccctacaagagtggtcgcggccgagatggaagaggctctgaagggccttcccatccgctaccagaccaccgccacaaaatctgaacacaccgggcgggagattgtggacctgatgtgccatgctacatttaccatgagactgctcagccctgttcgcgtgccgaattataacctgatcattatggatgaagcccacttcacggaccccgcctccatcgctgcgcggggatacatttctacaagagtcggcatgggggaggccgctgccatctttatgaccgccacacctcccggaaccgctgatgccttccctcagagcaatgcgcccatccaggacgaggaacgcgacattccggagcggtcctggaactctggcaatgaatggatcacggattttgctgggaagaccgtgtggttcgtgcctagcattaaagccggcaacgacatcgccaactgtcttagaaagaatggcaaaaaggtcattcaactgtcccgcaagacatttgataccgagtaccagaaaacaaagctcaacgactgggatttcgttgtgaccacagacatctctgagatgggagctaattttaaagccgatcgggtgattgaccccagacggtgcctgaagcccgtcatcctgaccgatgggcctgaacgcgtgatcctcgcgggacccatgcctgttacggccgctagcgccgctcagagacggggccgcgtggggagaaacccgcagaaagagaatgaccaatatattttcacaggacagccccttaacaatgatgaagaccatgcccactggaccgaggctaagatgctgctggacaacatcaatacccctgaaggcattatccccgccctcttcgagcctgagcgggaaaagtccgcggccattgatggggagtacagactgaaaggcgaaagccgcaagacatttgtcgagcttatgcggagaggagacctgcccgtgtggctcgctcacaaagttgcctctgaaggcatcaagtataccgatcgcaaatggtgcttcgacgggcagcggaacaatcagatcctggaggagaacatggatgtggaaatttggacaaaggagggagagaagaagaagctgagaccgcgctggctcgacgctcggacgtactccgatcctcttgccctgaaagagtttaaggacttcgccgctggcagaaaaagcatcgcgctggatctcgtcaccgaaattgggcgcgtgcccacacatctggcccacagaacccggaatgctcttgacaacctggtcatgctccatacatctgagcacggaggcaaggcctatcgccacgccgtggaggaactgcctgagaccatggaaacgctgctccttctgggcctgatgatcctcctgaccgggggagctatgctttttctgatttccggcaaagggatcggaaagacaagcatcggcctcatttgtgttatcgcctcctctgggatgctgtggatggcggagattcccctgcaatggatcgccagcgctattgtgctcgagttctttatgatggtgcttctgatccctgaacccgagaagcagagaaccccgcaggataatcaactggcctacgtcgttattggaatcctcacactggctgccatcattgcggccaacgaaatgggccttctggagaccacgaaacgggacctcggcatgtccaaggaacctggggtggtgagccccacatcttatctggatgtcgacctgcatcccgcttccgcctggaccctctacgctgtggccacaaccgttatcacccctatgcttcgccacacaattgagaatagcacggctaacgtgtctctggccgcgatcgccaaccaggctgtcgtgctgatgggactcgacaaaggctggccgattagcaagatggatctgggggtcccccttctggccctcggatgctactcccaggtgaatcctctgaccctgacagctgccgttctccttctgatcacccattatgccatcattggccccgggctgcaggcgaaagctacaagagaggcccaaaagcggaccgctgccggaatcatgaagaaccctacggtggacggcattatgacaatcgatctcgaccccgtcatttacgattctaaattcgaaaagcagctgggccaggtgatgcttctggttctctgtgccgtgcagctgctgctcatgagaaccagctgggctctttgcgaggccctgaccctggcgacagggcctatcaccacactctgggaaggatccccgggcaaattttggaatacgaccatcgccgtctctatggctaacattttccgcgggagctatctggccggagctggccttgccttttccatcatgaaaagcgtggggacaggaaaacggggcaccggctctcaaggggagacactgggagaaaagtggaagaaaaagctcaatcagctgtccagaaaagagttcgacctgtacaagaaaagcggcattaccgaggtggatcgcacggaagcgaaggaggggctcaaacggggagaaatcacccaccatgccgtttccagaggctctgctaaacttcagtggtttgtcgagcggaacatggtgattcccgaagggcgcgtgatcgacctgggatgtggcagaggcgggtggagctattactgcgccggactgaagaaagtcacagaggttcggggctataccaaagggggacctggccacgaggaacccgtgcctatgtccacatacgggtggaatattgtgaaactcatgtctggaaaggatgtcttctacctgcccccggagaaatgtgacacccttctgtgcgatatcggcgaaagctcccctagccccacagtggaggagtctcgcaccatcagagttctcaagatggtggaaccctggctgaagaacaatcagttctgtattaaagtcctgaacccttatatgcccacggtgatcgagcacctcgaacggcttcaacgcaagcatggcgggatgctggttagaaatcctctgtcccggaacagcacacacgagatgtactggatttctaatggaaccggcaacatcgtggcttccgtcaatatggtgagccgcctcctgcttaacagatttaccatgacacatcggagaccgacgattgaaaaagacgtggatctgggggccggaacccgccacgtcaacgctgagcccgagacacctaatatggacgttatcggcgaacggatcaagagaattaaagaggaacacaactctacctggcattatgacgatgagaatccctacaagacatgggcctatcacgggagctacgaagtgaaggcgaccggatccgcctctagcatgatcaacggcgtggtcaaactcctgacaaagccttgggacgtggttcccatggtgacccagatggctatgacggataccacaccgttcggccagcaacgcgtctttaaagagaaggtggacacccggacacctagatccatgcccgggacccgccgggttatgggaattacggccgagtggctgtggagaacactcggccgcaataaaaagcctcggctgtgcaccagagaagagttcacaaagaaagtgcgcaccaacgctgccatgggggccgtctttacggaagagaatcagtgggatagcgcgaaggctgccgtggaagacgaggatttctggaaacttgttgaccgggagagagaactgcataagctcggaaaatgtggctcctgcgtgtataacatgatggggaagcgcgagaaaaagctgggcgaatttggaaaggccaaaggctctagagctatctggtacatgtggcttggggcccggtacctggagttcgaggctctcggatttctgaatgaagatcactggttcagccgcgagaactcctattctggcgtcgaaggggagggactgcataagctcggctacattctgagagacatcagcaaaatccccgggggcgccatgtatgcggatgacaccgccggatgggacacacggattaccgaagatgaccttcacaatgaggagaagatcacacagcagatggatcctgaacacagacaactggctaacgccatttttaaactcacctaccagaataaggtggtcaaggtgcagcggcccacaccgaccggcacggttatggacatcatttcccgcaaagatcagagagggtctggacaagtgggcacatatgggctgaacaccttcaccaatatggaggctcagcttatccggcagatggaaggagagggcgtcctgagcaaggccgacctcgaaaaccctcatctgcccgagaaaaagatcacacagtggctggagaccaaaggggtggaacgcctcaagagaatggcgatttccggcgatgactgcgtggttaagcccatcgatgaccggtttgccaacgctctgcttgccctgaatgatatgggaaaagtgcgcaaggacattcctcaatggcagccgagcaaaggctggcacgattggcagcaggtccccttctgttctcatcacttccacgagctcatcatgaaggacgggagaaaactggtggttccttgccggccccaagacgaacttattggacgcgctagaatctcccagggcgccgggtggagcctgcgggagacagcttgtctcggaaaggcctacgcgcagatgtggtctctgatgtattttcatcgcagagatctgcggctcgcctccaacgctatttgcagcgccgtgcctgtccactgggtgcccacgtctcgcaccacatggtccatccatgcccaccatcaatggatgaccacagaagacatgctgaccgtctggaatagagtgtggatcgaggataacccttggatggaggacaagacgcccgttaccacatgggaaaatgtgccgtaccttggcaaacgggaggatcagtggtgtgggagcctgattggcctcacctccagagctacatgggcccagaacatcagcaccgcgattcagcaagtccgctctctgatcggaaatgaagagttccttgactacatgcctagcatgaagcggtttagaaaagaggaagagtccgaaggcgctatttggtga

SEQ ID NO: 20808 - RNA, 9873 nt, synthetic construct
  misc_feature 1..9873: note = derived and/or modified CDS sequence (opt5) from DENV-3__FJ850098__SS-prME
  source 1..9873: mol_type = other RNA
accagcctgtgcctcatgatgatcctgcccgccgctcttgccttccacctgacgtccagagacggcgaacctcggatgattgtggggaagaacgaacgcggaaaatctctcctgtttaagacggcgagcggcatcaatatgtgtacccttattgctatggatctgggggaaatgtgcgacgatacagtcacctacaaatgtccgcatatcacagaagttgaacccgaagacattgattgctggtgtaacctcacctccacatgggtgacctatggaacgtgcaatcaggccggcgaacacagacgggacaagcgctctgtggccctggctcctcatgtcgggatgggactggataccagaacacagacctggatgagcgccgaaggcgcttggcggcaggtcgaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggatcccgtgaacattgaagctgagcctccgttcggcgaatccaatatcgtgattgggatcggcgacaacgccctgaaaatcaattggtataagaagggatctagcattggcaaaatgtttgaggccacggctagaggggctagacgcatggctatccttggagatacagcctgggacttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgatatggggtgtgtcatcaattggaaaggaaaggaactgaagtgcggcagcgggattttcgtgacaaacgaggttcatacgtggaccgagcagtacaaatttcaagccgactcccccaagcggctggcgacagccatcgctggcgcctgggaaaatggagtgtgtggcattagaagcaccacacgcatggagaaccttctctggaaacagatcgctaatgaactgaactatatcctgtgggagaataacattaagctcaccgtcgtggttggggatgtgatcggagtcctggaacagggcaaacggacgcttaccctgcagcctatggagctcaagtactcttggaaaacatgggggaaggccaagattgtgaccgccgagacacaaaactccagcttcatcattgacggacccaatacccctgaatgcccctctgcttccagagcgtggaacgtgtgggaggtcgaagactatggctttggcgttttcacaaccaatatctggctgaaactgcgcgaggtgtacacgcagctttgtgatcaccggctcatgagcgccgctgtgaaggacgaaagagccgtccacgccgatatggggtactggatcgagtcccagaaaaacggatcttggaagctggagaaagctagcctgattgaagtgaagacatgcacctggccgaagtcccataccctctggtctaatggcgttctggagagcgacatgatcattcctaaatcccttgccgggcccatcagccagcacaactatcgccctggataccatacacaaaccgcgggcccctggcacctggggaagctcgaactggattttaattattgcgagggaacgacagtggtcattaccgagaactgtggcacacggggcccttctctgagaaccacaaccgtgtccgggaaacttatccacgaatggtgctgtcgcagctgcacgctgcccccgctgcggtacatgggagaggacggctgttggtatgggatggaaatcagacctatttctgagaaggaagagaatatggttaaatccctggtgagcgctggatctggcgaggtcgataacttcaccatgggggtgctctgcctggccatcctttttgaagaggttatgcggggaaagttcggcaagaaacatatgattgccggcgtgttctttacattcgtcctgctcctgagcgggcagatcacctggcgcgacatggctcacacactgattatgatcggatccaatgccagcgatagaatgggcatgggggtgacctaccttgcgctgattgctacgtttaagatccagcccttcctcgccctgggatttttcctccggaaactgacatctagagaaaaccttctgctcggcgtggggctggccatggctaccacactgcaacttcccgaggacatcgaacagatggccaatggaattgctctgggcctcatggccctgaagctcatcacccagtttgagacctatcagctgtggacagcgcttatttccctgacgtgtagcaacaccatcttcacactcaccgtcgcctggcgcacagctaccctgattctggccggcgtttcccttctgcctgtgtgccaatctagctccatgcggaaaacggattggctcccgatgacagtggctgccatgggggtgccccctctgcccctctttatcttctctctgaaggacacccttaagagacgcagctggcctctgaatgagggagtgatggccgttggcctggtgtccatcctcgcttctagcctgcttagaaacgatgtccccatggcggggcctctggtggccggaggcctcctgattgcttgttacgttatcaccgggacatccgccgacctcaccgtggaaaaagccgctgacgtcacatgggaggaagaggccgaacagacgggagtgagccataacctgatgattaccgtcgatgacgatggcacaatgcggatcaaggacgatgagaccgagaatattcttacagtgctgctgaaaaccgcgctcctgatcgtttctggcatctttccctactccattccggctacgcttctggtgtggcacacctggcagaagcagacacaacgcagcggggtcctctgggacgtgccttctccccctgaaacccagaaagccgagctggaagagggagtttatagaatcaagcagcagggcattttcgggaaaacacaagtgggagtcggcgtgcagaaggagggggtgtttcataccatgtggcacgttacacggggagccgtcctcacgtacaacggcaagcgcctggaacccaattgggcttccgtgaaaaaggatcttatcagctatggcgggggatggagactgtctgcccagtggcaaaaaggcgaggaagtgcaggtcattgcggtggagccggggaagaaccctaaaaatttccagaccatgcccggaacattccagaccaccacaggcgaaatcggggctattgccctggactttaagcctggaacgtccggcagccccatcatcaaccgggagggcaaggttgtggggctctacggaaatggcgtcgtgaccaaaaacgggggatatgtttccggcattgcccaaacaaatgctgagcccgatgggcctaccccggaactggaggaagagatgttcaagaaacgcaaccttacaatcatggacctgcaccccggcagcggaaagaccagaaaatacctccctgccattgtgcgggaagctatcaagcgcagactgcggacgctcattctggcccccacaagagtcgtggcggccgagatggaggaagctcttaagggcctgcctatccgctatcagaccaccgccacaaaatctgagcataccgggcgggaaatcgttgatctgatgtgccacgctacatttaccatgagactcctgagccccgtgcgcgtccctaattacaaccttattatcatggacgaggcccatttcacggatccggcctccattgctgcgcggggatacatctctacaagagtgggcatgggggaagccgctgccatttttatgaccgccacaccccctggaaccgctgacgccttcccccagagcaatgcgcctatccaggacgaggagcgcgatatccccgaacggtcctggaactctggcaatgagtggattacggactttgctgggaagaccgtgtggttcgtcccgagcatcaaagccggcaacgatattgccaactgtctgagaaagaatggcaaaaaggttatccaactctcccgcaagacatttgacaccgaatatcagaaaacaaagctgaacgattgggacttcgtggtgaccacagatatttctgagatgggagctaattttaaagccgaccgggtcatcgatcctagacggtgcctgaagcccgtgattctcaccgacgggcccgagcgcgttatccttgcgggacctatgcccgtgacggccgctagcgccgctcagagacggggccgcgtcgggagaaaccctcagaaagaaaatgatcaatacatcttcacaggacagccgctgaacaatgacgaggaccacgcccattggaccgaagctaagatgctgctcgataacattaatacccccgagggcatcattcctgccctgttcgaacccgagcgggagaagtccgcggccatcgacggggaatatagacttaaaggcgagagccgcaagacatttgtggaactgatgcggagaggagatctccctgtttggctggctcacaaagtggcctctgagggcattaagtacaccgaccgcaaatggtgcttcgatgggcagcggaacaatcagatcctggaagagaacatggacgtcgagatctggacaaaggaaggagagaaaaagaagctcagaccccgctggcttgatgctcggacgtattccgacccgctggccctgaaagaatttaaggatttcgccgctggcagaaaaagcattgcgctcgacctggtgaccgagatcgggcgcgtcccttctcaccttgcccatagaacacggaatgctctggataacctcgtgatgctgcacacctccgaacatggaggcaaggcctaccgccacgccgttgaggagctgcccgaaacaatggagaccctccttctgctgggcctcatgattctgcttacagggggagctatgctgtttctcatcagcggcaaagggattggaaagacctccatcggcctgatctgtgtgattgcctctagcgggatgctgtggatggcggaaatccctctccaatggattgcctccgctatcgtgcttgagttctttatgatggtcctgctgattcccgagcctgaaaagcagagaacaccccaggacaatcaactcgcctatgttgtgatcggcattctcacccttgctgccatcatcgcggccaacgagatgggactgctcgaaacaaccaaacgggatctgggcatgagcaaggagccgggggtggtctctcctacgtcctacctggacgtggacctccaccccgctagcgcctggacactttacgctgttgccaccacagtgattacccccatgctgcgccataccatcgaaaattctacagctaacgtcagcctggccgcgattgccaaccaggctgtggtcctcatgggactggataaaggctggcctatctccaagatggaccttggggtgccgctgctcgccctgggatgctattctcaggttaatcccctgacgctcaccgctgccgtgcttctgctgattacacactacgccatcatcggccctgggctccaggcgaaagctaccagagaggcccaaaagcggacagctgccggaattatgaagaaccccaccgtcgatggcatcatgacgattgacctggatcctgtgatctatgacagcaaattcgagaagcagcttggccaggttatgctgctcgtgctgtgtgccgtccagctgctccttatgagaacatcctgggctctgtgcgaagccctgaccctcgcgaccgggcccattacaaccctgtgggagggatctcctggcaaattttggaatacaacgatcgccgtgagcatggctaacatcttccgcgggtcctaccttgccggagctggcctggcctttagcattatgaagtctgtggggaccggaaaacggggcacaggctcccaaggggaaaccctcggagagaagtggaagaaaaagctgaatcagctgagcagaaaagagttcgatctctataagaaatccggcatcacagaggttgaccgcaccgaggcgaaggaagggcttaaacggggagagattacgcatcacgccgtctctagaggcagcgctaagctgcagtggtttgtggaacggaacatggtgatcccggaggggcgcgtcattgatctgggatgtggcagaggcgggtggtcctactattgcgccggactcaagaaagttaccgaagtgcggggctacacaaaagggggacccggccatgaggagcctgtgcccatgtctacctacgggtggaatatcgtcaaactgatgagcggaaaggacgtgttctatcttcctcccgaaaaatgtgatacactgctctgcgacattggcgagtccagcccgtctcctaccgttgaagagtcccgcacaatcagagtgctgaagatggtcgagccctggctgaagaacaatcagttctgtatcaaagtgctcaacccctacatgcctaccgttgtggaacaccttgagcggctgcaacgcaagcacggcgggatgctggtcagaaatcccctcagccggaactctacgcatgaaatgtattggatttccaatggaacaggcaacatcgtggctagcgtgaatatggtctctcgcctgcttctgaacagatttaccatgacccaccggagacctacaattgagaaagatgttgacctcggggccggaacgcgccatgtgaacgctgaaccggagacccccaatatggacgtgatcggcgagcggattaagagaatcaaagaagaacacaacagcacatggcactacgatgacgaaaatccttataagacctgggcctaccatgggtcctatgaggtcaaggcgacaggatctgccagctccatgatcaacggcgtggttaaactgctgaccaagccctgggatgtggtccctatggtgacacagatggctatgaccgacacgacccccttcggccagcaacgcgtttttaaagaaaaggtggatacacggaccccgagaagcatgcctgggacacgccgggtcatgggaattaccgccgagtggctctggagaacgctgggccgcaataaaaagccccggctttgcacaagagaggagttcaccaagaaagtgcgcacaaacgctgccatgggggccgtttttaccgaggaaaatcagtgggactccgcgaaggctgccgtggaggatgaagacttctggaaactggtcgatcgggagagagagctccacaagctgggaaaatgtggctcttgcgtgtacaacatgatggggaagcgcgagaagaaacttggcgagtttggaaaggccaaaggcagcagagctatctggtacatgtggctgggggcccggtatctcgagttcgaggctctgggatttctgaatgaggaccattggttctcccgcgaaaactcttacagcggcgtcgagggggaaggactccacaagctgggctatattcttagagatatctccaaaattcctgggggcgccatgtacgcggacgacacggccggatgggatacccggatcacagaggacgatctgcataatgaagagaagatcacccagcagatggaccccgagcacagacaactcgctaacgccatttttaaactgacatatcagaataaggtggttaaggtgcagcggcctacccccacaggcaccgtcatggatatcatttctcgcaaagaccagagagggagcggacaagtgggcacgtacgggcttaacacattcaccaatatggaagctcagctgatccggcagatggagggagaaggcgtgctctccaaggccgatctggagaacccgcgcctgcctgagaagaagattacccagtggctcgagacaaaaggggttgagagactgaagcggatggcgatcagcggcgacgattgcgtggtcaagcccatcgacgatcgctttgccaacgcccttctggccctcaatgacatgggaaaagtgagaaaggatattccccaatggcagccttctaaaggctggcacgactggcagcaggttccgttctgttcccatcacttccatgaactgatcatgaaggacgggcggaaacttgtggtcccctgccgccctcaagatgagctgattggacgggctcggatcagccagggcgccgggtggtctctccgcgaaaccgcttgtctgggaaaggcctatgcgcagatgtggtccctgatgtactttcacagacgggacctccgcctggccagcaacgctatttgctctgccgtgcccgtccactgggtgcctacatccagaacgacctggagcatccatgcccaccatcaatggatgacaaccgaggatatgcttacagtttggaatcgggtgtggattgaagacaacccctggatggaggataagacccctgtcacgacctgggagaatgtgccctacctgggcaaaagagaagaccagtggtgtgggtccctcatcggcctgacaagccgcgctacctgggcccagaacatcccgacagcgattcagcaagttcggtctcttatcggaaatgaggagttcctggattatatgcctagcatgaagagatttcgcaaagaggaggaatccgagggcgctatttggtga

SEQ ID NO: 20809 - RNA, 9873 nt, synthetic construct
  misc_feature 1..9873: note = derived and/or modified CDS sequence (opt5) from DENV-3__KF955479__SS-prME
  source 1..9873: mol_type = other RNA
accagcctctgcctcatgatgatcctgcccgccgctcttgccttccacctgacgtcccgggacggcgaacctcggatgattgtggggaagaacgaacgcggaaagtctctcctgtttaagacggcgagcggcatcaatatgtgtacccttattgctatggatctgggggagatgtgcgacgatacagtgacctacaaatgtccgcatatcacagaagttgagcccgaagacattgattgctggtgtaacctcacctccacatgggtgacctatggaacgtgcaatcaggccggcgagcaccggcgggacaagcgctctgtggccctggctcctcatgttgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacatcattggagtgctggagcagggcaaacggacgcttacccctcagcccatggagctgaagtactcttggaaaacatgggggaaggccaagatcgtcaccgccgaaacacaaaactccagcttcattatcgatggacctaatacccccgagtgcccgtctgcttccagagcgtggaacgtgtgggaagtggaggactatggctttggcgtcttcacaaccaatatctggctcaaactgcgcgaagtttacacgcagctgtgtgaccaccggcttatgagcgccgctgtgaaggatgagagagccgtgcacgccgacatggggtactggattgagtcccagaaaaacggatcttggaagctcgaaaaagctagctttatcgaggtcaagacatgcacctggcctaagtcccataccctgtggtctaatggcgtgctggaaagcgatatgattatccccaaatccctcgccgggcctattagccagcacaactatcgccccggataccatacacaaaccgcgggcccttggcacctggggaaacttgagctggacttcaattattgcgagggaacgacagttgtgatcaccgaaaactgtggcacacggggcccctctctcagaaccacaaccgtctccgggaaactgatccacgagtggtgctgtcgcagctgcacgctgccgcctcttcggtacatgggagaagatggctgttggtatgggatggagattagacccatctctgaaaaggaggagaatatggtgaaatccctcgttagcgctggatctggcgaagtggacaactttaccatgggggtcctgtgcctggccattctcttcgaggaagtgatgcggggaaagttcggcaagaaacatatgatcgccggcgtctttttcacatttgtgctgcttctgagcgggcagattacctggcgcgatatggctcacacactcatcatgattggatccaatgccagcgacagaatgggcatgggggtcacctacctggcgctgatcgctacgttcaagatccagccctttcttgccctgggattctttctccggaaactgacatctagagagaacctcctgcttggcgtggggctggccatggctaccacactccaactgcctgaagatattgagcagatggccaatggaatcgctctgggccttatggccctgaagctcattacccagttcgagacctatcagctgtggacagcgctcatctccctgacgtgtagcaacaccatttttacacttaccgtggcctggcgcacagctaccctgatcctcgccggcgtctccctgctgccggtttgccaatctagctccatgcggaaaacggactggcttcccatgacagtggctgccatgggggtgcctcccctgcctctcttcatcttttctctgaaggataccctcaagagacgcagctggcccctgaatgaaggagtcatggccgtgggccttgtttccattctggcttctagcctgctcagaaacgacgtgcctatggcggggcccctggtcgccggaggccttctgatcgcttgttacgtgattaccgggacatccgccgatctcaccgttgagaaagccgctgacgtgacatgggaagaggaagccgagcagacgggagtcagccataacctgatgatcaccgtggacgatgacggcacaatgcggattaaggatgacgagaccgaaaatatcctcacagtcctgcttaaaaccgcgctgctgatcgtgtctggcattttcccgtactccatccctgctacgctcctggtttggcacacctggcagaagcagacacaacgcagcggggtgctttgggatgtcccctctcctcccgagacccagaaagccgaactggaggagggagtgtatagaattaagcagcagggcatctttgggaaaacacaagttggagtgggcgtccagaaggaaggggtgttccataccatgtggcacgtgacacggggagccgttctcacgtacaacggcaagcgcctggagccgaattgggcttccgtcaaaaaggacctcattagctatggcgggggatggagactgtctgcccagtggcaaaaaggcgaagaggtccaggtgatcgcggtcgaacctgggaagaaccccaaaaatttccagaccatgcctggaacatttcagaccaccacaggcgagattggggctatcgcccttgatttcaagcccggaacgtccggcagccccatcattaaccgggagggcaaggtggttgggctgtacggaaatggcgtggtcaccaaaaacgggggatatgtgtccggcatcgcccaaacaaatgctgaacctgacgggccgacccccgagctggaagaggaaatgtttaagaaacgcaacctcacaattatggatctgcaccctggcagcggaaagaccagaaaataccttcccgccatcgttcgggaggctattaagcgcagactgcggacgctcatcctggcccctacaagagtggtcgcggccgagatggaagaggctctcaagggcctgcccatccgctatcagaccaccgccacaaaatctgaacataccgggcgggagattgtggaccttatgtgccacgctacattcaccatgagactgctgagccctgttcgcgtgccgaattacaacctcatcattatggatgaagcccattttacggaccccgcctccatcgctgcgcggggatacatttctacaagagtcggcatgggggaggccgctgccatcttcatgaccgccacacctcccggaaccgctgatgcctttcctcagagcaatgcgcccatccaggacgaggaacgcgacattccggagcggtcctggaactctggcaatgaatggatcacggatttcgctgggaagaccgtgtggtttgtgcctagcattaaagccggcaacgacatcgccaactgtctgagaaagaatggcaaaaaggtcattcaactttcccgcaagacattcgataccgagtatcagaaaacaaagctgaacgactgggattttgttgtgaccacagacatctctgagatgggagctaatttcaaagccgatcgggtgattgaccccagacggtgcctcaagcccgtcatcctgaccgatgggcctgaacgcgtgatcctggcgggacccatgcctgttacggccgctagcgccgctcagagacggggccgcgtggggagaaacccgcagaaagagaatgaccaatacattttcacaggacagcccctcaacaatgatgaagaccacgcccattggaccgaggctaagatgcttctggacaacatcaatacccctgaaggcattatccccgccctgtttgagcctgagcgggaaaagtccgcggccattgatggggagtatagactcaaaggcgaaagccgcaagacattcgtcgagctgatgcggagaggagaccttcccgtgtggctggctcacaaagttgcctctgaaggcatcaagtacaccgatcgcaaatggtgctttgacgggcagcggaacaatcagatcctcgaggagaacatggatgtggaaatttggacaaaggagggagagaagaagaagctgagaccgcgctggctggacgctcggacgtattccgatcctctcgcccttaaagagttcaaggactttgccgctggcagaaaaagcatcgcgctggatctggtcaccgaaattgggcgcgtgccctctcacctcgcccatagaacacggaatgctctggacaaccttgtcatgctgcacacctccgagcatggaggcaaggcctaccgccacgccgtggaggaactccctgagacaatggaaaccctgctgctccttggcctgatgatcctgctcacagggggagctatgctgttccttattagcggcaaagggatcggaaagacctccatcggcctgatttgtgttatcgcctctagcgggatgctctggatggcggagattcccctgcaatggatcgcctccgctattgtgctggagtttttcatgatggtgctccttatccctgaacccgagaagcagagaacaccgcaggataatcaactggcctatgtcgttattggaatcctgaccctcgctgccatcattgcggccaacgaaatgggcctgcttgagacaaccaaacgggacctgggcatgagcaaggaacctggggtggtgtctcccacgtcctacctcgatgtcgacctgcaccccgctagcgcctggacactgtacgctgtggccaccacagttatcacccctatgctccgccataccattgaaaattctacagctaacgtgagccttgccgcgatcgccaaccaggctgtcgtgctgatgggactggacaaaggctggccgatttccaagatggatctcggggtccccctgcttgccctgggatgctattctcaggtgaatcctctcacgctgaccgctgccgttctgctccttatcacacactacgccatcattggccccgggctgcaggcgaaagctaccagagaggcccaaaagcggacagctgccggaatcatgaagaaccctaccgtggacggcattatgacgatcgatctggaccccgtcatttatgatagcaaatttgaaaagcagctcggccaggtgatgctgcttgttctgtgtgccgtgcagctcctgctgatgagaacatcctgggctctctgcgaggcccttaccctggcgaccgggcctatcacaaccctgtgggaaggatctccgggcaaattctggaatacaacgatcgccgtcagcatggctaacatttttcgcgggtcctacctcgccggagctggcctggccttcagcatcatgaagtctgtggggaccggaaaacggggcacaggctcccaaggggagacccttggagaaaagtggaagaaaaagctgaatcagctcagcagaaaagagtttgacctgtataagaaatccggcattacagaggtggatcgcaccgaagcgaaggaggggctgaaacggggagaaatcacgcatcacgccgtttctagaggcagcgctaagctccagtggttcgtcgagcggaacatggtgattcccgaagggcgcgtgatcgaccttggatgtggcagaggcgggtggtcctactattgcgccggactgaagaaagtcaccgaggttcggggctacacaaaagggggacctggccatgaggaacccgtgcctatgtctacctacgggtggaatattgtgaaactgatgagcggaaaggatgtcttctatctgcccccggagaaatgtgacacactgctttgcgatatcggcgaatccagcccttctcccaccgtggaggagtcccgcacaatcagagttctgaagatggtggaaccctggctcaagaacaatcagttttgtattaaagtcctgaacccttacatgcccaccgtgatcgagcacctggaacggctccaacgcaagcacggcgggatgcttgttagaaatcctctgagccggaactctacgcatgagatgtattggatttccaatggaacaggcaacatcgtggctagcgtcaatatggtgtctcgcctgctcctgaacagattcaccatgacccaccggagaccgacaattgaaaaagacgtggatcttggggccggaacgcgccatgtcaacgctgagcccgagacccctaatatggacgttatcggcgaacggatcaagagaattaaagaggaacacaacagcacatggcactacgacgatgagaatccctataagacctgggcctaccatgggtcctatgaagtgaaggcgacaggatctgccagctccatgatcaacggcgtggtcaaactgctcaccaagccttgggacgtggttcccattgtgacacagatggctatgaccgatacgaccccgtttggccagcaacgcgtcttcaaagagaaggtggacacacggacccctagaagcatgcccgggacacgccgggttatgggaatcaccgccgagtggctgtggagaacgctgggccgcaataaaaagcctcggctctgcacaagagaagagtttaccaagaaagtgcgcacaaacgctgccatgggggccgtcttcaccgaagagaatcagtgggattccgcgaaggctgccgtggaagacgaggatttttggaaactggttgaccgggagagagaacttcacaagctgggaaaatgtggctcttgcgtgtacaacatgatggggaagcgcgagaaaaagctcggcgagttcggaaaggccaaaggcagcagagctatttggtacatgtggctgggggcccggtatcttgagtttgaggctctgggattcctcaatgaagatcattggttttcccgcgagaactcttacagcggcgtcgaaggggagggactgcacaagctgggctatatcctcagagacatctccaaaattcccgggggcgccatgtacgcggatgacacggccggatgggacacccggatcacagaagatgacctgcataatgaggagaagattacccagcagatggatcctgaacacagacaacttgctaacgccatcttcaaactgacatatcagaataaggtggtcaaggtgcagcggcccaccccgacaggcaccgttatggacattatctctcgcaaagatcagagagggagcggacaagtgggcacgtacgggctcaacacatttaccaatatggaggctcagctgatccggcagatggaaggagagggcgtcctttccaaggccgacctggaaaaccctcacctccccgagaaaaagattacccagtggctggagacaaaaggggtggaacgcctgaagagaatggcgatcagcggcgatgactgcgtggttaagcccattgatgaccggttcgccaacgctctcctggcccttaatgatatgggaaaagtgcgcaaggacatccctcaatggcagccgtctaaaggctggcatgattggcagcaggtccccttctgttcccaccattttcacgagctgattatgaaggacgggagaaaactcgtggttccttgccggccccaagacgaactgatcggacgcgctagaattagccagggcgccgggtggtctcttcgggagaccgcttgtctgggaaaggcctatgcgcagatgtggtccctcatgtacttccaccgcagagatctgcggctggccagcaacgctatctgctctgccgtgcctgtccattgggtgcccacatcccgcacgacctggagcatccacgcccatcaccaatggatgacaaccgaagacatgctcacagtctggaatagagtgtggattgaggataacccttggatggaggacaagacccccgttacgacctgggaaaatgtgccgtacctgggcaaacgggaggatcagtggtgtgggtcccttatcggcctgacaagcagagctacctgggcccagaacattcctacagcgatccagcaagtccgctctctcattggaaatgaagagtttctggactatatgcccagcatgaagcggttcagaaaagaggaagagtccgaaggcgctatctggtga

SEQ ID NO: 20810 - RNA, 9873 nt, synthetic construct
  misc_feature 1..9873: note = derived and/or modified CDS sequence (opt5) from DENV-3__FJ850109__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccatcctggcgctttttctggcccattacacggggacatccctcacccagaaggtggtcatcttcattctgcttatgctggtgacaccttctatgaccatgagatgtgttggagtgggcaaccgggactttgtcgaagggctcagcggagctacctgggtggatgtggtcctggagcacggcgggtgcgttacaacgatggccaagaataaacccaccctggacatcgagctccagaagacagaagctacccaactggccacacttcgcaaactgtgtattgagggaaagatcaccaacattacgacagattccagatgccctacccagggcgaagcggtgctcccggaggaacaggaccagaattatgtgtgtaaacacacctacgtcgatcggggctgggggaacggatgcggcctgttcgggaagggaagccttgtgacatgcgccaagtttcaatgtctggagcccatcgagggcaaagttgtgcagtatgaaaatctcaagtacaccgtcattatcacagtgcatacgggggaccagcaccaggttggaaacgagacccaaggcgtgacagctgaaatcacccctcaggcctctacaaccgaggctattctgcccgaatatggcacgctggggctcgagtgctcccctcgcaccggactggacttcaatgagatgatccttctgacaatgaaaaacaaggcctggatggtccatagacagtggtttttcgatctccccctgccgtggaccagcggcgccacaaccgaaacgcctacatggaatcggaaagagcttctggtgacctttaagaacgctcacgcgaaaaagcaagaagtcgtggttctcgggtctcaggagggagccatgcacacagctctgaccggcgccaccgaaattcagaattccgggggcacaagcatcttcgccggacatctgaagtgtcgcctcaaaatggacaagctggagcttaaaggcatgtcttacgctatgtgcacgaacacctttgtgctgaagaaagaggtctccgaaacacagcacgggaccattctcatcaaggtggagtacaagggagaagatgttccctgtaaaatccctttcagcacagaggacggccaagggaaggcccataacggaagactgattaccgcgaatcccgtggtcacgaaaaaggaggaacccgtgaacatcgaggctgaacctccgttcggcgagtccaatattgtgatcgggattggcgataactctctgaaaatcaattggtataagaagggaagctccatcggcaaaatgtttgaagccacagcccggggggctagacgcatggccattcttggagacaccgcttgggatttcggcagcgttgggggagtcctcaactctctgggcaagatggtgcaccagatctttgggtccgcctacaccgcgctgttcagcggcgtgtcttgggtcatgaaaattggaatcggcgtgctcctgacatggattgggcttaatagcaagaacacctccatgtcttttagctgcatcgccattggaatcatcacactgtatctcggcgctgttgtgcaggccgacacggggtgtgtcattaattggaaaggaaaggagctgaagtgcggctccgggatcttcgtgaccaacgaggttcatacatggaccgaacagtacaaatttcaagctgatagccccaagcggctggccacagcgattgccggcgcttgggagaatggagtgtgtggcatcagatctaccacgcgcatggaaaaccttctctggaaacagattgccaatgagctgaactatatcctgtgggaaaataacatcaagctcaccgtcgtggttggggacattatcggagtgctggagcagggcaaacggacacttacccctcagcccatggagctgaagtactcctggaaaacatgggggaaggctagaattgtcaccgccgaaacacaaaacagctctttcatcattgatggacctaatacccccgagtgcccgaacacgtcccgcgcctggaatgtgtgggaagtggaggactatggctttggcgtcttcacaaccaacatctggctcaagctgcgggaagtttacacccagctgtgtgaccacagacttatgagcgctgcggtgaaagatgagcgcgccgtgcacgctgacatggggtactggatcgagtcccagaagaatggatcttggaaactcgaaaaggccagcctgattgaggtcaaaacatgcacctggcctaagtcccatacgctgtggtctaacggcgtgctcgaaagcgatatgatcattcccaagtccctggccgggcctatcagccagcacaattatcggcccggataccatacacaaaccgctggcccttggcaccttgggaaactggagctcgactttaactattgcgagggaacaaccgttgtgattacagaaaattgtggcaccagaggcccctctctgcgcacgaccacagtctccgggaagctgatccacgagtggtgctgtcggagctgcacccttccgcctctcagatacatgggagaagatggctgttggtatgggatggagatccggcccatttctgaaaaagaggagaacatggtgaagtccctggttagcgccggatctggcgaagtggacaatttcacaatgggggtcctgtgcctcgcgatcctgtttgaggaagtgatgcgcggaaaattcggcaagaagcatatgattgctggcgttttctttaccttcgtgcttctgctcagcgggcagatcacgtggagagatatggcccacacactgattatgatcggatccaacgccaccgaccggatgggcatgggggtcacatacctggctcttattgccacctttaaaatccagcccttcctggcgctcggatttttcctgagaaagctcaccagccgcgagaatctgcttctgggcgtggggctcgctatggccacaacgctgcaactgcctgaagatatcgagcagatggccaacggaattgctcttggcctgatggccctcaaactgatcacccagtttgagacatatcagctctggaccgctctgatttctcttacatgttccaataccatcttcacgctgacagtggcctggcggaccgcgaccctcattctggccggcgtcagcctgcttccggtttgccaatcctctagcatgagaaagacagactggctgcccatgaccgtggctgccatgggggtgcctcccctccctctgtttatcttctccctcaaagatacactgaagcgcagatcttggccccttaacgaaggagtcatggctgtgggcctggttagcatcctggcctcctctctcctgcggaacgacgtgcctatggccgggccccttgtcgctggaggcctgctcattgcgtgttacgtgatcacggggaccagcgccgatctgacagttgagaaggctgccgacgtgacctgggaagaggaagccgagcagacaggagtctcccataatctcatgattaccgtggacgatgacggcacgatgcgcatcaaagatgacgagaccgaaaacattctgacagtccttctgaagaccgctctgctcatcgtgagcggcatctttccgtactctattcctgccacactgcttgtttggcacacctggcagaaacagacacaaagatccggggtgctgtgggatgtccccagccctcccgagacgcagaaggcggaactcgaggagggagtgtatcggatcaaacagcagggcattttcgggaagacccaagttggagtgggcgtccagaaagaaggggtgtttcatacaatgtggcacgtgacccgcggagctgttctgacctacaatggcaagagactcgagccgaactgggcctctgtcaagaaagacctgatctcctatggcgggggatggcggcttagcgcccagtggcaaaagggcgaagaggtgcaggtgattgctgtcgaacctgggaaaaatcccaagaacttccagacaatgcctggaacgttccagaccacaaccggcgagatcggggccattgcgctggattttaaacccggaacatctggctcccccatcatcaatcgcgagggcaaggtggttgggctgtacggaaacggcgtggtcaccaagaatgggggatatgtgagcggcattgctcaaacgaacgccgaacctgacgggccgacacccgagctcgaagaggaaatgttcaaaaagagaaatctgaccatcatggatcttcaccctggctccggaaaaacccggaagtacctgcccgccattgttcgcgaggctatcaaaagacggctcagaacactgattctcgcccctacccgcgtggtcgctgccgagatggaagaggcgctgaagggccttcccatccggtatcagacaaccgccacgaagagcgaacatacagggagagagatcgtggacctgatgtgccacgctacctttacaatgcgcctgctctctcctgttcgggtgccgaactacaatctgattatcatggatgaagcccatttcaccgaccccgctagcattgccgccagaggatacatctccacgcgcgtcggcatgggggaggctgcggccatttttatgaccgctacacctcccggaaccgccgatgccttccctcagtctaacgctcccatccaggacgaggaacgggacatcccggagagaagctggaattccggcaacgaatggattacagattttgccgggaaaaccgtgtggttcgtgccttctatcaaggcgggcaacgacattgctaattgtcttcgcaaaaacggaaagaaagtcatccaactgagccggaagacatttgataccgagtatcagaagacgaaactcaatgactgggatttcgttgtgacaaccgacatttccgagatgggcgccaactttaaggccgatagagtgatcgacccccggcgctgcctgaaacccgtcattctgaccgatgggcctgaaagagtgatcctcgctggacccatgcctgttacagccgcgtctgccgctcagcggcgcggcagagtggggcggaatccgcagaaggagaacgaccaatacatcttcaccggacagccccttaataacgatgaagaccacgcccattggacagaggctaaaatgctgctggacaatattaacacgcctgaaggcatcattcccgccctcttcgagcctgagagagaaaagagcgctgccatcgatggggagtatcgcctgaagggcgaatcccggaaaacctttgtcgagcttatgagacgcggagacctgcccgtgtggctcgcgcacaaggttgccagcgaaggcattaaatacacagatcggaagtggtgcttcgacgggcagagaaataaccagatcctggaggagaatatggatgtggaaatctggaccaaagagggagaaaagaaaaagctgcgcccgcggtggctcgacgctagaacatattctgatcctcttgccctgaaggagtttaaagacttcgctgccggccgcaagtccattgccctggatctcgtcaccgaaatcgggagagtgcccacgcacctggctcatcggacccgcaacgcgcttgacaatctggtcatgctccacacaagcgagcatggaggcaaagcctacagacacgctgtggaggaactgcctgagaccatggaaacactgctccttctgggcctgatgattctcctgaccgggggagccatgctttttctgatctctggcaaggggattggaaaaacgtccatcggcctcatctgtgttattgccagctccgggatgctgtggatggctgagatccccctgcaatggattgcctctgcgatcgtgctcgagttctttatgatggtgcttctgattcctgaacccgagaagcagcggacaccgcaggataaccaactggcctatgtcgttatcggaattctcaccctggctgccatcatcgctgccaatgaaatgggccttctggagacaaccaagcgcgacctcggcatgagcaaagaacctggggtggtgtcccccaccagctacctggatgtcgacctgcaccccgcgtctgcctggacactctacgctgtggccacgaccgttattacacctatgcttagacataccatcgagaactccacagctaacgtgagcctggccgctattgccaatcaggcggtcgtgctgatgggactcgacaagggctggccgatctctaaaatggatctgggggtcccccttctggccctcggatgctatagccaggtgaaccctctgaccctgacggctgccgttctccttctgattacacactacgctatcatcggccccgggctgcaggccaaggccacccgggaggcgcaaaaaagaaccgctgccggaattatgaagaatcctacagtggacggcatcatgaccattgatctcgaccccgtcatctatgattccaagttcgaaaaacagctgggccaggtgatgcttctggttctctgtgctgtgcagctgctgctcatgcgcacatcttgggccctttgcgaggccctgacgctggctaccgggcctattacaaccctctgggaaggaagcccgggcaagttttggaacacaaccatcgccgtctccatggcgaatatcttccgggggtcttacctggccggagctggccttgcctttagcattatgaaatccgtggggacgggaaagagaggcaccggcagccaaggggagacactgggagaaaaatggaagaagaaactcaaccagctgtctcgcaaggagttcgacctgtataaaaagtccggcatcaccgaggtggatcggacagaagctaaagaggggctcaagagaggagaaattacccatcacgccgttagccggggctccgcgaaacttcagtggtttgtcgagcgcaatatggtgatccccgaagggagagtgattgacctgggatgtggccggggcgggtggtcttactattgcgccggactgaagaaggtcacagaggttcgcggctacaccaaagggggacctggccatgaggaacccgtgcctatgagcacgtacgggtggaacatcgtgaagctcatgtccggaaaagatgtcttctatctgcccccggagaagtgtgacacacttctgtgcgatattggcgaatctagcccttcccccaccgtggaggagagcagaaccatccgggttctcaaaatggtggaaccctggctgaagaataaccagttctgtatcaaggtcctgaatccttacatgcccgctgtgattgagcacctcgaacgccttcaaagaaaacacggcgggatgctggttcggaaccctctgtctcgcaattccacacatgagatgtattggatcagcaacggaacgggcaatattgtggcctctgtcaacatggtgtccagactcctgcttaaccggtttaccatgacacacagacgcccgaccatcgaaaaggacgtggatctgggggctggaacacggcatgtcaatgccgagcccgagacccctaacatggacgttattggcgaaagaatcaaacgcatcaaggaggaacacaatagcacatggcactacgacgatgagaacccctataaaacctgggcttaccatgggtcttatgaagtgaaggccacgggaagcgcgtcctctatgattaatggcgtggtcaagctcctgaccaaaccttgggacgtggttcccatggtgatccagatggccatgacagataccacaccgttcggccagcaacgggtctttaaggagaaagtggacaccagaacgcctcgcagcatgcccgggacacggagagttatggagattaccgctgaatggctgtggcgcacactcggacggaacaagaaacctagactgtgcacccgcgaggaattcacgaagaaggtgcggaccaatgccgctatgggcgccgtctttacagaggaaaaccagtgggattccgccaaagcggctgtggaggacgaggatttctggaagcttgttgacagagaacgcgagctgcacaaactcgggaagtgtggaagctgcgtgtacaatatgatgggcaaaagagaaaagaaactgggggagtttggcaaggccaagggatcccgggccatctggtacatgtggcttggcgctcgctatctggagttcgaagccctcgggtttctgaacgaggatcattggttctctagagaaaatagctactccggagtcgagggcgaagggctgcacaaactcggatatattctgcgggacatctctaagatccccggcggggctatgtacgccgatgacaccgcgggctgggacacaagaattaccgaggatgaccttcataacgaggaaaaaatcacacagcagatggatcctgagcaccggcaactggccaatgctatttttaagctcacctatcagaacaaagtggtcaaggtgcagcgccccacgccgacaggaaccgttatggacatcattagcagaaaggatcagcggggctccgggcaagtgggaacctacggcctgaatacattcaccaacatggaagcccagcttatccgccagatggagggggaaggagtcctgtctaaagctgacctcgagaaccctcacctgcccgagaagaaaatcacacagtggctggaaacgaagggcgtggagagactcaaacggatggccattagcggggatgactgcgtggttaagcccatcgatgaccgctttgcgaatgccctgcttgctctgaacgatatgggcaaggtgagaaaagacattcctcaatggcagccgtccaagggatggcatgattggcagcaggtccccttctgtagccaccatttccacgaactcatcatgaaagacggccggaagctggtggttccttgccgcccccaagacgagcttattgggagagcccggatctctcagggagctggctggtccctgcgcgaaaccgcctgtctcgggaaagcttatgcccagatgtggagcctgatgtactttcacagacgggatctgcgcctcgcgtctaatgccatttgctccgctgtgcctgtccattgggtgcccacaagcagaaccacatggtctatccacgcccatcaccaatggatgaccacggaggacatgctgaccgtctggaaccgggtgtggatcgaggataatccttggatggaagacaagacacccgttaccacatgggagaacgtgccgtaccttggaaagagagaagatcagtggtgtggctccctgattgggctcaccagccgcgccacgtgggctcagaatatccctacagccattcagcaagtccggtccctgatcggcaacgaggagttccttgactatatgcccagcatgaaaagatttcgcaaggaagaggaatctgagggagcgatttggtga

SEQ ID NO: 20811 - RNA, 9873 nt, synthetic construct
  misc_feature 1..9873: note = derived and/or modified CDS sequence (opt5) from DENV-3__GQ868586__SS-prME
  source 1..9873: mol_type = other RNA
acaagcctctgcctcatgatgatcctgcccgccgctcttgccttccacctgacatcccgggacggcgaacctcggatgattgtggggaagaacgaacgcggaaagtctctcctgtttaagacggcgagcggcatcaatatgtgtacccttattgctatggatctgggggagatgtgcgacgatacagtgacctacaagtgtccgcatatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggattacaagggagaggacgttccctgtaaaattcctttcagcaccgaagatggccaagggaaggcccataacggaagactgatcacagcgaatcccgtggtcaccaaaaaggaggagcccgtgaacattgaagctgagcctccgttcggcgaatccaatatcgtgattgggatcggcgacaacgccctgaaaatcaattggtataagaagggatctagcattggcaaaatgtttgaggccacggctagaggggccagacgcatggctatccttggagatacagcctgggacttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgatacagggtgtgtcatcaattggaaaggaaaggaactgaagtgcggcagcgggattttcgtgacgaacgaggttcatacctggacagagcagtacaaatttcaagccgactcccccaagcggctggcgaccgccatcgctggcgcctgggaaaatggagtgtgtggcattagaagcacaacccgcatggagaaccttctctggaaacagatcgctaatgaactgaactatatcctgtgggagaataacattaagctcacggtcgtggttggggatatcattggagtgctggaacagggcaaacggacccttacacctcagcccatggagctgaagtactcttggaaaacctgggggaaggccaagatcgtcacagccgagacccaaaactccagcttcattatcgacggacctaatacacccgaatgcccgtctgcttccagagcgtggaacgtgtgggaggtggaagactatggctttggcgtcttcaccacgaatatctggctcaaactgcgcgaggtttacacacagcagtgtgatcaccggctgatgagcgccgctgtgaaggacgaaagagccgtgcacgccgatatggggtactggattgagtcccagaaaaacggatcttggaaacttgagaaagctagcctcatcgaagtcaagacctgcacctggcctaagtcccatacactgtggtctaatggcgtgctggagagcgacatgattatccccaaatccctcgccgggcctattagccaacacaactatcgccccggataccatacccagacggcgggcccttggcacctggggaaacttgaactggattttaattattgcgagggaacaaccgttgtgatcacagagaactgtggcacccggggcccctctctcagaacaaccacggtctccgggaaactgatccacgaatggtgctgtcgcagctgcaccctgccgcctcttcggtacatgggagaggacggctgttggtatgggatggaaattagacccatctctgagaaggaagagaatatggtgaaatccctcgttagcgctggatctggcgaggtggataacttcacaatgggggtcctgtgcctggccattctctttgaagaggtgatgcggggaaagttcggcaagaaacatatgatcgccggcgttttctttaccttcgtgctgcttctgagcgggcagattacatggcgcgacatggctcacaccctcatcatgattggatccaatgccagcgatagaatgggcatgggggtcacgtacctggcgctgatcgctacatttaagatccaacccttccttgccctgggatttttcctccggaaactgacctctagagaaaacctcctgcttggcgtggggctggccatggctacaaccctccagctgcctgaggacattgaacagatggccaatggaatcgctctgggccttatggccctgaagctcattacccagtttgagacatatcaactgtggacggcgctcatctccctgacctgtagcaacacaattttcacccttacagtggcctggcgcaccgctacgctgatcctcgccggcgtctccctgctgccggtttgccagtctagctccatgcggaaaacagattggcttcccatgaccgtggctgccatgggggtgcctcccctgcctctctttatcttctctctgaaggacaccctcaagagacgcagctggcccctgaatgagggagtcatggccgtgggccttgtttccattctggcttctagcctgctcagaaacgatgtgcctatggcggggcccctggtcgccggaggccttctgatcgcttgttacgtgattacagggacctccgccgacctcacagttgaaaaagccgctgacgtgacgtgggaggaagaggccgaacagaccggagtcagccataacctgatgatcacagtggatgacgatggcaccatgcggattaaggacgatgagacagagaatatcctcaccgtcctgcttaaaacggcgctgctgatcgtgtctggcatttttccgtactccatccctgctaccctcctggtttggcacacatggcagaagcaaacccagcgcagcggggtgctttgggacgtcccctctcctcccgaaacacagaaagccgagctggaagagggagtgtatagaattaagcagcaaggcatcttcgggaaaacccaggttggagtgggcgtccagaaggagggggtgtttcatacaatgtggcacgtgacgcggggagccgttctcacctacaacggcaagcgcctggaaccgaattgggcttccgtcaaaaaggatctcattagctatggcgggggatggagactgtctgcccaatggcagaaaggcgaggaagtccaggtgatcgcggtcgagcctgggaagaaccccaaaaatttccagacaatgcctggaaccttccaaaccacaacgggcgaaattggggctatcgcccttgactttaagcccggaacctccggcagccccatcattaaccgggagggcaaggtggttgggctgtacggaaatggcgtggtcaccaagaacgggggatatgtgtccggcatcgcccagaccaatgctgagcctgatgggccgacacccgaactggaggaagagatgttcaagaaacgcaacctcaccattatggacctgcaccctggcagcggaaagacgagaaaataccttcccgccatcgttcgggaagctattaagcgcagactgcggacactcatcctggcccctaccagagtggtcgcggccgagatggaggaagctctcaagggcctgcccatccgctatcagaccacagccaccaaatctgagcatacagggcgggaaattgtggatcttatgtgccacgctacctttacgatgagactgctgagccctgttcgcgtgccgaattacaacctcatcattatggacgaggcccatttcacagatcccgcctccatcgctgcgcggggatacatttctaccagagtcggcatgggggaagccgctgccatctttatgacagccacccctcccggaacggctgacgccttccctcagagcaatgcgcccatccaagacgaggagcgcgatattccggaacggtcctggaactctggcaatgagtggatcaccgactttgctgggaagacagtgtggttcgtgcctagcattaaagccggcaacgatatcgccaactgtctgagaaagaatggcaaaaaggtcattcagctttcccgcaagacctttgacacagaatatcagaaaaccaagctgaacgattgggacttcgttgtgacaaccgatatctctgagatgggagctaattttaaagccgaccgggtgattgatcccagacggtgcctcaagcccgtcatcctgacggacgggcctgagcgcgtgatcctggcgggacccatgcctgttacagccgctagcgccgctcagagacggggccgcgtggggagaaacccgcaaaaagaaaatgatcagtacattttcaccggacagcccctcaacaatgacgaggaccacgcccattggaccgaagctaagatgcttctggataacatcaatacacctgagggcattatccccgccctgttcgaacctgagcgggagaagtccgcggccattgacggggaatatagactcaaaggcgagagccgcaagacctttgtcgaactgatgcggagaggagatcttcccgtgtggctggctcacaaagttgcctctgagggcatcaagtacacagaccgcaaatggtgcttcgatgggcagcggaacaatcaaatcctcgaagagaacatggacgtggagatttggacgaaggaaggagagaaaaagaagctgagaccgcgctggctggatgctcggacctattccgaccctctcgcccttaaagaatttaaggatttcgccgctggcagaaaaagcatcgcgctggacctggtcacagagattgggcgcgtgccctctcacctcgcccatagaacccggaatgctctggataaccttgtcatgctgcacacatccgaacatggaggcaaggcctaccgccacgccgtggaggagctccctgaaaccatggagacgctgctgctccttggcctgatgatcctgctcaccgggggagctatgctgtttcttattagcggcaaagggatcggaaagacatccatcggcctgatttgtgttatcgcctctagcgggatgctctggatggcggaaattcccctgcagtggatcgcctccgctattgtgctggagttctttatgatggtgctccttatccctgagcccgaaaagcagagaaccccgcaagacaatcagctggcctatgtcgttattggaatcctgacactcgctgccatcattgcggccaacgagatgggcctgcttgaaaccacgaaacgggatctgggcatgagcaaggagcctggggtggtgtctcccacatcctacctcgacgtcgacctgcaccccgctagcgcctggaccctgtacgctgtggccacaaccgttatcacccctatgctccgccatacaattgaaaattctacggctaacgtgagccttgccgcgatcgccaaccaggctgtcgtgctgatgggactggataaaggctggccgatttccaagatggacctcggggtccccctgcttgccctgggatgctattctcaggtgaatcctctcaccctgacagctgccgttctgctccttatcacccactacgccatcattggccccgggctgcaagcgaaagctacaagagaggcccagaagcggaccgctgccggaatcatgaagaaccctacggtggatggcattatgacaatcgacctggatcccgtcatttatgacagcaaattcgagaagcagctcggccaggtgatgctgcttgttctgtgtgccgtgcaactcctgctgatgagaacctcctgggctctctgcgaagcccttaccctggcgacagggcctatcaccacactgtgggagggatctccgggcaaattttggaatacgaccatcgccgtcagcatggctaacattttccgcgggtcctacctcgccggagctggcctggcctttagcatcatgaagtctgtggggacaggaaaacggggcaccggctcccagggggaaacacttggagagaagtggaagaaaaagctgaatcagctcagcagaaaagagttcgatctgtataagaaatccggcattaccgaggtggaccgcacggaggcgaaggaagggctgaaacggggagaggttacccatcacgccgtctctagaggcagcgctaagctccagtggtttgtggaacggaacatggtgatccccgaggggcgcgtcattgatcttggatgtggcagaggcgggtggtcctactattgcgccggactgaagaaagttacagaagtgcggggctacaccaaagggggacctggccatgaggagcccgtgcctatgtctacatacgggtggaatatcgtcaaactgatgagcggaaaggacgtgttctatctgcccccggaaaaatgtgataccctgctttgcgacattggcgagtccagcccttctcccacagttgaagagtcccgcaccatcagagtgctgaagatggtcgagccctggctcaagaacaatcaattctgtatcaaagtgctgaacccttacatgcccacggttattgaacacctggagcggctccagcgcaagcacggcgggatgcttgtgagaaatcctctgagccggaactctacacatgaaatgtattggatctccaatggaaccggcaacattgtcgctagcgtgaatatggtgtctcgcctgctcctgaacagatttaccatgacacaccggagaccgacgatcgagaaagatgtcgaccttggggccggaacccgccatgttaacgctgaacccgagacacctaatatggacgtgattggcgagcggatcaagagaatcaaagaagaacacaacagcacctggcactacgatgacgaaaatccctataagacatgggcctaccatgggtcctatgaggtgaaggcgaccggatctgccagctccatgattaacggcgtcgtgaaactgctcacaaagccttgggatgttgtgcccatggtcacccagatggctatgacggacaccacaccgttcggccaacagcgcgtgtttaaagaaaaggttgatacccggacacctagaagcatgcccgggacccgccgggtgatgggaatcacggccgagtggctgtggagaacactgggccgcaataaaaagcctcggctctgcaccagagaggagttcacaaagaaagtccgcaccaacgctgccatgggggccgtgtttacggaggaaaatcagtgggactccgcgaaggctgccgttgaggatgaagacttctggaaactggtggagcgggagagagaacttcacaagctgggaaaatgtggctcttgcgtctacaacatgatggggaagcgcgagaaaaagctcggcgaatttggaaaggccaaaggcagcagagctatttggtacatgtggctgggggcccggtatcttgagttcgaggctctgggatttctcaatgaagatcattggttctcccgcgagaactcttacagcggcgtggaaggggagggactgcacaagctgggctatatcctcagagacatttccaaaatccccgggggcgccatgtacgcggatgacaccgccggatgggacacacggatcaccgaagatgacctgcataatgaggagaagattacacagcaaatggatcctgaacacaaacagcttgctaacgccatctttaagctgacctatcagaataaggtcgtgaaagttcagagacccacaccgaccggcacggtgatggacattatctctcggaaggatcaacgcgggagcggacaggtcggcacatacgggctcaacaccttcaccaatatggaggctcagctgattagacagatggaaggagagggcgtgctttccaaagccgacctggaaaaccctcacctccccgagaagaaaatcacacaatggctggagaccaagggggtggaacggctgaagcgcatggcgatcagcggcgatgactgcgttgtgaaacccattgatgacagatttgccaacgctctcctggcccttaatgatatgggaaaggtccggaaagacatccctcagtggcagccgtctaagggctggcatgattggcagcaagtgcccttctgttcccaccatttccacgagctgattatgaaagacgggcgcaagctcgttgtgccttgcagaccccaggacgaactgatcggacgggctcgcattagccagggcgccgggtggtctcttagagagacagcttgtctggccaaggcgtatgcccaaatgtggtccctcatgtactttcaccggcgcgatctgagactggctagcaacgccatctgctctgccgtccctgtgcattgggtccccacgtcccggaccacatggagcattcacgctcatcaccagtggatgaccacagaagacatgctcaccgtgtggaatcgcgtttggatcgaggataacccttggatggaggacaaaacgcccgtgaccacatgggaaaatgtcccgtacctgggaaagagagaggatcagtggtgtggctcccttatcgggctgaccagccgggccacatgggcgcagaacattcctaccgctatccaacaggtgagatctctcattggcaatgaagagttcctggactatatgcccagcatgaaacgctttcggaaggaggaagagtccgaaggagccatctggtga

SEQ ID NO: 20812 - RNA, 9873 nt, synthetic construct
  misc_feature 1..9873: note = derived and/or modified CDS sequence (opt5) from DENV-3__FJ850110__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccagaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctcggggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacacagggtgtgtcatcaattggaaaggaaaggagctgaagtgcggcagcgggattttcgtgacgaacgaggttcatacctggacagaacagtacaaatttcaagccgattcccccaagcggctggcgaccgccatcgctggcgcctgggagaatggagtgtgtggcattagaagcacaacccgcatggaaaaccttctctggaaacagatcgctaatgagctgaactatatcctgtgggaaaataacattaagctcacggtcgtggttggggacatcattggagtgctggagcagggcaaacggacccttacacctcagcccatggagctgaagtactcttggaaaacctgggggaaggccagaatcgtcacagccgaaacccaaaactccagcttcattatcgatggacctaatacacccgagtgcccgaacacctctcgcgcttggaatgtgtgggaagtggaggactatggctttggcgtcttcacgacaaacatctggctcaagctgcgggaagtttacacccagctgtgtgaccacagacttatgtccgcggccgtgaaagatgagcgcgctgtgcacgccgacatggggtactggattgagagccagaagaatggatcctggaaactcgaaaaggcctctctgatcgaggtcaaaacctgcacatggcctaagagccataccctgtggtccaacggcgtgctcgaatctgatatgattatccccaagagcctggctgggcctatttcccagcacaattatcggcccggataccatacgcaaacagccggcccttggcaccttgggaaactggagctcgactttaactattgcgagggaaccacagttgtgatcaccgaaaattgtggcacaagaggccccagcctgcgcaccacgaccgtctctgggaagctgatccacgagtggtgctgtcggtcctgcacacttccgcctctcagatacatgggagaagatggctgttggtatgggatggagattcggcccatcaacgaaaaagaggagaatatggtgaagagcctggtttctgcgggatccggcgaagtggacaacttcaccatgggggtcctgtgcctcgctattctgtttgaggaagtgatgcgcggaaaattcggcaagaagcatatgatcgccggcgttttctttacattcgtgcttctgctcagcgggcagattacctggagagatatggcccacacgctgatcatgattggatctaatgctacagaccggatgggcatgggggtcacctacctggcccttatcgcgacatttaaaatccagcccttcctggctctcggatttttcctgagaaagctcaccagccgcgagaacctgcttctgggcgtggggctcgccatggccaccacactgcaactgcctgaagatattgagcagatggctaatggaatcgcccttggcctgatggctctcaaactgattacgcagtttgagacctatcagctctggacagccctgatctcccttacctgtagcaacacaattttcaccctgacggtggcgtggcggacagccaccctcatcctggctggcgtctctctgcttccggtttgccaatccagctccatgagaaagaccgactggctgcccatgacagtggccgctatgggggtgcctcccctccctctgtttatcttctctctcaaagataccctgaagcgcagaagctggccccttaacgaaggagtcatggccgtgggcctggtttccattctggcctctagcctcctgcggaatgacgtgcctatggctgggccccttgtcgcgggaggcctgctcatcgcctgttacgtgattacagggacgtccgctgatctgaccgttgagaaggccgccgacgtgacatgggaagaggaagctgagcagaccggagtctctcataacctcatgatcacagtggacgatgacggcaccatgcgcattaaagatgacgagacggaaaatatcctgaccgtccttctgaagacagccctgctcatcgtgagcggcatttttccgtactccatccctgcgaccctgcttgtttggcacacatggcagaaacagacccaaagaagcggggtgctgtgggatgtcccctctcctcccgagacacagaaggctgaactcgaggagggagtgtatcggattaaacagcagggcatcttcgggaagacgcaagttggagtgggcgtccagaaagaaggggtgtttcataccatgtggcacgtgacacgcggagccgttctgacctacaacggcaagagactcgagccgaattgggcctccgtcaagaaagacctgattagctatggcgggggatggcggctttctgctcagtggcaaaagggcgaagaggtgcaggtgatcgccgtcgaacctgggaaaaaccccaagaatttccagaccatgcctggaacattccagacgaccacaggcgagattggggcgatcgctctggattttaaacccggaacctccggcagccccatcattaaccgcgagggcaaggtggttgggctgtacggaaatggcgtggtcacaaagaacgggggatatgtgtctggcatcgcccaaaccaatgccgaacctgacgggccgacgcccgagctcgaagaggaaatgttcaaaaagagaaacctgacaattatggatcttcaccctggctccggaaaaacccggaagtacctgcccgctatcgttcgcgaggccattaaaagacggctcagaaccctgatcctcgctcctacacgcgtggtcgccgcggagatggaagaggccctgaagggccttcccatccggtatcagaccacagctaccaagagcgaacatacggggagagagattgtggacctgatgtgccacgccacatttaccatgcgcctgctctcccctgttcgggtgccgaattacaacctgatcattatggatgaagctcatttcacagaccccgccagcatcgccgctagaggatacatttctacccgcgtcggcatgggggaggcggccgctatctttatgacggccacccctcccggaacagccgatgctttccctcagagcaatgcccccatccaggacgaggaacgggacattccggagagatcctggaactctggcaacgaatggatcaccgattttgcggggaaaacagtgtggttcgtgcctagcattaaggctggcaatgacatcgccaactgtcttcgcaaaaatggaaagaaagtcattcaactgtcccggaagacctttgatacagagtatcagaagaccaaactcaacgactgggatttcgttgtgacgacagacatctctgagatgggcgccaattttaaggctgatagagtgattgacccccggcgctgcctgaaacccgtcatcctgaccgatgggcctgaaagagtgatcctcgccggacccatgcctgttaccgcggccagcgctgcccagcggcgcggcagagtggggcggaacccgcagaaggagaatgaccaatacattttcacaggacagccccttaacaatgatgaagaccacgctcattggaccgaggccaaaatgctgctggacaacatcaatacacctgaaggcattatccccgctctcttcgagcctgagagagaaaagtccgccgcgattgatggggagtatcgcctgaagggcgaatctcggaaaacgtttgtcgagcttatgagacgcggagacctgcccgtgtggctcgcccacaaggttgctagcgaaggcatcaaatacaccgatcggaagtggtgcttcgacgggcagagaaacaatcagatcctggaggagaacatggatgtggaaatttggacaaaagagggagaaaagaaaaagctgcgcccgcggtggctcgacgccagaacctattccgatcctcttgctctgaaggagtttaaagacttcgccgccggccgcaagagcatcgctctggatctcgtcacagaaattgggagagtgcccacccacctggcgcatcggacgcgcaatgcccttgacaacctggtcatgctccacacctctgagcatggaggcaaagcttacagacacgccgtggaggaactgcctgagacaatggaaaccctgctccttctgggcctgatgatcctcctgacagggggagccatgctttttctgatttccggcaaggggatcggaaaaaccagcatcggcctcatttgtgttatcgcttcttccgggatgctgtggatggccgagattcccctgcaatggatcgcgagcgccattgtgctcgagttctttatgatggtgcttctgatccctgaacccgagaagcagcggacgccgcaggataatcaactggcttatgtcgttattggaatcctcacactggccgctatcattgccgcgaacgaaatgggccttctggagaccacaaagcgcgacctcggcatgtccaaagaacctggggtggtgtctcccaccagctacctggatgtcgacctgcaccccgcctccgcttggaccctctacgccgtggctacaacggttatcacccctatgcttagacatacaattgagaacagcaccgccaatgtgtctctggctgccatcgcgaaccaggccgtcgtgctgatgggactcgacaagggctggccgatttccaaaatggatctgggggtcccccttctggctctcggatgctatagccaggtgaatcctctgacactgaccgccgctgttctccttctgatcacgcactacgccatcattggccccgggctgcaggccaaggcgacacgggaggctcaaaaaagaaccgccgctggaatcatgaagaaccctaccgtggacggcattatgacaatcgatctcgaccccgtcatttatgattctaagttcgaaaaacagctgggccaggtgatgcttctggttctctgtgccgtgcagctgctgctcatgcgcaccagctgggccctttgcgaggctctgacactggccacggggcctatcaccacactctgggaaggatccccgggcaagttttggaataccacaatcgcggtctctatggccaacattttccgggggagctacctggctggagccggccttgctttttccatcatgaaatctgtggggaccggaaagagaggcacgggcagccaaggggagaccctgggagaaaaatggaagaagaaactcaatcagctgtcccgcaaggagttcgacctgtataaaaagagcggcattacagaggtggatcggaccgaagccaaagaggggctcaagagaggagaaatcacacatcacgcggtttctcggggctccgccaaacttcagtggtttgtcgagcgcaacatggtgattcccgaagggagagtgatcgacctgggatgtggccggggcgggtggagctactattgcgctggactgaagaaggtcaccgaggttcgcggctacacaaaagggggacctggccatgaggaacccgtgcctatgtccacctacgggtggaatattgtgaagctcatgtctggaaaagatgtcttctatctgcccccggagaagtgtgacacgcttctgtgcgatatcggcgaaagctccccttctcccacagtggaggagagcagaaccatccgggttctcaaaatggtggaaccctggctgaagaacaatcagttctgtattaaggtcctgaacccttacatgcccgccgtgatcgagcacctcgaacgccttcaaagaaaacacggcgggatgctggttcggaatcctctgtcccgcaacagcacccatgagatgtattggatttctaatggaacaggcaacatcgtggcttccgtcaacatggtgagcagactcctgcttaatcggtttacgatgacccacagacgcccgacaattgaaaaggacgtggatctgggggccggaacccggcatgtcaacgctgagcccgagacacctaatatggacgttatcggcgaaagaatcaaacgcattaaggaggaacacaactctacctggcactacgacgatgagaatccctataaaacatgggcctaccatgggtcctatgaagtgaaggcgaccggaagcgcctctagcatgatcaacggcgtggtcaagctcctgacgaaaccttgggacgtggttcccatggtgacccagatggctatgacagataccacaccgttcggccagcaacgggtctttaaggagaaagtggacaccagaacgcctcgctccatgcccgggacacggagagttatggagattaccgccgaatggctgtggcgcacactcggacggaataagaaacctagactgtgcacccgcgaggaattcacgaagaaggtgcggaccaacgctgccatgggcgccgtctttacagaggaaaatcagtgggattctgcgaaagctgccgtggaggacgaggatttctggaagcttgttgacagagaacgcgagctgcacaaactcgggaagtgtggaagctgcgtgtacaacatgatgggcaaaagagaaaagaaactgggggagtttggcaaggccaagggatcccgggctatctggtacatgtggcttggcgcccgctatctggagttcgaagctctcgggtttctgaatgaggatcattggttcagcagagaaaactcctactctggagtcgagggcgaagggctgcacaaactcggatatattctgcgggacatcagcaagatccccggcggggccatgtacgcggatgacaccgccggctgggacacaagaattaccgaggatgaccttcataatgaggaaaaaatcacacagcagatggatcctgagcaccggcaactggctaacgccatttttaagctcacctatcagaataaagtggtcaaggtgcagcgccccacgccgacaggaaccgttatggacatcatttccagaaaggatcagcggggctctgggcaagtgggaacctacggcctgaacacattcaccaacatggaagctcagcttatccgccagatggagggggaaggagtcctgagcaaagccgacctcgagaatcctcacctgcccgagaagaaaatcacacagtggctggaaacgaagggcgtggagagactcaaacggatggcgatttccggggatgactgcgtggttaagcccatcgatgaccgctttgccaacgctctgcttgccctgaatgatatgggcaaggtgagaaaagacattcctcaatggcagccgtctaagggatggcatgattggcagcaggtccccttctgtagccaccatttccacgaactcatcatgaaagacggccggaagctggtggttccttgccgcccccaagacgagcttattgggagagctcggatctcccagggagccggctggagcctgcgcgaaaccgcttgtctcgggaaagcctatgcgcagatgtggtctctgatgtactttcacagacgggatctgcgcctcgcctccaacgctatttgcagcgccgtgcctgtccattgggtgcccacatctagaaccacatggtccatccacgcccatcaccaatggatgaccacggaggacatgctgaccgtctggaatcgggtgtggatcgaggataacccttggatggaagacaagacacccgttaccacatgggagaatgtgccgtaccttggaaagagagaagatcagtggtgtggcagcctgattgggctcacctctcgcgctacgtgggcccagaacatccctacagcgattcagcaagtccggtccctgatcggcaatgaggagttccttgactatatgcccagcatgaaaagatttcgcaaggaagaggaatccgagggagctatttggtga

SEQ ID NO: 20813 - RNA, 9873 nt, synthetic construct
  misc_feature 1..9873: note = derived and/or modified CDS sequence (opt5) from DENV-3__FJ850111__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccagaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataactctctgaaaatcaattggtataagaagggaagctccattggcaaaatgtttgaagccacggcccggggggctagacgcatggccatccttggagacacagcttgggatttcggcagcgttgggggagtcctcaactctctgggcaagatggtgcaccagatttttgggtccgcctacaccgcgctgttcagcggcgtgtcttgggtcatgaaaatcggaattggcgtgctcctgacctggatcgggcttaatagcaagaacacatccatgtcttttagctgcattgccatcggaatcattaccctgtatctcggcgctgttgtgcaggccgacacagggtgtgtcatcaattggaaaggaaaggagctgaagtgcggctccgggattttcgtgacgaacgaggttcatacctggacagaacagtacaaatttcaagctgatagccccaagcggctggccaccgcgatcgccggcgcttgggagaatggagtgtgtggcattagatctacaacccgcatggaaaaccttctctggaaacagatcgccaatgagctgaactatatcctgtgggaaaataacattaagctcacggtcgtggttggggacatcattggagtgctggagcagggcaaacggacccttacacctcagcccatggagctgaagtactcctggaaaacctgggggaaggctagaatcgtcacagccgaaacccaaaacagctctttcattatcgatggacctaatacacccgagtgcccgaacacctcccgcgcctggaatgtgtgggaagtggaggactatggctttggcgtcttcacgacaaacatctggctcaagctgcgggaagtttacacccagctgtgtgaccacagacttatgagcgctgcggtgaaagatgagcgcgccgtgcacgctgacatggggtactggattgagtcccagaagaatggatcttggaaactcgaaaaggccagcctgatcgaggtcaaaacctgcacatggcctaagtcccataccctgtggtctaacggcgtgctcgaaagcgatatgattatccccaagtccctggccgggcctattagccagcacaattatcggcccggataccatacgcaaacagctggcccttggcaccttgggaaactggagctcgactttaactattgcgagggaaccacagttgtgatcaccgaaaattgtggcacaagaggcccctctctgcgcaccacgaccgtctccgggaagctgatccacgagtggtgctgtcggagctgcacacttccgcctctcagatacatgggagaagatggctgttggtatgggatggagattcggcccatctctgaaaaagaggagaacatggtgaagtccctggttagcgccggatctggcgaagtggacaatttcaccatgggggtcctgtgcctcgcgattctgtttgaggaagtgatgcgcggaaaattcggcaagaagcatatgatcgctggcgttttctttacattcgtgcttctgctcagcgggcagattacctggagagatatggcccacacgctgatcatgattggatccaacgccacagaccggatgggcatgggggtcacctacctggctcttatcgccacatttaaaatccagcccttcctggcgctcggatttttcctgagaaagctcaccagccgcgagaatctgcttctgggcgtggggctcgctatggccaccacactgcaactgcctgaagatattgagcagatggccaacggaatcgctcttggcctgatggccctcaaactgattacgcagtttgagacctatcagctctggacagctctgatctctcttacctgttccaatacaattttcaccctgacggtggcctggcggacagcgaccctcatcctggccggcgtcagcctgcttccggtttgccaatcctctagcatgagaaagaccgactggctgcccatgacagtggctgccatgggggtgcctcccctccctctgtttatcttctccctcaaagataccctgaagcgcagatcttggccccttaacgaaggagtcatggctgtgggcctggttagcattctggcctcctctctcctgcggaacgacgtgcctatggccgggccccttgtcgctggaggcctgctcatcgcgtgttacgtgattacagggacgagcgccgatctgaccgttgagaaggctgccgacgtgacatgggaagaggaagccgagcagaccggagtctcccataatctcatgatcacagtggacgatgacggcaccatgcgcattaaagatgacgagacggaaaacatcctgaccgtccttctgaagacagctctgctcatcgtgagcggcatttttccgtactctatccctgccaccctgcttgtttggcacacatggcagaaacagacccaaagatccggggtgctgtgggatgtccccagccctcccgagacacagaaggcggaactcgaggagggagtgtatcggattaaacagcagggcatcttcgggaagacgcaagttggagtgggcgtccagaaagaaggggtgtttcataccatgtggcacgtgacacgcggagctgttctgacctacaatggcaagagactcgagccgaactgggcctctgtcaagaaagacctgatttcctatggcgggggatggcggcttagcgcccagtggcaaaagggcgaagaggtgcaggtgatcgctgtcgaacctgggaaaaatcccaagaacttccagaccatgcctggaacattccagacgaccacaggcgagattggggccatcgcgctggattttaaacccggaacctctggctcccccatcattaatcgcgagggcaaggtggttgggctgtacggaaacggcgtggtcacaaagaatgggggatatgtgagcggcatcgctcaaaccaacgccgaacctgacgggccgacgcccgagctcgaagaggaaatgttcaaaaagagaaatctgacaattatggatcttcaccctggctccggaaaaacccggaagtacctgcccgccatcgttcgcgaggctattaaaagacggctcagaaccctgatcctcgcccctacacgcgtggtcgctgccgagatggaagaggcgctgaagggccttcccatccggtatcagaccacagccaccaagagcgaacatacggggagagagattgtggacctgatgtgccacgctacatttaccatgcgcctgctctctcctgttcgggtgccgaactacaatctgatcattatggatgaagcccatttcacagaccccgctagcatcgccgccagaggatacatttccacccgcgtcggcatgggggaggctgcggccatctttatgacggctacccctcccggaacagccgatgccttccctcagtctaacgctcccatccaggacgaggaacgggacattccggagagaagctggaattccggcaacgaatggatcaccgattttgccgggaaaacagtgtggttcgtgccttctattaaggcgggcaacgacatcgctaattgtcttcgcaaaaacggaaagaaagtcattcaactgagccggaagacctttgatacagagtatcagaagaccaaactcaatgactgggatttcgttgtgacgacagacatctccgagatgggcgccaactttaaggccgatagagtgattgacccccggcgctgcctgaaacccgtcatcctgaccgatgggcctgaaagagtgatcctcgctggacccatgcctgttaccgccgcgtctgccgctcagcggcgcggcagagtggggcggaatccgcagaaggagaacgaccaatacattttcacaggacagccccttaataacgatgaagaccacgcccattggaccgaggctaaaatgctgctggacaatatcaacacacctgaaggcattatccccgccctcttcgagcctgagagagaaaagagcgctgccattgatggggagtatcgcctgaagggcgaatcccggaaaacgtttgtcgagcttatgagacgcggagacctgcccgtgtggctcgcgcacaaggttgccagcgaaggcatcaaatacaccgatcggaagtggtgcttcgacgggcagagaaataaccagatcctggaggagaatatggatgtggaaatttggacaaaagagggagaaaagaaaaagctgcgcccgcggtggctcgacgctagaacctattctgatcctcttgccctgaaggagtttaaagacttcgctgccggccgcaagtccatcgccctggatctcgtcacagaaattgggagagtgcccacccacctggctcatcggacgcgcaacgcgcttgacaatctggtcatgctccacaccagcgagcatggaggcaaagcctacagacacgctgtggaggaactgcctgagacaatggaaaccctgctccttctgggcctgatgatcctcctgacagggggagccatgctttttctgatttctggcaaggggatcggaaaaacctccatcggcctcatttgtgttatcgccagctccgggatgctgtggatggctgagattcccctgcaatggatcgcctctgcgattgtgctcgagttctttatgatggtgcttctgatccctgaacccgagaagcagcggacgccgcaggataaccaactggcctatgtcgttattggaatcctcacactggctgccatcattgctgccaatgaaatgggccttctggagaccacaaagcgcgacctcggcatgagcaaagaacctggggtggtgtcccccaccagctacctggatgtcgacctgcaccccgcgtctgcctggaccctctacgctgtggccacaacggttatcacccctatgcttagacatacaattgagaactccaccgctaacgtgagcctggccgctatcgccaatcaggcggtcgtgctgatgggactcgacaagggctggccgatttctaaaatggatctgggggtcccccttctggccctcggatgctatagccaggtgaaccctctgacactgaccgctgccgttctccttctgatcacgcactacgctatcattggccccgggctgcaggccaaggccacacgggaggcgcaaaaaagaaccgctgccggaatcatgaagaatcctaccgtggacggcattatgacaatcgatctcgaccccgtcatttatgattccaagttcgaaaaacagctgggccaggtgatgcttctggttctctgtgctgtgcagctgctgctcatgcgcacctcttgggccctttgcgaggccctgacactggctacggggcctatcaccacactctgggaaggaagcccgggcaagttttggaacaccacaatcgccgtctccatggcgaatattttccgggggtcttacctggccggagctggccttgcctttagcatcatgaaatccgtggggaccggaaagagaggcacgggcagccaaggggagaccctgggagaaaaatggaagaagaaactcaaccagctgtctcgcaaggagttcgacctgtataaaaagtccggcattacagaggtggatcggaccgaagctaaagaggggctcaagagaggagaaatcacacatcacgccgttagccggggctccgcgaaacttcagtggtttgtcgagcgcaatatggtgattcccgaagggagagtgatcgacctgggatgtggccggggcgggtggtcttactattgcgccggactgaagaaggtcaccgaggttcgcggctacacaaaagggggacctggccatgaggaacccgtgcctatgagcacctacgggtggaacattgtgaagctcatgtccggaaaagatgtcttctatctgcccccggagaagtgtgacacgcttctgtgcgatatcggcgaatctagcccttcccccacagtggaggagagcagaaccatccgggttctcaaaatggtggaaccctggctgaagaataaccagttctgtattaaggtcctgaatccttacatgcccgctgtgatcgagcacctcgaacgccttcaaagaaaacacggcgggatgctggttcggaaccctctgtctcgcaattccacccatgagatgtattggattagcaacggaacaggcaatatcgtggcctctgtcaacatggtgtccagactcctgcttaaccggtttacgatgacccacagacgcccgacaattgaaaaggacgtggatctgggggctggaacccggcatgtcaatgccgagcccgagacacctaacatggacgttatcggcgaaagaatcaaacgcattaaggaggaacacaatagcacctggcactacgacgatgagaacccctataaaacatgggcttaccatgggtcttatgaagtgaaggccaccggaagcgcgtcctctatgatcaatggcgtggtcaagctcctgacgaaaccttgggacgtggttcccatggtgattcagatggccatgaccgatacaaccccgttcggccagcaacgggtctttaaggagaaagtggacacaagaacccctcgcagcatgcccgggacgcggagagttatggagatcacagctgaatggctgtggcgcaccctcggacggaacaagaaacctagactgtgcacacgcgaggaattcaccaagaaggtgcggacgaatgccgctatgggcgccgtctttaccgaggaaaaccagtgggattccgccaaagcggctgtggaggacgaggatttctggaagcttgttgacagagaacgcgagctgcacaaactcgggaagtgtggaagctgcgtgtacaatatgatgggcaaaagagaaaagaaactgggggagtttggcaaggccaagggatcccgggccatttggtacatgtggcttggcgctcgctatctggagttcgaagccctcgggtttctgaacgaggatcattggttctctagagaaaatagctactccggagtcgagggcgaagggctgcacaaactcggatatatcctgcgggacatctctaagattcccggcggggctatgtacgccgatgacacagcgggctgggacaccagaatcacagaggatgaccttcataacgaggaaaaaattacccagcagatggatcctgagcaccggcaactggccaatgctatctttaagctcacatatcagaacaaagtggtcaaggtgcagcgccccaccccgacgggaacagttatggacattatcagcagaaaggatcagcggggctccgggcaagtgggaacctacggcctgaataccttcacaaacatggaagcccagcttatccgccagatggagggggaaggagtcctgtctaaagctgacctcgagaaccctcacctgcccgagaagaaaattacccagtggctggaaacaaagggcgtggagagactcaaacggatggccatcagcggggatgactgcgtggttaagcccattgatgaccgctttgcgaatgccctgcttgctctgaacgatatgggcaaggtgagaaaagacatccctcaatggcagccgtccaagggatggcatgattggcagcaggtccccttctgtagccaccatttccacgaactcattatgaaagacggccggaagctggtggttccttgccgcccccaagacgagcttatcgggagagcccggatttctcagggagctggctggtccctgcgcgaaacggcctgtctcgggaaagcttatgcccagatgtggagcctgatgtactttcacagacgggatctgcgcctcgcgtctaatgccatctgctccgctgtgcctgtccattgggtgcccaccagcagaacaacctggtctatccacgcccatcaccaatggatgacaaccgaggacatgctgacggtctggaaccgggtgtggattgaggataatccttggatggaagacaagacccccgttacaacctgggagaacgtgccgtaccttggaaagagagaagatcagtggtgtggctccctgatcgggctcacaagccgcgccacctgggctcagaatattcctacggccatccagcaagtccggtccctgattggcaacgaggagttccttgactatatgcccagcatgaaaagatttcgcaaggaagaggaatctgagggagcgatctggtga

SEQ ID NO: 20814 - RNA, 9873 nt, synthetic construct
  misc_feature 1..9873: note = derived and/or modified CDS sequence (opt5) from DENV-3__KF955486__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccatcctggcgctttttctggcccattacatcgggacgtccctcacacagaaggtggtcattttcaccctgcttatgctggtgacaccttctatgaccatgagatgtgttggagtgggcaaccgggactttgtcgaagggctcagcggagctacctgggtggatgtggtcctggagcacggcgggtgcgttacaacgatggccaagaataaacccaccctggacatcgagctccagaagacagaagctacccaactggccacacttcgcaaactgtgtattgagggaaagatcaccaacattacgacagattccagatgccctacccagggcgaagcggtgctcccggaggaacaggaccagaattatgtgtgtaaacacacctacgtcgatcggggctgggggaacggatgcggcctgttcgggaagggaagccttgtgacatgcgccaagtttcaatgtctggagcccatcgagggcaaagttgtgcagtatgaaaatctcaagtacaccgtcattatcacagtgcatacgggggaccagcaccaggttggaaacgagacccaaggcgtgacagctgaaatcacccctcaggcctctacaaccgaggctattctgcccgaatatggcacgctggggctcgagtgctcccctcgcaccggactggacttcaatgagatgatccttctgacaatgaaaaacaaggcctggatggtccatagacagtggtttttcgatctccccctgccgtggaccagcggcgccacaaccgaaacgcctacatggaatcggaaagagcttctggtgacctttaagaacgctcacgcgaaaaagcaagaagtcgtggttctcgggtctcaggagggagccatgcacacagctctgaccggcgccaccgaaattcagaattccgggggcacaagcatcttcgccggacatctgaagtgtcgcctcaaaatggacaagctggagcttaaaggcatgtcttacgctatgtgcacgaacacctttgtgctgaagaaagaggtctccgaaacacagcacgggaccattctcatcaaggtggagtacaagggagaagatgttccctgtaaaatccctttcagcacagaggacggccaagggaaggcccataacggaagactgattaccgcgaatcccgtggtcacgaaaaaggaggaacccgtgaacatcgaggctgaacctccgttcggcgagtccaatattgtgatcgggattggcgataacgccctgaaaatcaattggtataagaagggatctagcatcggcaaaatgtttgaagccacagctcggggggccagacgcatggctattcttggagacaccgcctgggatttcggctccgttgggggagtcctcaacagcctgggcaagatggtgcaccagatctttgggtctgcgtacaccgccctgttctccggcgtgagctgggtcatgaaaattggaatcggcgtgctcctgacatggattgggcttaattctaagaacaccagcatgtccttttcttgcatcgctattggaatcatcacactgtatctcggcgccgttgtgcaggctgacatggggtgtgtcattaattggaaaggaaaggagctgaagtgcggcagcgggatcttcgtgacgaacgaggttcatacctggacagaacagtacaaatttcaagccgattcccccaagcggctggcgaccgccattgctggcgcctgggagaatggagtgtgtggcatcagaagcacaacccgcatggaaaaccttctctggaaacagattgctaatgagctgaactatatcctgtgggaaaataacatcaagctcacggtcgtggttggggacattatcggagtgctggagcagggcaaacggacccttacacctcagcccatggagctgaagtactcttggaaaacctgggggaaggccaagattgtcacagccgaaacccaaaactccagcttcatcattgatggacctaatacacccgagtgcccgtctgcttccagagcgtggaacgtgtgggaagtggaggactatggctttggcgtcttcaccacgaatatctggctcaaactgcgcgaagtttacacacagctgtgtgaccaccggcttatgagcgccgctgtgaaggatgagagagccgtgcacgccgacatggggtactggatcgagtcccagaaaaacggatcttggaagctcgaaaaagctagcctgattgaggtcaagacctgcacctggcctaagtcccatacactgtggtctaatggcgtgctcgaaagcgatatgatcattcccaaatccctggccgggcctatcagccagcacaactatcgccccggataccatacccaaacggcgggcccttggcaccttgggaagctggagctcgactttaattattgcgagggaacaaccgttgtgattacagaaaactgtggcacccggggcccctctctgagaacaaccacggtctccgggaaactgatccacgagtggtgctgtcgcagctgcacccttccgcctctccggtacatgggagaagatggctgttggtatgggatggagatcagacccatttctgaaaaggaggagaatatggtgaaatccctggttagcgctggatctggcgaagtggacaacttcacaatgggggtcctgtgcctcgccatcctgtttgaggaagtgatgcggggaaagttcggcaagaaacatatgattgccggcgttttctttaccttcgtgcttctgctcagcgggcagatcacatggcgcgatatggctcacaccctgattatgatcggatccaatgccagcgacagaatgggcatgggggtcacgtacctggcgcttattgctacatttaagatccagcccttcctggccctcggatttttcctgcggaaactcacctctagagagaacctgcttctgggcgtggggctcgccatggctacaaccctgcaactgcctgaagatatcgagcagatggccaatggaattgctcttggcctgatggccctcaagctgatcacccagtttgagacatatcagctctggacggcgctgatttcccttacctgtagcaacacaatcttcaccctgacagtggcctggcgcaccgctacgctcattctggccggcgtctccctgcttccggtttgccaatctagctccatgcggaaaacagactggctgcccatgaccgtggctgccatgggggtgcctcccctccctctgtttatcttctctctcaaggataccctgaagagacgcagctggccccttaatgaaggagtcatggccgtgggcctggtttccatcctggcttctagcctcctgagaaacgacgtgcctatggcggggccccttgtcgccggaggcctgctcattgcttgttacgtgatcacagggacctccgccgatctgacagttgagaaagccgctgacgtgacgtgggaagaggaagccgagcagaccggagtcagccataacctcatgattacagtggacgatgacggcaccatgcggatcaaggatgacgagacagaaaatattctgaccgtccttctgaaaacggcgctgctcatcgtgtctggcatctttccgtactccattcctgctaccctgcttgtttggcacacatggcagaagcagacccaacgcagcggggtgctgtgggatgtcccctctcctcccgagacacagaaagccgaactcgaggagggagtgtatagaatcaagcagcagggcattttcgggaaaacccaagttggagtgggcgtccagaaggaaggggtgtttcatacaatgtggcacgtgacgcggggagccgttctgacctacaacggcaagcgcctcgagccgaattgggcttccgtcaaaaaggacctgatcagctatggcgggggatggagactttctgcccagtggcaaaaaggcgaagaggtgcaggtgattgcggtcgaacctgggaagaaccccaaaaatttccagacaatgcctggaaccttccagaccacaacgggcgagatcggggctattgccctggattttaagcccggaacctccggcagccccatcatcaaccgggagggcaaggtggttgggctgtacggaaatggcgtggtcacaaaaaacgggggatatgtgtccggcattgcccaaaccaatgctgaacctgacgggccgacacccgagctcgaagaggaaatgttcaagaaacgcaacctgaccatcatggatcttcaccctggcagcggaaagacgagaaaatacctgcccgccattgttcgggaggctatcaagcgcagactccggacactgattctcgcccctaccagagtggtcgcggccgagatggaagaggctctgaagggccttcccatccgctatcagaccacagccaccaaatctgaacatacagggcgggagatcgtggacctgatgtgccacgctacctttacgatgagactgctcagccctgttcgcgtgccgaattacaacctgattatcatggatgaagcccatttcacagaccccgcctccattgctgcgcggggatacatctctaccagagtcggcatgggggaggccgctgccatttttatgacagccacccctcccggaacggctgatgccttccctcagagcaatgcgcccatccaggacgaggaaaaggacatcccggagcgctcctggaactctggcaatgaatggattaccgattttgctgggaaaacagtgtggttcgtgcctagcatcaaggccggcaacgacattgccaactgtcttcggaaaaatggaaagaaggtcatccaactgtccagaaaaacctttgatacagagtatcagaagaccaaactcaacgactgggatttcgttgtgacaaccgacatttctgagatgggcgctaattttaaggccgatcgcgtgatcgacccccggagatgcctgaaacccgtcattctgacggatgggcctgaacgggtgatcctcgcgggacccatgcctgttacagccgctagcgccgctcagcgcagaggccgggtggggcgcaacccgcagaaggagaatgaccaatacatcttcaccggacagccccttaacaatgatgaagaccacgcccattggaccgaggctaagatgctgctggacaacattaatacacctgaaggcatcattcccgccctcttcgagcctgagagagaaaaatccgcggccatcgatggggagtatcggctgaagggcgaaagcagaaaaacctttgtcgagcttatgcgccggggagacctgcccgtgtggctcgctcacaaggttgcctctgaaggcattaaatacacagatagaaagtggtgcttcgacgggcagcgcaacaatcagatcctggaggagaacatggatgtggaaatctggacgaaagagggagaaaagaagaaactgcggccgagatggctcgacgctcgcacctattccgatcctcttgccctgaaggagtttaaagacttcgccgctggccggaagagcattgcgctggatctcgtcacagaaatcgggagagtgcccacccacctggcccatcgcacaagaaatgctcttgacaacctggtcatgctccacacctctgagcatggaggcaaagcctaccggcacgccgtggaggaactgcctgagacgatggaaaccctgctccttctgggcctgatgattctcctgacagggggagctatgctttttctgatctccggcaaggggattggaaagaccagcatcggcctcatctgtgttattgcctcctctgggatgctgtggatggcggagatccccctgcaatggattgccagcgctatcgtgctcgagttctttatgatggtgcttctgattcctgaacccgagaaacagcgcacaccgcaggataatcaactggcctatgtcgttatcggaattctcaccctggctgccatcatcgcggccaacgaaatgggccttctggagacgacaaagagagacctcggcatgtccaaagaacctggggtggtgagccccacctcttacctggatgtcgacctgcaccccgcttccgcctggacactctacgctgtggccaccaccgttattacacctatgcttcggcatacgatcgagaatagcaccgctaacgtgtctctggccgcgattgccaaccaggctgtcgtgctgatgggactcgacaagggctggccgatcagcaaaatggatctgggggtcccccttctggccctcggatgctattcccaggtgaatcctctgacactgaccgctgccgttctccttctgattacacactacgccatcatcggccccgggctgcaggcgaaggctacccgcgaggcccaaaagagaacggctgccggaattatgaaaaaccctacagtggacggcatcatgaccattgatctcgaccccgtcatctatgattctaagttcgaaaaacagctgggccaggtgatgcttctggttctctgtgccgtgcagctgctgctcatgcggaccagctgggctctttgcgaggccctgacactggcgaccgggcctattacaacgctctgggaaggatccccgggcaagttttggaataccacaatcgccgtctctatggctaacatcttcagagggagctacctggccggagctggccttgccttttccattatgaaaagcgtggggaccggaaagcgcggcacaggctctcaaggggagaccctgggagaaaagtggaaaaagaaactcaatcagctgtcccggaaggagttcgacctgtataaaaagagcggcatcacggaggtggatagaaccgaagcgaaagaggggctcaagcgcggagaaattacacatcacgccgtttcccggggctctgctaagcttcagtggtttgtcgagagaaacatggtgatccccgaagggcgggtgattgacctgggatgtggccgcggcgggtggagctactattgcgccggactgaaaaaggtcaccgaggttagaggctacacaaaagggggacctggccatgaggaacccgtgcctatgtccacctacgggtggaatatcgtgaagctcatgtctggaaaagatgtcttctatctgcccccggagaagtgtgacacacttctgtgcgatattggcgaaagctcccctagccccaccgtggaggagtctcggacgatccgcgttctcaagatggtggaaccctggctgaaaaacaatcagttctgtatcaaggtcctgaacccttacatgcccacagtgattgagcacctcgaaagacttcaacggaaacacggcgggatgctggttcgcaatcctctgtccagaaacagcacccatgagatgtattggatctctaatggaaccggcaacattgtggcttccgtcaatatggtgagccggctcctgcttaaccgctttacaatgacgcacagacggccgaccatcgaaaaggacgtggatctgggggccggaacaagacatgtcaacgctgagcccgagacccctaatatggacgttattggcgaacgcatcaaacggatcaaggaggaacacaactctacatggcactacgacgatgagaatccctataagacctgggcctaccatgggagctatgaagtgaaagcgacaggatccgcctctagcatgattaacggcgtggtcaagctcctgaccaaaccttgggacgtggttcccatggtgacgcagatggctatgaccgatacaaccccgttcggccagcaaagagtctttaaggagaaagtggacacacgcacccctcggtccatgcccgggacgagacgcgttatgggaatcacagccgagtggctgtggcggaccctcggcagaaataagaagcctcgcctgtgcacacgggaagagttcaccaaaaaggtgagaacgaacgctgccatgggggccgtctttaccgaagagaatcagtgggatagcgcgaaagctgccgtggaagacgaggatttctggaagcttgttgaccgcgagcgggaactgcacaaactcggaaagtgtggctcctgcgtgtacaacatgatggggaaaagagagaagaagctgggcgaatttggaaaagccaagggctctcgcgctatttggtacatgtggcttggggccagatatctggagttcgaggctctcggatttctgaatgaagatcattggttcagccgggagaactcctactctggcgtcgaaggggagggactgcacaaactcggctatatcctgcgcgacattagcaagatccccgggggcgccatgtacgcggatgacacagccggatgggacaccagaatcacagaagatgaccttcataatgaggagaaaattacccagcagatggatcctgaacaccggcaactggctaacgccatctttaagctcacatatcagaataaggtggtcaaagtgcagagacccaccccgacgggcacagttatggacattatctcccggaaggatcagcgcgggtctggacaagtgggcacctacgggctgaacaccttcacaaatatggaggctcagcttattagacagatggaaggagagggcgtcctgagcaaagccgacctcgaaaaccctcacctgcccgagaagaaaatcacccagtggctggagacaaagggggtggaacggctcaagcgcatggcgatctccggcgatgactgcgtggttaaacccattgatgacagatttgccaacgctctgcttgccctgaatgatatgggaaaggtgcggaaagacatccctcaatggcagccgagcaagggctggcatgattggcagcaggtccccttctgttctcaccatttccacgagctcattatgaaagacgggcgcaagctggtggttccttgcagaccccaagacgaacttatcggacgggctcgcatttcccagggcgccgggtggagcctgagagagacggcttgtctcggaaaggcctatgcgcagatgtggtctctgatgtactttcaccggcgcgatctgagactcgcctccaacgctatctgcagcgccgtgcctgtccattgggtgcccacctctcggacaacctggtccattcacgcccatcaccaatggatgacaaccgaagacatgctgacggtctggaatcgcgtgtggatcgaggataacccttggatggaggacaaaacccccgttacaacctgggaaaatgtgccgtaccttggcaagagagaggatcagtggtgtgggagcctgatcggcctcacatcccgggctacctgggcccagaacattcctacggcgatccagcaagtcagaagcctgattggaaatgaagagttccttgactatatgccctctatgaaacgctttcggaaggaggaagagagcgaaggcgctatctggtga

SEQ ID NO: 20815 - RNA, 9873 nt, synthetic construct
  misc_feature 1..9873: note = derived and/or modified CDS sequence (opt5) from DENV-3__FJ898468__SS-prME
  source 1..9873: mol_type = other RNA
accagcctgtgcctcatgatgatcctgcccgccgctcttgccttccacctgacgtcccgggacggagaacctcggatgattgtggggaagaacgaacgcggaaagtctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacgtgatcggagtcctggagcagggcaaacggacgcttacccctcagcccatggagctgaagtactcttggaaaacatgggggaaggccaagattgtgaccgccgaaacacaaaactccagcttcatcattgatggacctaatacccccgagtgcccgtctgcttccagagcgtggaacgtgtgggaagtcgaggactatggctttggcgttttcacaaccaatatctggctcaaactgcgcgaagtgtacacgcagctgtgtgaccaccggcttatgagcgccgctgtgaaggatgagagagccgtccacgccgacatggggtactggatcgagtcccagaaaaacggatcttggaagctcgaaaaagctagcctgattgaggtgaagacatgcacctggcctaagtcccataccctgtggtctaatggcgttctcgaaagcgatatgatcattcccaaatccctggccgggcctatcagccagcacaactatcgccccggataccatacacaaaccgcgggcccttggcaccttgggaagctggagctcgactttaattattgcgagggaacgacagtggtcattaccgaaaactgtggcacacggggcccctctctgagaaccacaaccgtgtccgggaaactgatccacgagtggtgctgtcgcagctgcacgcttccgcctctccggtacatgggagaagatggctgttggtatgggatggagatcagacccatttctgaaaaggaggagaatatggttaaatccctggtgagcgctggatctggcgaagtcgacaacttcaccatgggggtgctgtgcctcgccatcctgtttgaggaagttatgcggggaaagttcggcaagaaacatatgattgccggcgtgttctttacattcgtccttctgctcagcgggcagatcacctggcgcgatatggctcacacactgattatgatcggatccaatgccagcgacagaatgggcatgggggtgacctacctggcgcttattgctacgtttaagatccagcccttcctggccctcggatttttcctgcggaaactcacatctagagagaacctgcttctgggcgtggggctcgccatggctaccacactgcaactgcctgaagatatcgagcagatggccaatggaattgctcttggcctgatggccctcaagctgatcacccagtttgagacctatcagctctggacagcgctgatttcccttacgtgtagcaacaccatcttcacactgaccgtcgcctggcgcacagctaccctcattctggccggcgtttccctgcttccggtgtgccaatctagctccatgcggaaaacggactggctgcccatgacagtggctgccatgggggtccctcccctccctctgtttatcttctctctcaaggataccctgaagagacgcagctggccccttaatgaaggagtgatggccgttggcctggtgtccatcctggcttctagcctcctgagaaacgacgtccctatggcggggccccttgtggccggaggcctgctcattgcttgttacgttatcaccgggacatccgccgatctgaccgtggagaaagccgctgacgtcacatgggaagaggaagccgagcagacgggagtgagccataacctcatgattaccgtcgacgatgacggcacaatgcggatcaaggatgacgagaccgaaaatattctgacagtgcttctgaaaaccgcgctgctcatcgtttctggcatctttccgtactccattcctgctacgctgcttgtgtggcacacctggcagaagcagacacaacgcagcggggtcctgtgggatgtgccctctcctcccgagacccagaaagccgaactcgaggagggagtttatagaatcaagcagcagggcattttcgggaaaacacaagtgggagtcggcgtgcagaaggaaggggtgtttcataccatgtggcacgttacacggggagccgtcctgacgtacaacggcaagcgcctcgagccgaattgggcttccgtgaaaaaggacctgatcagctatggcgggggatggagactttctgcccagtggcaaaaaggcgaagaggtgcaggtcattgcggtggaacctgggaagaaccccaaaaatttccagaccatgcctggaacattccagaccaccacaggcgagatcggggctattgccctggattttaagcccggaacgtccggcagccccatcatcaaccgggagggcaaggttgtggggctgtacggaaatggcgtcgtgaccaaaaacgggggatatgtttccggcattgcccaaacaaatgctgaacctgacgggccgacccccgagctcgaagaggaaatgttcaagaaacgcaacctgacaatcatggatcttcaccctggcagcggaaagaccagaaaatacctgcccgccattgtgcgggaggctatcaagcgcagactccggacgctgattctcgcccctacaagagtcgtggcggccgagatggaagaggctctgaagggccttcccatccgctatcagaccaccgccacaaaatctgaacataccgggcgggagatcgttgacctgatgtgccacgctacatttaccatgagactgctcagccctgtgcgcgtcccgaattacaacctgattatcatggatgaagcccatttcacggaccccgcctccattgctgcgcggggatacatctctacaagagtgggcatgggggaggccgctgccatttttatgaccgccacacctcccggaaccgctgatgccttccctcagagcaatgcgcccatccaggacgaggaacgcgacatcccggagcggtcctggaactctggcaatgaatggattacggattttgctgggaagaccgtgtggttcgtccctagcatcaaagccggcaacgacattgccaactgtcttagaaagaatggcaaaaaggttatccaactgtcccgcaagacatttgataccgagtatcagaaaacaaagctcaacgactgggatttcgtggtgaccacagacatttctgagatgggagctaattttaaagccgatcgggtcatcgaccccagacggtgcctgaagcccgtgattctgaccgatgggcctgaacgcgttatcctcgcgggacccatgcctgtgacggccgctagcgccgctcagagacggggccgcgtcgggagaaacccgcagaaagagaatgaccaatacatcttcacaggacagccccttaacaatgatgaagaccacgcccattggaccgaggctaagatgctgctggacaacattaatacccctgaaggcatcattcccgccctcttcgagcctgagcgggaaaagtccgcggccatcgatggggagtatagactgaaaggcgaaagccgcaagacatttgtggagcttatgcggagaggagacctgcccgtttggctcgctcacaaagtggcctctgaaggcattaagtacaccgatcgcaaatggtgcttcgacgggcagcggaacaatcagatcctggaggagaacatggatgtcgaaatctggacaaaggagggagagaagaagaagctgagaccgcgctggctcgacgctcggacgtattccgatcctcttgccctgaaagagtttaaggacttcgccgctggcagaaaaagcattgcgctggatctcgtgaccgaaatcgggcgcgtcccctctcacctggcccatagaacacggaatgctcttgacaacctggtgatgctccacacctccgagcatggaggcaaggcctaccgccacgccgttgaggaactgcctgagacaatggaaaccctgctccttctgggcctgatgattctcctgacagggggagctatgctttttctgatcagcggcaaagggattggaaagacctccatcggcctcatctgtgtgattgcctctagcgggatgctgtggatggcggagatccccctgcaatggattgcctccgctatcgtgctcgagttctttatgatggtccttctgattcctgaacccgagaagcagagaacaccgcaggataatcaactggcctatgttgtgatcggcattctcaccctggctgccatcatcgcggccaacgaaatgggccttctggagacaaccaaacgggacctcggcatgagcaaggaacctggggtggtctctcccacgtcctacctggatgtggacctgcaccccgctagcgcctggacactctacgctgttgccaccacagtgattacccctatgcttcgccataccatcgaaaattctacagctaacgtcagcctggccgcgattgccaaccaggctgtggtcctgatgggactcgacaaaggctggccgatctccaagatggatctgggggtgccccttctggccctcggatgctattctcaggttaatcctctgacgctgaccgctgccgtgctccttctgattacacactacgccatcatcggccccgggctgcaggcgaaagctaccagagaggcccaaaagcggacagctgccggaattatgaagaaccctaccgtcgacggcatcatgacgattgatctcgaccccgtgatctatgatagcaaattcgagaagcagctgggccaggttatgcttctggtgctctgtgccgtccagctgctgctcatgagaacatcctgggctctttgcgaggccctgaccctggcgaccgggcctattacaaccctctgggaaggatctccgggcaaattttggaatacaacgatcgccgtgagcatggctaacatcttccgcgggtcctacctggccggagctggccttgcctttagcattatgaagtctgtggggaccggaaaacggggcacaggctcccaaggggagaccctgggagaaaagtggaagaaaaagctcaatcagctgagcagaaaagagttcgacctgtataagaaatccggcatcacagaggttgatcgcaccgaagcgaaggaggggctcaaacggggagaaattacgcatcacgccgtctctagaggcagcgctaaacttcagtggtttgtggagcggaacatggtgatccccgaagggcgcgtcattgacctgggatgtggcagaggcgggtggtcctactattgcgccggactgaagaaagttaccgaggtgcggggctacacaaaagggggacctggccatgaggaacccgtgcctatgtctacctacgggtggaatatcgtcaaactcatgagcggaaaggatgtgttctatctgcccccggagaaatgtgacacacttctgtgcgatattggcgaatccagcccttctcccaccgttgaggagtcccgcacaatcagagtgctcaagatggtcgaaccctggctgaagaacaatcagttctgtatcaaagtgctgaacccttacatgcccaccgttgtggagcacctcgaacggcttcaacgcaagcacggcgggatgctggtcagaaatcctctgagccggaactctacgcatgagatgtattggatttccaatggaacaggcaacatcgtggctagcgtgaatatggtctctcgcctcctgcttaacagatttaccatgacccaccggagaccgacaattgaaaaagacgttgatctgggggccggaacgcgccatgtgaacgctgagcccgagacccctaatatggacgtgatcggcgaacggattaagagaatcaaagaggaacacaacagcacatggcactacgacgatgagaatccctataagacctgggcctaccatgggtcctatgaagtcaaggcgacaggatctgccagctccatgatcaacggcgtggttaaactcctgaccaagccttgggacgtggtccccatggtgacacagatggctatgaccgatacgaccccgttcggccagcaacgcgtttttaaagagaaggtggacacacggacccctagaagcatgcccgggacacgccgggtcatgggaattaccgccgagtggctgtggagaacgctcggccgcaataaaaagcctcggctgtgcacaagagaagagttcaccaagaaagtgcgcacaaacgctgccatgggggccgtttttaccgaagagaatcagtgggattccgcgaaggctgccgtggaagacgaggatttctggaaacttgtcgaccgggagagagaactgcacaagctcggaaaatgtggctcttgcgtgtacaacatgatggggaagcgcgagaaaaagctgggcgaatttggaaaggccaaaggcagcagagctatctggtacatgtggcttggggcccggtatctggagttcgaggctctcggatttctgaatgaagatcattggttctcccgcgagaactcttacagcggcgtcgaaggggagggactgcacaagctcggctatattctgagagacatctccaaaattcccgggggcgccatgtacgcggatgacacggccggatgggacacccggatcacagaagatgaccttcataatgaggagaagatcacccagcagatggatcctgaacacagacaactggctaacgccatttttaaactcacatatcagaataaggtggttaaggtgcagcggcccaccccgacaggcaccgtcatggacatcatttctcgcaaagatcagagagggagcggacaagtgggcacgtacgggctgaacacattcaccaatatggaggctcagcttatccggcagatggaaggagagggcgtgctgtccaaggccgacctcgaaaaccctcgcctgcccgagaaaaagattacccagtggctggagacaaaaggggttgaaagactcaagcggatggcgatcagcggcgatgactgcgtggtcaagcccatcgatgaccgctttgccaacgctctgcttgccctgaatgatatgggaaaagtgagaaaggacattcctcaatggcagccgtctaaaggctggcacgattggcagcaggttcccttctgttcccatcacttccatgagctcatcatgaaggacgggcggaaactggtggtcccttgccgcccccaagacgaacttattggacgggctcggatcagccagggcgccgggtggtctctgcgcgagaccgcttgtctcggaaaggcctatgcgcagatgtggtccctgatgtactttcacagacgggatctgcgcctcgccagcaacgctatttgctctgccgtgcctgtccactgggtgcccacatccagaacgacctggagcatccatgcccaccatcaatggatgacaaccgaagacatgctgacagtttggaatcgggtgtggattgaggataacccttggatggaggacaagacccccgtcacgacctgggaaaatgtgccgtaccttggcaaaagagaggatcagtggtgtgggtccctgatcggcctcacaagccgcgctacctgggcccagaacatccctacagcgattcagcaagttcggtctctgatcggaaatgaagagttccttgactatatgcccagcatgaagagatttcgcaaagaggaagagtccgaaggcgctatttggtga

SEQ ID NO: 20816 - RNA, 9873 nt, synthetic construct
  misc_feature 1..9873: note = derived and/or modified CDS sequence (opt5) from DENV-3__FJ898469__SS-prME
  source 1..9873: mol_type = other RNA
accagcctgtgcctcatgatgatcctgcccgccgctcttgccttccacctgacatcccgggacggcgagcctcggatgattgtggggaagaacgaacgcggaaagtctctcctgtttaagacggcgagcggcatcaatatgtgtacccttattgctatggatctgggggaaatgtgcgacgatacagtgacctacaagtgtccgcacatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggctagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacatcattggagtgctggagcagggcaaacggacgcttacccctcagcccatggagctgaagtactcttggaaaacatgggggaaggccaagatcgtcaccgccgaaacacaaaactccagcttcattatcgatggacctaatacccccgagtgcccgtctgcttccagagcgtggaacgtgtgggaagtggaggactatggctttggcgtcttcacaaccaatatctggctcaaactgcgcgaagtttacacgcagctgtgtgaccaccggcttatgagcgccgctgtgaaggatgagagagccgtgcacgccgacatggggtactggattgagtcccagaaaaacggatcttggaagctcgaaaaagctagcctgatcgaggtcaagacatgcacctggcctaagtcccataccctgtggtctaatggcgtgctcgaaagcgatatgattatccccaaatccctggccgggcctattagccagcacaactatcgccccggataccatacacaaaccgcgggcccttggcaccttgggaagctggagctcgactttaattattgcgagggaacgacagttgtgatcaccgaaaactgtggcacacggggcccctctctgagaaccacaaccgtctccgggaaactgatccacgagtggtgctgtcgcagctgcacgcttccgcctctccggtacatgggagaagatggctgttggtatgggatggagattagacccatctctgaaaaggaggagaatatggtgaaatccctggttagcgctggatctggcgaagtggacaacttcaccatgggggtcctgtgcctcgccattctgtttgaggaagtgatgcggggaaagttcggcaagaaacatatgatcgccggcgttttctttacattcgtgcttctgctcagcgggcagattacctggcgcgatatggctcacacactgatcatgattggatccaatgccagcgacagaatgggcatgggggtcacctacctggcgcttatcgctacgtttaagatccagcccttcctggccctcggatttttcctgcggaaactcacatctagagagaacctgcttctgggcgtggggctcgccatggctaccacactgcaactgcctgaagatattgagcagatggccaatggaatcgctcttggcctgatggccctcaagctgattacccagtttgagacctatcagctctggacagcgctgatctcccttacgtgtagcaacaccattttcacactgaccgtggcctggcgcacagctaccctcatcctggccggcgtctccctgcttccggtttgccaatctagctccatgcggaaaacggactggctgcccatgacagtggctgccatgggggtgcctcccctccctctgtttatcttctctctcaaggataccctgaagagacgcagctggccccttaatgaaggagtcatggccgtgggcctggtttccattctggcttctagcctcctgagaaacgacgtgcctatggcggggccccttgtcgccggaggcctgctcatcgcttgttacgtgattaccgggacatccgccgatctgaccgttgagaaagccgctgacgtgacatgggaagaggaagccgagcagacgggagtcagccataacctcatgatcaccgtggacgatgacggcacaatgcggattaaggatgacgagaccgaaaatatcctgacagtccttctgaaaaccgcgctgctcatcgtgtctggcatttttccgtactccatccctgctacgctgcttgtttggcacacctggcagaagcagacacaacgcagcggggtgctgtgggatgtcccctctcctcccgagacccagaaagccgaactcgaggagggagtgtatagaattaagcagcagggcatcttcgggaaaacacaagttggagtgggcgtccagaaggaaggggtgtttcataccatgtggcacgtgacacggggagccgttctgacgtacaacggcaagcgcctcgagccgaattgggcttccgtcaaaaaggacctgattagctatggcgggggatggagactttctgcccagtggcaaaaaggcgaagaggtccaggtgatcgcggtcgaacctgggaagaaccccaaaaatttccagaccatgcctggaacattccagaccaccacaggcgagattggggctatcgccctggattttaagcccggaacgtccggcagccccatcattaaccgggagggcaaggtggttgggctgtacggaaatggcgtggtcaccaaaaacgggggatatgtgtccggcatcgcccaaacaaatgctgaacctgacgggccgacccccgagctcgaagaggaaatgttcaagaaacgcaacctgacaattatggatcttcaccctggcagcggaaagaccagaaaatacctgcccgccatcgttcgggaggctattaagcgcagactccggacgctgatcctcgcccctacaagagtggtcgcggccgagatggaagaggctctgaagggccttcccatccgctatcagaccaccgccacaaaatctgaacataccgggcgggagattgtggacctgatgtgccacgctacatttaccatgagactgctcagccctgttcgcgtgccgaattacaacctgatcattatggatgaagcccatttcacggaccccgcctccatcgctgcgcggggatacatttctacaagagtcggcatgggggaggccgctgccatctttatgaccgccacacctcccggaaccgctgatgccttccctcagagcaatgcgcccatccaggacgaggaacgcgacattccggagcggtcctggaactctggcaatgaatggatcacggattttgctgggaagaccgtgtggttcgtgcctagcattaaagccggcaacgacatcgccaactgtcttagaaagaatggcaaaaaggtcattcaactgtcccgcaagacatttgataccgagtatcagaaaacaaagctcaacgactgggatttcgttgtgaccacagacatctctgagatgggagctaattttaaagccgatcgggtgattgaccccagacggtgcctgaagcccgtcatcctgaccgatgggcctgaacgcgtgatcctcgcgggacccatgcctgttacggccgctagcgccgctcagagacggggccgcgtggggagaaacccgcagaaagagaatgaccaatacattttcacaggacagccccttaacaatgatgaagaccacgcccattggaccgaggctaagatgctgctggacaacatcaatacccctgaaggcattatccccgccctcttcgagcctgagcgggaaaagtccgcggccattgatggggagtatagactgaaaggcgaaagccgcaagacatttgtcgagcttatgcggagaggagacctgcccgtgtggctcgctcacaaagttgcctctgaaggcatcaagtacaccgatcgcaaatggtgcttcgacgggcagcggaacaatcagatcctggaggagaacatggatgtggaaatttggacaaaggagggagagaagaagaagctgagaccgcgctggctcgacgctcggacgtattccgatcctcttgccctgaaagagtttaaggacttcgccgctggcagaaaaagcatcgcgctggatctcgtcaccgaaattgggcgcgtgcccacacacctggcccatagaacccggaatgctcttgacaacctggtcatgctccacacatctgagcatggaggcaaggcctaccgccacgccgtggaggaactgcctgagaccatggaaacgctgctccttctgggcctgatgatcctcctgaccgggggagctatgctttttctgatttccggcaaagggatcggaaagacaagcatcggcctcatttgtgttatcgcctcctctgggatgctgtggatggcggagattcccctgcaatggatcgccagcgctattgtgctcgagttctttatgatggtgcttctgatccctgaacccgagaagcagagaaccccgcaggataatcaactggcctatgtcgttattggaatcctcacactggctgccatcattgcggccaacgaaatgggccttctggagaccacgaaacgggacctcggcatgtccaaggaacctggggtggtgagccccacatcttacctggatgtcgacctgcaccccgcttccgcctggaccctctacgctgtggccacaaccgttatcacccctatgcttcgccatacaattgagaatagcacggctaacgtgtctctggccgcgatcgccaaccaggctgtcgtgctgatgggactcgacaaaggctggccgattagcaagatggatctgggggtcccccttctggccctcggatgctattcccaggtgaatcctctgaccctgacagctgccgttctccttctgatcacccactacgccatcattggccccgggctgcaggcgaaagctacaagagaggcccaaaagcggaccgctgccggaatcatgaagaaccctacggtggacggcattatgacaatcgatctcgaccccgtcatttatgattctaaattcgaaaagcagctgggccaggtgatgcttctggttctctgtgccgtgcagctgctgctcatgagaaccagctgggctctttgcgaggccctgaccctggcgacagggcctatcaccacactctgggaaggatccccgggcaaattttggaatacgaccatcgccgtctctatggctaacattttccgcgggagctacctggccggagctggccttgccttttccatcatgaaaagcgtggggacaggaaaacggggcaccggcctgcaaggggagacactcggagaaaagtggaagaaaaagctgaatcagctgtctagaaaagagttcgacctctataagaaatccggcattaccgaggtggatcgcacggaagcgaaggaggggcttaaacggggagaaatcacccatcacgccgttagcagaggctccgctaagctgcagtggtttgtcgagcggaacatggtgattcccgaagggcgcgtgatcgacctgggatgtggcagaggcgggtggtcttactattgcgccggactcaagaaagtcacagaggttcggggctacaccaaagggggacctggccatgaggaacccgtgcctatgagcacatacgggtggaatattgtgaaactgatgtccggaaaggatgtcttctatcttcccccggagaaatgtgacaccctgctctgcgatatcggcgaatctagcccttcccccacagtggaggagagccgcaccatcagagttctgaagatggtggaaccctggctgaagaacaatcagttctgtattaaagtcctcaacccttacatgcccacggtgatcgagcaccttgaacggctgcaacgcaagcacggcgggatgctggttagaaatcctctctctcggaactccacacatgagatgtattggattagcaatggaaccggcaacatcgtggcttctgtcaatatggtgtcccgcctgcttctgaacagatttaccatgacacaccggagaccgacgattgaaaaagacgtggatctcggggccggaacccgccatgtcaacgctgagcccgagacacctaatatggacgttatcggcgaacggatcaagagaattaaagaggaacacaacagcacctggcactacgacgatgagaatccctataagacatgggcctaccatgggtcttatgaagtgaaggcgaccggaagcgcctcctctatgatcaacggcgtggtcaaactgctgacaaagccttgggacgtggttcccatggtgacccagatggctatgacggataccacaccgttcggccagcaacgcgtctttaaagagaaggtggacacccggacacctagaagcatgcccgggacccgccgggttatgggaattacggccgagtggctctggagaacactgggccgcaataaaaagcctcggctttgcaccagagaagagttcacaaagaaagtgcgcaccaacgctgccatgggggccgtctttacggaagagaatcagtgggattccgcgaaggctgccgtggaagacgaggatttctggaaactggttgaccgggagagagaactccacaagctgggaaaatgtggcagctgcgtgtacaacatgatggggaagcgcgagaagaaacttggcgaatttggaaaagccaaaggctccagagctatctggtacatgtggctgggggcccggtatctcgagttcgaggctctgggatttctgaatgaagatcattggttctctcgcgagaacagctactccggcgtcgaaggggagggactccacaagctgggctatattcttagagacatctctaaaatccccgggggcgccatgtacgcggatgacaccgccggatgggacacacggattaccgaagatgacctgcataatgaggagaagatcacacagcagatggatcctgaacacagacaactcgctaacgccatttttaaactgacctatcagaataaggtggtcaaggtgcagcggcccacaccgaccggcacggttatggacatcattagccgcaaagatcagagagggtccggacaagtgggcacatacgggcttaacaccttcaccaatatggaggctcagctgatccggcagatggaaggagagggcgtcctctctaaggccgacctggaaaaccctcatctgcccgagaaaaagatcacacagtggctcgagaccaaaggggtggaacgcctgaagagaatggcgattagcggcgatgactgcgtggttaagcccatcgatgaccggtttgccaacgcccttctggccctcaatgatatgggaaaagtgcgcaaggacattcctcaatggcagccgtccaaaggctggcatgattggcagcaggtccccttctgtagccaccatttccacgagctgatcatgaaggacgggagaaaacttgtggttccttgccggccccaagacgaactgattggacgcgctagaatctctcagggcgccgggtggtccctccgggagacagcttgtctgggaaaggcctatgcgcagatgtggagcctgatgtactttcaccgcagagatctccggctggcctctaacgctatttgctccgccgtgcctgtccattgggtgcccacgagccgcaccacatggtctatccacgcccatcaccaatggatgaccacagaagacatgcttaccgtctggaatagagtgtggatcgaggataacccttggatggaggacaagacgcccgttaccacatgggaaaatgtgccgtacctgggcaaacgggaggatcagtggtgtgggtccctcattggcctgaccagcagagctacatgggcccagaacatccctaccgcgattcagcaagtccgctcccttatcggaaatgaagagttcctggactatatgcccagcatgaagcggtttagaaaagaggaagagtctgaaggcgctatttggtga

SEQ ID NO: 20817 - RNA, 9873 nt, synthetic construct
  misc_feature 1..9873: note = derived and/or modified CDS sequence (opt5) from DENV-3__FJ898470__SS-prME
  source 1..9873: mol_type = other RNA
accagcctgtgcctcatgatgatcctgcccgccgctcttgccttccacctgacatcccgggacggcgagcctcggatgattgtggggaagaacgaacgcggaaagtctctcctgtttaagacggcgagcggcatcaatatgtgtacccttattgctatggatctgggggaaatgtgcgacgatacagtgacctacaagtgtccgcacatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacatcattggagtgctggagcagggcaaacggacgcttacccctcagcccatggagctgaagtactcttggaaaacatgggggaaggccaagatcgtcaccgccgaaacacaaaactccagcttcattatcgatggacctaatacccccgagtgcccgtctgcttccagagcgtggaacgtgtgggaagtggaggactatggctttggcgtcttcacaaccaatatctggctcaaactgcgcgaagtttacacgcagctgtgtgaccaccggcttatgagcgccgctgtgaaggatgagagagccgtgcacgccgacatggggtactggattgagtcccagaaaaacggatcttggaagctcgaaaaagctagcctgatcgaggtcaagacatgcacctggcctaagtcccataccctgtggtctaatggcgtgctcgaaagcgatatgattatccccaaatccctggccgggcctattagccagcacaactatcgccccggataccatacacaaaccgcgggcccttggcaccttgggaagctggagctcgactttaattattgcgagggaacgacagttgtgatcaccgaaaactgtggcacacggggcccctctctgagaaccacaaccgtctccgggaaactgatccacgagtggtgctgtcgcagctgcacgcttccgcctctccggtacatgggagaagatggctgttggtatgggatggagattagacccatctctgaaaaggaggagaatatggtgaaatccctggttagcgctggatctggcgaagtggacaacttcaccatgggggtcctgtgcctcgccattctgtttgaggaagtgatgcggggaaagttcggcaagaaacatatgatcgccggcgttttctttacattcgtgcttctgctcagcgggcagattacctggcgcgatatggctcacacactgatcatgattggatccaatgccagcgacagaatgggcatgggggtcacctacctggcgcttatcgctacgtttaagatccagcccttcctggccctcggatttttcctgcggaaactcacatctagagagaacctgcttctgggcgtggggctcgccatggctaccacactgcaactgcctgaagatattgagcagatggccaatggaatcgctcttggcctgatggccctcaagctgattacccagtttgagacctatcagctctggacagcgctgatctcccttacgtgtagcaacaccattttcacactgaccgtggcctggcgcacagctaccctcatcctggccggcgtctccctgcttccggtttgccaatctagctccatgcggaaaacggactggctgcccatgacagtggctgccatgggggtgcctcccctccctctgtttatcttctctctcaaggataccctgaagagacgcagctggccccttaatgaaggagtcatggccgtgggcctggtttccattctggcttctagcctcctgagaaacgacgtgcctatggcggggccccttgtcgccggaggcctgctcatcgcttgttacgtgattaccgggacatccgccgatctgaccgttgagaaagccgctgacgtgacatgggaagaggaagccgagcagacgggagtcagccataacctcatgatcaccgtggacgatgacggcacaatgcggattaaggatgacgagaccgaaaatatcctgacagtccttctgaaaaccgcgctgctcatcgtgtctggcatttttccgtactccatccctgctacgctgcttgtttggcacacctggcagaagcagacacaacgcagcggggtgctgtgggatgtcccctctcctcccgagacccagaaagccgaactcgaggagggagtgtatagaattaagcagcagggcatcttcgggaaaacacaagttggagtgggcgtccagaaggaaggggtgtttcataccatgtggcacgtgacacggggagccgttctgacgtacaacggcaagcgcctcgagccgaattgggcttccgtcaaaaaggacctgattagctatggcgggggatggagactttctgcccagtggcaaaaaggcgaagaggtccaggtgatcgcggtcgaacctgggaagaaccccaaaaatttccagaccatgcctggaacattccagaccaccacaggcgagattggggctatcgccctggattttaagcccggaacgtccggcagccccatcattaaccgggagggcaaggtggttgggctgtacggaaatggcgtggtcaccaaaaacgggggatatgtgtccggcatcgcccaaacaaatgctgaacctgacgggccgacccccgagctcgaagaggaaatgttcaagaaacgcaacctgacaattatggatcttcaccctggcagcggaaagaccagaaaatacctgcccgccatcgttcgggaggctattaagcgcagactccggacgctgatcctcgcccctacaagagtggtcgcggccgagatggaagaggctctgaagggccttcccatccgctatcagaccaccgccacaaaatctgaacataccgggcgggagattgtggacctgatgtgccacgctacatttaccatgagactgctcagccctgttcgcgtgccgaattacaacctgatcattatggatgaagcccatttcacggaccccgcctccatcgctgcgcggggatacatttctacaagagtcggcatgggggaggccgctgccatctttatgaccgccacacctcccggaaccgctgatgccttccctcagagcaatgcgcccatccaggacgaggaacgcgacattccggagcggtcctggaactctggcaatgaatggatcacggattttgctgggaagaccgtgtggttcgtgcctagcattaaagccggcaacgacatcgccaactgtcttagaaagaatggcaaaaaggtcattcaactgtcccgcaagacatttgataccgagtatcagaaaacaaagctcaacgactgggatttcgttgtgaccacagacatctctgagatgggagctaattttaaagccgatcgggtgattgaccccagacggtgcctgaagcccgtcatcctgaccgatgggcctgaacgcgtgatcctcgcgggacccatgcctgttacggccgctagcgccgctcagagacggggccgcgtggggagaaacccgcagaaagagaatgaccaatacattttcacaggacagccccttaacaatgatgaagaccacgcccattggaccgaggctaagatgctgctggacaacatcaatacccctgaaggcattatccccgccctcttcgagcctgagcgggaaaagtccgcggccattgatggggagtatagactgaaaggcgaaagccgcaagacatttgtcgagcttatgcggagaggagacctgcccgtgtggctcgctcacaaagttgcctctgaaggcatcaagtacaccgatcgcaaatggtgcttcgacgggcagcggaacaatcagatcctggaggagaacatggatgtggaaatttggacaaaggagggagagaagaagaagctgagaccgcgctggctcgacgctcggacgtattccgatcctcttgccctgaaagagtttaaggacttcgccgctggcagaaaaagcatcgcgctggatctcgtcaccgaaattgggcgcgtgcccacacacctggcccatagaacccggaatgctcttgacaacctggtcatgctccacacatctgagcatggaggcaaggcctaccgccacgccgtggaggaactgcctgagaccatggaaacgctgctccttctgggcctgatgatcctcctgaccgggggagctatgctttttctgatttccggcaaagggatcggaaagacaagcatcggcctcatttgtgttatcgcctcctctgggatgctgtggatggcggagattcccctgcaatggatcgccagcgctattgtgctcgagttctttatgatggtgcttctgatccctgaacccgagaagcagagaaccccgcaggataatcaactggcctatgtcgttattggaatcctcacactggctgccatcattgcggccaacgaaatgggccttctggagaccacgaaacgggacctcggcatgtccaaggaacctggggtggtgagccccacatcttacctggatgtcgacctgcaccccgcttccgcctggaccctctacgctgtggccacaaccgttatcacccctatgcttcgccatacaattgagaatagcacggctaacgtgtctctggccgcgatcgccaaccaggctgtcgtgctgatgggactcgacaaaggctggccgattagcaagatggatctgggggtcccccttctggccctcggatgctattcccaggtgaatcctctgaccctgacagctgccgttctccttctgatcacccactacgccatcattggccccgggctgcaggcgaaagctacaagagaggcccaaaagcggaccgctgccggaatcatgaagaaccctacggtggacggcattatgacaatcgatctcgaccccgtcatttatgattctaaattcgaaaagcagctgggccaggtgatgcttctggttctctgtgccgtgcagctgctgctcatgagaaccagctgggctctttgcgaggccctgaccctggcgacagggcctatcaccacactctgggaaggatccccgggcaaattttggaatacgaccatcgccgtctctatggctaacattttccgcgggagctacctggccggagctggccttgccttttccatcatgaaaagcgtggggacaggaaaacggggcaccggctctcaaggggagacactgggagaaaagtggaagaaaaagctcaatcagctgtccagaaaagagttcgacctgtataagaaaagcggcattaccgaggtggatcgcacggaagcgaaggaggggctcaaacggggagaaatcacccatcacgccgtttccagaggctctgctaaacttcagtggtttgtcgagcggaacatggtgattcccgaagggcgcgtgatcgacctgggatgtggcagaggcgggtggagctactattgcgccggactgaagaaagtcacagaggttcggggctacaccaaagggggacctggccatgaggaacccgtgcctatgtccacatacgggtggaatattgtgaaactcatgtctggaaaggatgtcttctatctgcccccggagaaatgtgacacccttctgtgcgatatcggcgaaagctcccctagccccacagtggaggagtctcgcaccatcagagttctcaagatggtggaaccctggctgaagaacaatcagttctgtattaaagtcctgaacccttacatgcccacggtgatcgagcacctcgaacggcttcaacgcaagcacggcgggatgctggttagaaatcctctgtcccggaacagcacacatgagatgtattggatttctaatggaaccggcaacatcgtggcttccgtcaatatggtgagccgcctcctgcttaacagatttaccatgacacaccggagaccgacgattgaaaaagacgtggatctgggggccggaacccgccatgtcaacgctgagcccgagacacctaatatggacgttatcggcgaacggatcaagagaattaaagaggaacacaactctacctggcactacgacgatgagaatccctataagacatgggcctaccatgggagctatgaagtgaaggcgaccggatccgcctctagcatgatcaacggcgtggtcaaactcctgacaaagccttgggacgtggttcccatggtgacccagatggctatgacggataccacaccgttcggccagcaacgcgtctttaaagagaaggtggacacccggacacctagatccatgcccgggacccgccgggttatgggaattacggccgagtggctgtggagaacactcggccgcaataaaaagcctcggctgtgcaccagagaagagttcacaaagaaagtgcgcaccaacgctgccatgggggccgtctttacggaagagaatcagtgggatagcgcgaaggctgccgtggaagacgaggatttctggaaacttgttgaccgggagagagaactgcacaagctcggaaaatgtggctcctgcgtgtacaacatgatggggaagcgcgagaaaaagctgggcgaatttggaaaggccaaaggctctagagctatctggtacatgtggcttggggcccggtatctggagttcgaggctctcggatttctgaatgaagatcattggttcagccgcgagaactcctactctggcgtcgaaggggagggactgcacaagctcggctatattctgagagacatcagcaaaatccccgggggcgccatgtacgcggatgacaccgccggatgggacacacggattaccgaagatgaccttcataatgaggagaagatcacacagcagatggatcctgaacacagacaactggctaacgccatttttaaactcacctatcagaataaggtggtcaaggtgcagcggcccacaccggctggcaccgttatggacatcatttcccgcaaagatcagagagggtctggacaagtgggcacgtacgggctgaacacattcaccaatatggaggcccagcttatccggcagatggaaggagagggcgtcctgagcaaggcggacctcgaaaaccctcatctgcccgagaaaaagatcacccagtggctggagacaaaaggggtggaacgcctcaagagaatggccatttccggcgatgactgcgtggttaagcccatcgatgaccggtttgctaacgccctgcttgctctgaatgatatgggaaaagtgcgcaaggacattcctcaatggcagccgagcaaaggctggcatgattggcagcaggtccccttctgttctcaccatttccacgagctcatcatgaaggacgggagaaaactggtggttccttgccggccccaagacgaacttattggacgcgccagaatctcccagggcgctgggtggagcctgcgggagaccgcctgtctcggaaaggcgtatgcccagatgtggtctctgatgtactttcaccgcagagatctgcggctcgcttccaacgccatttgcagcgccgtgcctgtccattgggtgcccacatctcgcacgacctggtccatccacgctcatcaccaatggatgacaaccgaagacatgctgacagtctggaatagagtgtggatcgaggataacccttggatggaggacaagacccccgttacgacctgggaaaatgtgccgtaccttggcaaacgggaggatcagtggtgtgggagcctgattggcctcacatccagagccacctgggcgcagaacatccctacagctattcagcaagtccgcagcctgatcggaaatgaagagttccttgactatatgccctctatgaagcggtttagaaaagaggaagagagcgaaggcgccatttggtga

SEQ ID NO: 20818 - RNA, 9873 nt, synthetic construct
  misc_feature 1..9873: note = derived and/or modified CDS sequence (opt5) from DENV-3__FJ898471__SS-prME
  source 1..9873: mol_type = other RNA
acaagcctgtgcctcatgatgatcctgcccgccgctcttgccttccacctgacatcccgggacggcgaacctcggatgattgtggggaagaacgaacgcggaaaatctctcctgtttaagacggcgagcggcatcaatatgtgtacccttattgctatggatctgggggagatgtgcgacgatacagtcacctacaaatgtccgcacatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcattcagaaggtggtcatcttcattctgcttatgctggtgacaccttctatgaccatgagatgtgttggagtgggcaaccgggactttgtcgaagggctcagcggagctacatgggtggatgtggtcctggagcacggcgggtgcgttaccaccatggccaagaataaacccacactggacatcgagctccagaagacggaagctacccaactggccacacttcgcaaactgtgtattgagggaaagatcaccaacattacaaccgattccagatgccctacgcagggcgaagcggtgctcccggaggaacaggaccagaattatgtgtgtaaacacacatacgtcgatcggggctgggggaacggatgcggcctgttcgggaagggaagccttgtgacctgcgccaagtttcaatgtctggagcccatcgagggcaaagttgtgcagtatgaaaatctcaagtacaccgtcatcattacagtgcataccggggaccagcaccaggttggaaacgagacacaaggcgtgacggctgaaatcacccctcaggcctctacaaccgaggctattctgcccgaatatggcacactggggctcgagtgctcccctcgcaccggactggacttcaatgagatgatccttctgacgatgaaaaacaaggcctggatggtccatagacagtggtttttcgatctccccctgccgtggaccagcggcgccacaaccgaaacacctacctggaatcggaaagagcttctggtgacgtttaagaacgctcacgcgaaaaagcaagaagtcgtggttctcgggtctcaggagggagccatgcacacagctctgaccggcgccacagaaattcaaaattccgggggcaccagcatcttcgccggacatctgaagtgtcgcctcaaaatggacaagctggagcttaaaggcatgtcttacgctatgtgcaccaacacatttgtgctgaagaaagaggtctccgaaacgcagcacgggaccatcctcattaaggtggagtacaagggagaagatgttccctgtaaaatccctttcagcacagaggacggccaagggaaggcccataacggaagactgattaccgcgaatcccgtggtcaccaagaaggaggaacccgtgaacatcgaggctgaacctccgttcggcgagtccaatattgtgatcgggatcggcgataacgccctgaaaattaattggtataagaagggatctagcatcggcaaaatgtttgaagccaccgctagaggggccagacgcatggctattcttggagacacggcctgggatttcggctccgttgggggagtcctcaacagcctgggcaagatggtgcaccagatctttgggtctgcgtacacagccctgttctccggcgtgagctgggtcatgaaaattggaatcggcgtgctcctgacctggattgggcttaattctaagaacaccagcatgtccttttcttgcatcgttatcggaattatcacactgtatctcggcgctgtggtccaggccgacatggggtgtgtgattaattggaaaggaaaggagctgaagtgcggcagcgggatcttcgttaccaacgaggtgcatacatggacggaacagtacaaatttcaagctgattcccccaagcggctggccaccgcgattgccggcgcttgggagaatggagtctgtggcatcagaagcacaacccgcatggaaaaccttctctggaaacagatcgccaatgagctgaactatattctgtgggaaaataacatcaagctcacagtggttgtgggggacattatcggagtcctggagcagggcaaacggacccttacgcctcagcccatggagctgaagtactcttggaaaacctgggggaaggctaagattgtgacagccgaaacccaaaactccagcttcatcatcgatggacctaatacacccgagtgcccgtctgcctccagagcttggaacgtgtgggaagtcgaggactatggctttggcgttttcaccacaaatatttggctcaaactgcgcgaagtgtacacccagctgtgtgaccaccggcttatgagcgcggccgtgaaggatgagagagctgtccacgccgacatggggtactggatcgagtcccagaaaaacggatcttggaagctcgaaaaagccagcctgattgaggtgaagacgtgcacatggcctaagtcccataccctgtggtctaatggcgttctcgaaagcgatatgatcattcccaaatccctggctgggcctatcagccagcacaactatcgccccggataccatacccaaacagccggcccttggcaccttgggaagctggagctcgactttaattattgcgagggaaccacggtggtcatcacagaaaactgtggcacccggggcccctctctgagaacaaccacagtgtccgggaaactgattcacgagtggtgctgtcgcagctgcacccttccgcctctccggtacatgggagaagatggctgttggtatgggatggagatcagacccatttctgaaaaggaggagaatatggttaaatccctggtgagcgcgggatctggcgaagtcgacaacttcacgatgggggtgctgtgcctcgctatcctgtttgaggaagttatgcggggaaagttcggcaagaaacatatgattgccggcgtgttctttaccttcgtccttctgctcagcgggcagatcacatggcgcgatatggcccacaccctgattatgatcggatccaatgctagcgacagaatgggcatgggggtgacatacctggcccttatcgcgacctttaagattcagcccttcctggctctcggatttttcctgcggaaactcacgtctagagagaacctgcttctgggcgtggggctcgccatggccacaaccctgcaactgcctgaagatatcgagcagatggctaatggaattgcccttggcctgatggctctcaagctgatcacacagtttgagacctatcagctctggaccgccctggtctcccttacatgtagcaacacgattttcaccctgacagttgcgtggcgcaccgccacactcatcctggctggcgtgtccctgcttccggtgtgccaatctagctccatgcggaaaaccgactggctgcccatgacggtcgccgctatgggggtgcctcccctccctctgtttatcttctctctcaaggatacactgaagagacgcagctggccccttaatgaaggagttatggccgtgggcctggtctccattctggcctctagcctcctgagaaacgacgtgcctatggctgggccccttgttgcgggaggcctgctcatcgcctgttacgtgattaccgggacctccgctgatctgacagtcgagaaagccgccgacgtgacctgggaagaggaagctgagcagacaggagtcagccataacctcatgatcacggtggacgatgacggcaccatgcggattaaggatgacgagacagaaaatatcctgaccgttcttctgaaaacagccctgctcatcgtgtctggcatttttccgtactccatccctgcgaccctgcttgtctggcacacgtggcagaagcagacccaacgcagcggggtgctgtgggatgttccctctcctcccgagacacagaaagctgaactcgaggagggagtgtatagaattaagcagcagggcatcttcgggaaaacccaagtcggagtgggcgtgcagaaggaaggggtttttcatacaatgtggcacgtcacccggggagccgtgctgacatacaacggcaagcgcctcgagccgaattgggcctccgtgaaaaaggacctgattagctatggcgggggatggagactttctgctcagtggcaaaaaggcgaagaggtccaggtgatcgccgttgaacctgggaagaaccccaaaaatttccagacgatgcctggaaccttccagacaaccaccggcgagattggggcgatcgctctggattttaagcccggaacatccggcagccccatcattaaccgggagggcaaggtggtcgggctgtacggaaatggcgtggttacgaaaaacgggggatatgtgtccggcatcgcccaaaccaatgccgaacctgacgggccgacacccgagctcgaagaggaaatgttcaagaaacgcaacctgaccattatggatcttcaccctggcagcggaaagacaagaaaatacctgcccgctatcgtccgggaggccattaagcgcagactccggaccctgatcctcgctcctacgagagtggttgccgcggagatggaagaggccctgaagggccttcccatccgctatcagacaaccgctaccaaatctgaacatacagggcgggagattgtggacctgatgtgccacgccacctttacaatgagactgctcagccctgtccgcgtgccgaattacaacctgatcattatggatgaagctcatttcaccgaccccgcctccatcgccgctcggggatacatttctacgagagtgggcatgggggaggcggccgctatctttatgacagccacccctcccggaacagccgatgctttccctcagagcaatgcccccatccaggacgaggaacgcgacattccggagcggtcctggaactctggcaatgaatggatcaccgattttgcggggaagacggtctggttcgttcctagcattaaagctggcaacgacatcgccaactgtcttagaaagaatggcaaaaaggtgattcaactgtcccgcaagacctttgatacagagtatcagaaaaccaagctcaacgactgggatttcgtggtcacaaccgacatctctgagatgggagccaattttaaagctgatcgggtgattgaccccagacggtgcctgaagcccgttatcctgacagatgggcctgaacgcgtgatcctcgccggacccatgcctgtcaccgcggccagcgctgcccagagacggggccgcgtggggagaaacccgcagaaagagaatgaccaatacattttcacgggacagccccttaacaatgatgaagaccacgctcattggacagaggccaagatgctgctggacaacatcaatacccctgaaggcattatccccgctctcttcgagcctgagcgggaaaagtccgccgcgattgatggggagtatagactgaaaggcgaaagccgcaagacctttgttgagcttatgcggagaggagacctgcccgtgtggctcgcctacaaagtcgcttctgaaggcatcaagtatacagatcgcaaatggtgcttcgacgggcagcggaacaatcagatcctggaggagaacatggatgtggaaatttggaccaaggagggagagaagaagaagctgagaccgcgctggctcgacgcccggacatactccgatcctcttgctctgaaagagtttaaggacttcgccgccggcagaaaaagcatcgctctggatctcgtcacggaaattgggcgcgtgccctctcacctggcgcacagaacccggaatgcccttgacaacctggttatgctccatacatccgagcacggaggcaaggcttatcgccatgccgtggaggaactgcctgagaccatggaaacactgctccttctgggcctgatgatcctcctgaccgggggagccatgctttttctgattagcggcaaagggatcggaaagacgtccatcggcctcatttgtgtgatcgcttctagcgggatgctgtggatggccgagattcccctgcaatggatcgcgtccgccattgtcctcgagttctttatgatggttcttctgatccctgaacccgagaagcagagaaccccgcaggataatcaactggcttacgtggtgattggaatcctcacactggccgctatcattgccgcgaacgaaatgggccttctggagaccacaaaacgggacctcggcatgagcaaggaacctggggtcgtgtctcccacctcctacctggatgttgacctgcaccccgccagcgcttggacgctctatgccgtggctacaaccgtcatcacacctatgcttcgccacaccattgaaaattctaccgccaacgtgagcctggctgccatcgcgaaccaggccgtcgtgctgatgggactcgacaaaggctggccgatttccaagatggatctgggggttccccttctggctctcggatgctactctcaggtgaatcctctgacactgacggccgctgtcctccttctgatcacccattatgccatcattggccccgggctgcaggccaaagcgacaagagaggctcaaaagcggaccgccgctggaatcatgaagaaccctacagtggacggcattatgaccatcgatctcgaccccgttatttacgatagcaaattcgagaagcagctgggccaggtgatgcttctggtcctctgtgccgtgcagctgctgctcatgagaacgtcctgggccctttgcgaggctctgacactggccaccgggcctatcaccacactctgggaaggatctccgggcaaattttggaataccacaatcgcggtgagcatggccaacattttccgcgggtcctatctggctggagccggccttgcttttagcatcatgaagtctgttgggacgggaaaacggggcaccggctcccaaggggagacactgggagaaaagtggaagaaaaagctcaatcagctgagcagaaaagagttcgacctgtacaagaaatccggcattaccgaggtcgatcgcacagaagccaaggaggggctcaaacggggagaaatcacccaccatgcggtgtctagaggcagcgccaaacttcagtggtttgtggagcggaacatggtcattcccgaagggcgcgttatcgacctgggatgtggcagaggcgggtggtcctattactgcgctggactgaagaaagtgacggaggtgcggggctacaccaaagggggacctggccacgaggaacccgtccctatgtctacatatgggtggaatattgtgaaactcatgagcggaaaggatgttttctacctgcccccggagaaatgtgacacccttctgtgcgatatcggcgaatccagcccttctcccacagtggaggagtcccgcaccatcagagtcctcaagatggtggaaccctggctgaagaacaatcagttctgtattaaagttctgaacccttatatgcccacagtgatcgagcatctcgaacggcttcaacgcaagcacggcgggatgctggtcagaaatcctctgagccggaactctacccacgagatgtactggatttccaatggaacgggcaacatcgtggccagcgtgaatatggtctctcgcctcctgcttaacagatttacaatgacccatcggagaccgaccattgaaaaagacgttgatctgggggctggaacacgccacgtgaacgccgagcccgagacgcctaatatggacgtgatcggcgaacggatcaagagaattaaagaggaacataacagcacctggcactatgacgatgagaatccctacaagacatgggcttatcacgggtcctacgaagtcaaggccaccggatctgcgagctccatgatcaacggcgtggttaaactcctgacaaagccttgggacgtggtccccatggtgacccagatggccatgacagataccacgccgttcggccagcaacgcgtttttaaagagaaggtggacacccggacacctagaagcatgcccgggacccgccgggtcatgggaattacagctgagtggctgtggagaaccctcggccgcaataaaaagcctcggctgtgcacgagagaagagttcacaaagaaagtgcgcaccaacgccgctatgggggccgtttttacagaagagaatcagtgggattccgccaaggcggctgtggaagacgaggatttctggaaacttgtcgaccgggagagagaactgcataagctcggaaaatgtggctcttgcgtgtacaacatgatggggaagcgcgagaaaaagctgggcgaatttggaaaggccaaaggcagcagagccatctggtatatgtggcttggggctcggtacctggagttcgaggccctcggatttctgaatgaagatcactggttctcccgcgagaactcttatagcggcgtcgaaggggagggactgcataagctcggctacattctgagagacatctccaaaatccccgggggcgctatgtatgccgatgacaccgcgggatgggacacgcggattaccgaagatgaccttcacaatgaggagaagatcacacagcagatggatcctgaacatagacaactggccaacgctatttttaaactcacctaccagaataaggtggttaaggtgcagcggcccacaccgaccggcacagtcatggacatcatttctcgcaaagatcagagagggagcggacaagtgggcacctatgggctgaacacgttcacaaatatggaggcccagcttatccggcagatggaaggagagggcgtgctgtccaaggctgacctcgaaaaccctcatctgcccgagaaaaagatcacccagtggctggagaccaaaggggttgaacgcctcaagagaatggccattagcggcgatgactgcgtggtcaagcccatcgatgaccggtttgcgaacgccctgcttgctctgaatgatatgggaaaagtgcgcaaggacattcctcaatggcagccgtctaaaggctggcacgattggcagcaggttcccttctgttcccatcacttccatgagctcatcatgaaggacgggagaaaactggtggtcccttgccggccccaagacgaacttattggacgcgccagaatcagccagggcgctgggtggtctctgcgggagacagcctgtctcggaaaggcttacgcccagatgtggtccctgatgtactttcaccgcagagatctgcggctcgcgagcaacgccatttgctctgctgtgcctgtccactgggtgcccacctcccgcacaacgtggagcatccatgcccaccatcaatggatgaccacagaagacatgctgaccgtttggaatagagtgtggatcgaggataacccttggatggaggacaagacacccgtcaccacgtgggaaaatgtgccgtatcttggcaaacgggaggatcagtggtgtgggtccctgattggcctcaccagcagagccacatgggctcagaacatccctaccgccattcagcaagttcgctctctgatcggaaatgaagagttccttgactacatgcccagcatgaagcggtttagaaaagaggaagagtccgaaggcgcgatttggtga

SEQ ID NO: 20819 - RNA, 9873 nt, synthetic construct
  misc_feature 1..9873: note = derived and/or modified CDS sequence (opt5) from DENV-3__FJ898472__SS-prME
  source 1..9873: mol_type = other RNA
accagcctgtgcctcatgatgatcctgcccgccgctcttgccttccacctgacatcccgggacggcgaacctcggatgattgtggggaagaatgaacgcggaaagtctctcctgtttaagacggcgagcggcatcaatatgtgtacccttattgctatggatctgggggaaatgtgcgacgatacagtgacctacaaatgtccgcacatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggatacccggacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggctagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacatcattggagtgctggagcagggcaaacggacgcttacccctcagcccatggagctgaagtactcttggaaaacatgggggaaggccaagatcgtcaccgccgaaacacaaaactccagcttcattatcgatggacctaatacccccgagtgcccgtctgcttccagagcgtggaacgtgtgggaagtggaggactatggctttggcgtcttcacaaccaatatctggctcaaactgcgcgaagtttacacgcagctgtgtgaccaccggcttatgagcgccgctgtgaaggatgagagagccgtgcacgccgacatggggtactggattgagtcccagaaaaacggatcttggaagctcgaaaaagctagcctgatcgaggtcaagacatgcacctggcctaagtcccataccctgtggtctaatggcgtgctcgaaagcgatatgattatccccaaatccctggccgggcctattagccagcacaactatcgccccggataccatacacaaaccgcgggcccttggcaccttgggaagctggagctcgactttaattattgcgagggaacgacagttgtgatcaccgaaaactgtggcacacggggcccctctctgagaaccacaaccgtctccgggaaactgatccacgagtggtgctgtcgcagctgcacgcttccgcctctccggtacatgggagaagatggctgttggtatgggatggagattagacccatctctgaaaaggaggagaatatggtgaaatccctggttagcgctggatctggcgaagtggacaacttcaccatgggggtcctgtgcctcgccattctgtttgaggaagtgatgcggggaaagttcggcaagaaacatatgatcgccggcgttttccttacatttgtgctgctcctgagcgggcagattacctggcgcgatatggctcacacactgatcatgattggatccaatgccagcgacagaatgggcatgggggtcacctaccttgcgctgatcgctacgttcaagatccagccctttctcgccctgggattctttctccggaaactgacatctagagagaaccttctgctcggcgtggggctggccatggctaccacactgcaacttcctgaagatattgagcagatggccaatggaatcgctctgggcctcatggccctgaagctcattacccagttcgagacctatcagctgtggacagcgcttatctccctgacgtgtagcaacaccatttttacactcaccgtggcctggcgcacagctaccctgatcctggccggcgtctcccttctgccggtttgccaatctagctccatgcggaaaacggactggctccccatgacagtggctgccatgggggtgcctcccctgcctctcttcatctttaatctgaaggatacccttaagagacgctcttggcccctgaacgaaggagtcatggccgtgggcctggttagcattctcgcttcctctctgcttagaaacgacgtgcctatggcggggcccctggtcgccggaggcctcctgatcgcttgttacgtgattaccgggacaagcgccgatctcaccgttgagaaagccgctgacgtgacatgggaagaggaagccgagcagacgggagtctcccataatctgatgatcaccgtggacgatgacggcacaatgcggattaaggatgacgagaccgaaaacatccttacagtcctgctgaaaaccgcgctcctgatcgtgagcggcattttcccgtactctatccctgctacgcttctggtttggcacacctggcagaagcagacacaacgctccggggtgctctgggatgtccccagccctcccgagacccagaaagccgaactggaggagggagtgtatagaattaagcagcagggcatctttgggaaaacacaagttggagtgggcgtccagaaggaaggggtgttccataccatgtggcacgtgacacggggagccgttctcacgtacaatggcaagcgcctggagccgaactgggcttctgtcaaaaaggaccttatttcctatggcgggggatggagactgagcgcccagtggcaaaaaggcgaagaggtccaggtgatcgcggtcgaacctgggaagaatcccaaaaactttcagaccatgcctggaacattccagaccaccacaggcgagattggggctatcgccctggatttcaagcccggaacgtctggctcccccatcattaatcgggagggcaaggtggttgggctctacggaaacggcgtggtcaccaaaaatgggggatatgtgagcggcatcgcccaaacaaacgctgaacctgacgggccgacccccgagctggaagaggaaatgtttaagaaacgcaatcttacaattatggatctgcaccctggctccggaaagaccagaaaatacctccccgccatcgttcgggaggctattaagcgcagactgcggacgctcatcctggcccctacaagagtggtcgcggccgagatggaagaggctcttaagggcctgcccatccgctatcagaccaccgccacaaaaagcgaacataccgggcgggagattgtggacctgatgtgccacgctacattcaccatgagactcctgtctcctgttcgcgtgccgaactacaatcttatcattatggatgaagcccattttacggaccccgccagcatcgctgcgcggggatacatttccacaagagtcggcatgggggaggccgctgccatcttcatgaccgccacacctcccggaaccgctgatgcctttcctcagtctaacgcgcccatccaggacgaggaacgcgacattccggagcggagctggaactccggcaacgaatggatcacggatttcgctgggaagaccgtgtggtttgtgccttctattaaagccggcaacgacatcgccaattgtctgagaaagaacggcaaaaaggtcattcaactcagccgcaagacattcgataccgagtatcagaaaacaaagctgaatgactgggattttgttgtgaccacagacatctccgagatgggagctaacttcaaagccgatcgggtgattgaccccagacggtgcctgaagcccgtcatcctcaccgatgggcctgaacgcgtgatccttgcgggacccatgcctgttacggccgcttctgccgctcagagacggggccgcgtggggagaaatccgcagaaagagaacgaccaatacatttttacaggacagcccctgaataacgatgaagaccacgcccattggaccgaggctaagatgctgctcgacaatatcaacacccctgaaggcattatccccgccctgttcgagcctgagcgggaaaagagcgcggccattgatggggagtatagacttaaaggcgaatcccgcaagacattcgtcgagctgatgcggagaggagacctccccgtgtggctggctcacaaagttgccagcgaaggcatcaagtacaccgatcgcaaatggtgctttgacgggcagcggaataaccagatcctggaggagaatatggatgtggaaatttggacaaaggagggagagaagaagaagctcagaccgcgctggcttgacgctcggacgtattctgatcctctggccctgaaagagttcaaggactttgccgctggcagaaaatccatcgcgctcgatctggtcaccgaaattgggcgcgtgcccacacaccttgcccatagaacccggaacgctctggacaatctcgtcatgctgcacacaagcgagcatggaggcaaggcctaccgccacgccgtggaggaactgcctgagaccatggaaacgctccttctgctgggcctcatgatcctgcttaccgggggagctatgctgttcctcatttctggcaaagggatcggaaagacatccatcggcctgatttgtgttatcgccagctccgggatgctgtggatggcggagattcccctccaatggatcgcctctgctattgtgcttgagtttttcatgatggtgctgctgatccctgaacccgagaagcagagaaccccgcaggataaccaactcgcctatgtcgttattggaatcctgacacttgctgccatcattgcggccaatgaaatgggcctgctcgagaccacgaaacgggacctgggcatgagcaaggaacctggggtggtgtcccccacaagctacctggatgtcgacctccaccccgcttctgcctggaccctttacgctgtggccacaaccgttatcacccctatgctgcgccatacaattgagaactccacggctaacgtgagcctggccgcgatcgccaatcaggctgtcgtgctcatgggactggacaaaggctggccgatttctaagatggatcttggggtccccctgctcgccctgggatgctatagccaggtgaaccctctgaccctcacagctgccgttcttctgctgatcacccactacgccatcattggccccgggctccaggcgaaagctacaagagaggcccaaaagcggaccgctgccggaatcatgaagaatcctacggtggacggcattatgacaatcgatctggaccccgtcatttatgattccaaatttgaaaagcagcttggccaggtgatgctgctcgttctgtgtgccgtgcagctgctccttatgagaacctcttgggctctgtgcgaggccctgaccctcgcgacagggcctatcaccacactgtgggaaggaagcccgggcaaattctggaacacgaccatcgccgtctccatggctaatatttttcgcgggtcttaccttgccggagctggcctggccttcagcatcatgaagtccgtggggacaggaaaacggggcaccggcagccaaggggagacactcggagaaaagtggaagaaaaagctgaaccagctgtctagaaaagagtttgacctctataagaaatccggcattaccgaggtggatcgcacggaagcgaaggaggggcttaaacggggagaaatcacccatcacgccgttagcagaggctccgctaagctgcagtggttcgtcgagcggaatatggtgattcccgaagggcgcgtgatcgacctgggatgtggcagaggcgggtggtcttactattgcgccggactcaagaaagtcacagaggttcggggctacaccaaagggggacctggccatgaggaacccgtgcctatgagcacatacgggtggaacattgtgaaactgatgtccggaaaggatgtcttttatcttcccccggagaaatgtgacaccctgctctgcgatatcggcgaatctagcccttcccccacagtggaggagagccgcaccatcagagttctgaagatggtggaaccctggctgaagaataaccagttctgtattaaagtcctcaatccttacatgcccacggtgatcgagcaccttgaacggctgcaacgcaagcacggcgggatgctggttagaaaccctctctctagaaattccacacatgagatgtattggattagcaacggaaccggcaatatcgtggcttctgtcaacatggtgtcccgcctgcttctgaacagattcaccatgacacaccggagaccgacgattgaaaaagacgtggatctcggggccggaacccgccatgtcaatgctgagcccgagacacctaacatggacgttatcggcgaacggatcaagagaattaaagaggaacacaatagcacctggcactacgacgatgagaacccctataagacatgggcctaccatgggtcttatgaagtgaaggcgaccggaagcgcctcctctatgatcaatggcgtggtcaaactgctgacaaagccttgggacgtggttcccatggtgacccagatggctatgacggataccacaccgtttggccagcaacgcgtcttcaaagagaaggtggacacccggacacctagaagcatgcccgggacccgccgggttatgggaattacggccgagtggctctggagaacactgggccgcaacaaaaagcctcggctttgcaccagagaagagtttacaaagaaagtgcgcaccaatgctgccatgggggccgtcttcacggaagagaaccagtgggattccgcgaaggctgccgtggaagacgaggatttttggaaactggttgaccgggagagagaactccacaagctgggaaaatgtggcagctgcgtgtacaatatgatggggaagcgcgagaagaaacttggcgagttcggaaaagccaaaggctccagagctatctggtacatgtggctgggggcccggtatctcgagtttgaggctctgggattcctgaacgaagatcattggttttctcgcgagaatagctactccggcgtcgaaggggagggactccacaagctgggctatattcttagagacatctctaaaatccccgggggcgccatgtacgcggatgacaccgccggatgggacacacggattaccgaagatgacctgcataacgaggagaagatcacacagcagatggatcctgaacacagacaactcgctaatgccattttcaaactgacctatcagaacaaggtggtcaaggtgcagcggcccacaccgaccggcacggttatggacatcattagccgcaaagatcagagagggtccggacaagtgggcacatacgggcttaatacctttaccaacatggaggctcagctgatccggcagatggaaggagagggcgtcctctctaaggccgacctggaaaaccctcatctgcccgagaaaaagatcacacagtggctcgagaccaaaggggtggaacgcctgaagagaatggcgattagcggcgatgactgcgtggttaagcccatcgatgaccggttcgccaatgcccttctggccctcaacgatatgggaaaagtgcgcaaggacattcctcaatggcagccgtccaaaggctggcatgattggcagcaggtccccttttgtagccaccatttccacgagctgatcatgaaggacgggagaaaacttgtggttccttgccggccccaagacgaactgattggacgcgctagaatctctcagggcgccgggtggtccctccgggagacagcttgtctgggaaaggcctatgcgcagatgtggagcctgatgtacttccaccgcagagatctccggctggcctctaatgctatttgctccgccgtgcctgtccattgggtgcccacgagccgcaccacatggtctatccacgcccatcaccaatggatgaccacagaagacatgcttaccgtctggaacagagtgtggatcgaggataatccttggatggaggacaagacgcccgttaccacatgggaaaacgtgccgtacctgggcaaacgggaggatcagtggtgtgggtccctcattggcctgaccagcagagctacatgggcccagaatatccctaccgcgattcagcaagtccgctcccttatcggaaacgaagagtttctggactatatgcccagcatgaagcggttcagaaaagaggaagagtctgaaggcgctatttggtga

SEQ ID NO: 20820 - RNA, 9873 nt, synthetic construct
  misc_feature 1..9873: note = derived and/or modified CDS sequence (opt5) from DENV-3__FJ898474__SS-prME
  source 1..9873: mol_type = other RNA
accagcctgtgcctcatgatgatcctgcccgccgctcttgccttccacctgacatcccgggacggagaacctcggatgattgtggggaagaacgaacgcggaaaatctctcctgtttaagacggcgagcggcatcaatatgtgtacccttattgctatggatctgggggaaatgtgcgacgatacagtgacctacaaatgtccgcatatcacagaagttgaacccgaagacattgattgctggtgtaacctcacctccacatgggtgacctatggaacgtgcaatcaggccggcgaacaccggcgggacaagcgctctgtggccctggctcctcatgtcgggatgggactggatacccggacacagacctggatgagcgccgaaggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggccctcccggaggaacaggaccagaattatgtgtgtaaacacacctacgtggatcggggctgggggaacggatgcggcctgttcgggaagggaagccttgtgacctgcgctaagtttcaatgtctggagcccattgagggcaaagtggttcagtatgaaaatctcaagtacacagtgatcatcaccgtccatacaggggaccagcaccaggtgggaaacgagacgcaaggcgttaccgccgaaattacacctcaggcttctaccacagaggccatcctgcccgaatatggcaccctggggctcgagtgctcccctcgcacgggactggacttcaatgagatgattcttctgaccatgaaaaacaaggcctggatggtgcatagacagtggtttttcgatctccccctgccgtggacaagcggcgctaccacagaaacccctacgtggaatcggaaagagcttctggtcacatttaagaacgcgcacgccaaaaagcaagaagtggtcgtgctcgggtctcaggagggagctatgcacaccgccctgacaggcgccaccgaaatccaaaattccgggggcaccagcattttcgctggacatctgaagtgtcgcctcaaaatggacaagctggagcttaaaggcatgtcttacgccatgtgcacaaacacgtttgttctgaagaaagaggtgtccgaaacccagcacgggacaatcctcatcaaggtcgagtacaagggagaagatgtgccctgtaaaattcctttcagcaccgaggacggccaagggaaggcgcataacggaagactgatcacagctaatcccgttgtgaccaaaaaggaggaacccgtcaacattgaggccgaacctccgttcggcgagtccaatatcgtgattgggatcggcgataacgccctgaaaatcaattggtataagaagggatctagcattggcaaaatgtttgaagctacggccagaggggctagacgcatggccatccttggagacacagcgtgggatttcggctccgtcggcggggttctcaacagcctggggaagatggtccaccagatttttgggtctgcctacaccgctctgttctccggcgtgagctgggtgatgaaaatcggaattggcgtcctcctgacctggatcgggcttaattctaagaacacaagcatgtccttttcttgcattgccatcggaatcattaccctgtatctcggcgctgtggttcaggccgacatggggtgtgtgatcaattggaaaggaaaggagctgaagtgcggcagcgggattttcgtcacaaacgaggtgcatacgtggaccgaacagtacaaatttcaagcggattcccccaagcggctggccacagctatcgccggcgcttgggagaatggagtttgtggcattagaagcaccacacgcatggaaaaccttctctggaaacagatcgccaatgagctgaactatatcctgtgggaaaataacattaagctcaccgtggtcgtgggggacatcattggagttctggagcagggcaaacggacgcttacccctcagcccatggagctgaagtactcttggaaaacatgggggaaggccaagatcatgaccgctgaaacacaaaactccagcttcattatcgatggacctaatacccccgagtgcccgtctgcgtccagagcctggaacgtgtgggaagtcgaggactatggctttggcgtgttcacaaccaatatctggctcaaactgcgcgaagtgtacacgcagctgtgtgaccaccggcttatgagcgctgccattaaggatgagagagccgtccacgctgacatggggtactggatcgagtcccagaaaaacggatcttggaagctcgaaaaagccagcctgattgaggttaagacatgcacctggcctaagtcccataccctgtggtctaatggcgtgctcgaaagcgatatgatcattcccaaagggctggcgggacctatctcccagcacaaccatcgccccggctatcacacacaaaccgctgggccttggcaccttggaaagctggagctcgactttaattactgcgagggcacgacagtggtcatcaccgaaaactgtggcacacgggggcccagcctgagaaccacaaccgtgtctggaaaactgattcatgagtggtgctgtcgctcctgcacgcttccgcctctccggtatatcggcgaagatgggtgttggtacggaatggagattagacccatcagcgaaaaggaggagaatatggttaaatctctggtgtccgccggcagcgggaaggtcgacaacttcaccatgggagtgctgtgcctcgccattctgtttgaagaggttatgcggggcaagttcggcaaaaagcacatgatcgctggggtgttctttacattcgtccttctgctctctggacagattacctggcgcgatatggcccatacactgatcatgatcggcagcaatgcgtccgacagaatggggatgggagtgacctatctggctcttattgccacgtttaaaatccagcccttcctggccctcggctttttcctgcggaagctcacaagcagagaaaacctgcttctgggggttggactcgctatggccaccacactgcaactgcctgaggatattgaacagatggctaatggcatcgcccttggcctgatggcgctcaaactgattacccagtttgagacctaccagctctggacagccctgatctctcttacgtgttccaacaccatcttcacactgaccgtggcttggcgcacagccaccctcattctggctggggtcagcctgcttccggtgtgccaatcctctagcatgcggaagacggactggctgcccatggccgtggccgctatgggagtccctcccctccctctgtttatcttctccctcaaggatacactgaaaagacgctcttggccccttaatgagggcgttatggcggtggggctggtgagcattctggcctcctctctcctgagaaacgacgtccctatggctggaccccttgtggccggcgggctgctcatcgcctgttatgttattaccggaaccagcgctgatctgacagtggaaaaggccgcggacatcacctgggaggaagaggctgaacagacaggcgtctcccacaacctcatgatcacggtggacgatgacggcaccatgcggattaaagatgacgagacagagaatatcctgaccgttcttctgaagacagccctgctcattgtgagcgggatctttccgtactctattcctgccaccctgcttgtctggcatacgtggcagaaacagacccaacgctccggagtgctgtgggatgtccccagccctcccgaaacacagaaggctgagctcgaagagggcgtgtacagaatcaaacagcaggggattttcggaaagacccaagttggcgtgggggtccagaaggagggagtgtttcacacaatgtggcacgttacccggggcgccgtgctgacatataacggcaaacgcctcgaaccgaattgggcgtctgtcaagaaagacctgatctcctacgggggaggctggagacttagcgctcagtggcaaaagggggaggaagtccaggtgatcgccgttgagcctggcaagaaccccaagaatttccagacgatgcctggcaccttccagacaattaccggggaaatcggagccattgctctggattttaagcccggcacctctggctcccccatcattaaccgggaggggaaagtcgtgggactgtatggcaatggggtggtcacaaagaacggaggctacgtgagcgggatcgcccaaacgaatgctgagcctgacggcccgacccccgaactcgaggaagagatgttcaaaaagcgcaacctgacaatcatggatcttcatcctggatccggcaaaaccagaaagtatctgcccgccattgttcgggaagcgatcaagcgcagactccggacactgattctcgcccctaccagagtggtcgctgccgagatggaggaagctctgaaagggcttcccatccgctaccagacgacagccaccaagagcgagcacaccggacgggaaattgtggacctgatgtgccatgccacatttaccatgagactgctctctcctgttcgcgtgccgaattataacctgatcatcatggatgaggctcacttcacagaccccgcgagcattgccgctcggggctacatctccaccagagtcgggatgggagaagccgccgctatttttatgacggccacacctcccggcaccgcggatgctttccctcagtctaatgcccccatccaggacgaggagcgcgacattccggaacggagctggaactccgggaatgagtggatcacagattttgccggcaaaaccgtgtggttcgttccttctattaaggctggaaacgacatcgccaactgtcttcgcaaaaatggcaagaaggtgatccaactgagcagaaaaacgtttgataccgaataccagaagacaaaactcaacgactgggatttcgtcgtgaccacagacatttccgagatgggggcgaattttaaggccgatcgggtgatcgaccccagacggtgcctgaaacccgtcattctgaccgatggacctgagcgcgttatcctcgctggccccatgcctgtgacagccgcttctgccgctcagagacgggggcgcgtgggaagaaacccgcagaaggaaaatgaccaatatattttcaccggccagccccttaacaatgatgaggaccatgcccactggacggaagcgaagatgctgctggacaacatcaatacacctgaggggatcattcccgccctcttcgaacctgagcgggagaaaagcgctgccatcgatggcgaatacagactgaagggagagtcccgcaaaacctttgtcgaacttatgcggagaggcgacctgcccgtgtggctcgctcacaaggttgccagcgaggggattaaatataccgatcgcaagtggtgcttcgacggacagcggaacaatcagatcctggaagagaacatggatgtggagatttggacaaaagaaggcgagaagaagaaactgagaccgcgctggctcgacgcccggacctactctgatcctcttgctctgaaggaatttaaagacttcgcggccgggagaaagtccatcgctctggatctcgtcacagagatcggacgcgtgcccagccatctggcccacagaacgcggaatgcccttgacaacctggttatgctccatacctctgaacacggcggccgcgcttatagacacgccgtggaggagctgcctgaaacaatggagaccctgctccttctggggctgatgattctcctgacaggaggcgcgatgctttttctgatctccgggaaaggaattggcaagaccagcatcgggctcatttgtgtcatcgcctcctctggaatgctgtggatggctgaaattcccctgcaatggatcgccagcgctatcgtgctcgagttctttatgatggtccttctgattcctgagcccgaaaagcagcggacgccgcaggataatcaactggcctacgtggttatcggcattctcaccctggcggccatcattgctgccaacgagatgggccttctggaaacaaccaaacgcgacctcgggatgtccaaggagcctggagtggtgagccccacatcttatctggatgtcgacctgcatcccgcttccgcctggaccctctacgctgttgccacgacagtgatcacccctatgcttagacacacaatcgaaaatagcaccgcgaacgtgtctctggccgctattgccaaccaggctgtcgtgctgatgggcctcgacaaagggtggccgatcagcaagatggatctgggagttccccttctggccctcggctgctactcccaggtgaatcctctgaccctgacagccgcggtcctccttctgattacgcattatgctatcattgggcccggactgcaggccaaagctacccgggaggcccaaaagagaacagccgctggcatcatgaagaaccctaccgtggacggcatcatgacaattgatctcgaccccgtcatctacgattctaaattcgagaagcagctgggacaggtgatgcttctggttctctgtgccgtgcagctgctgctcatgcgcaccagctgggcgctttgcgaagccctgacgctggctacaggacctattaccaccctctgggagggctccccggggaaattttggaatacaaccatcgccgtctctatggctaacattttccggggaagctatctggccggcgcggggcttgccttttccatcatgaaaagcgtgggaacaggcaaaagaggcacggggtctcaaggagaaaccctgggcgagaagtggaagaaaaagctcaatcagctgtcccgcaaagagttcgacctgtacaagaaaagcgggattacagaggttgatcggaccgaggctaaggaaggactcaaaagaggcgagacaacccaccatgccgtgtcccgggggtctgctaaacttcagtggtttgtcgaacgcaacatggtgatccccgagggaagagtgatcgacctgggctgtggcagagggggatggagctattactgcgccggcctgaagaaagttacggaagtccgcgggtataccaagggaggccctgggcacgaggagcccgtgcctatgtccacatacggatggaatattgtgaaactcatgtctggcaaggatgtcttctacctgcccccggaaaaatgtgacacccttctgtgcgatatcggcgagagctcccctagccccacagttgaagagtctagaaccattcgggtgctcaagatggtggagccctggctgaagaacaatcagttctgtatcaaagtcctgaacccttatatgcccacagtgattgaacacctcgagcgccttcaaagaaagcatgggggaatgctggttcggaatcctctgtcccgcaacagcacccacgaaatgtactggatctctaatggcacggggaacatcgtggcttccgtcaatatggtgagcagactcctgcttaaccggtttacaatgacccatagacgcccgaccattgagaaagacgttgatctgggagccggcacacggcacgtgaacgcggaacccgagacgcctaatatggacgtcatcggggagagaattaagcgcatcaaagaagaacacaactctacctggcattatgacgatgaaaatccctacaagacatgggcctatcacggaagctacgaggtgaaggctaccggctccgcctctagcatgattaacggcgtggtcaaactcctgacaaagccttgggacgttgtgcccatggtgacccagatggctatgacagataccacgccgttcgggcagcaacgggtctttaaagaaaaggtggacaccagaacacctcgctccatgcccggaacccggagagttatgggcatcacagccgagtggctgtggcgcaccctcgggcggaataaaaagcctagactgtgcacgcgcgaggagttcacaaagaaagtgcggaccaacgccgcgatgggagctgtctttacagaggaaaatcagtgggatagcgccaaggccgctgtggaggacgaagatttctggaaacttgttgacagagagcgcgagctgcataagctcggcaaatgtgggtcctgcgtgtataacatgatgggcaagagagagaagaagctgggagagtttggcaaggccaaagggtctcgggctatctggtacatgtggcttggagcccgctacctggagttcgaggcgctcggctttctgaatgaggatcactggttcagcagagaaaactcctattctggggtcgagggagaaggcctgcataagctcgggtacattctgcgggacatcagcaaaattcccggcggagccatgtatgctgatgacaccgccggctgggacacgagaatcaccgaggatgaccttcacaatgaagagaagattacacagcagatggatcctgagcaccggcaactggctaacgccatctttaaactcacctaccagaataaggtggttaaggtgcagcgccccacaccgaccgggacagtcatggacatcatttccagaaaagatcagcggggatctggccaagtggggacctatggactgaacacgttcacaaatatggaagcgcagcttatccgccagatggagggcgaaggggtcctgagcaaggccgacctcgagtcccctcatctgcccgagaaaaagattacccagtggctggagaccaaaggcgtggagagactcaagcggatggctatcagcggagatgactgcgttgtgaagcccattgatgaccgctttgccaacgctctgcttgccctgaacgatatgggcaaagtcagaaaggacatccctcaatggcagccgtctaaagggtggcacgattggcaacaggtgcccttctgttcccatcacttccacgaactcattatgaaggacggacggaaactggtggttccttgccgcccccaagacgagcttatcggcagagctcggatcagccagggggccggatggtctctgcgcgaaacagcgtgtctcggcaaggcctacgctcagatgtggtccctgatgtattttcatagacgggatctgcgcctcgccagcaatgccatttgctctgctgtgcctgtccactgggtgcccacctccagaacaacgtggagcatccatgcccaccatcaatggatgaccacagaggacatgctgaccgtttggaaccgggtgtggattgaagataatccttggatggaggacaagacacccgtcaccacgtgggagaacgtgccgtaccttgggaaaagagaagatcagtggtgtggctccctgatcggactcaccagccgcgcgacatgggctcagaatattcctaccgccatccagcaagtccggtctctgatcggcaacgaggagttccttgactacatgcccagcatgaagagatttcgcaaagaggaggaatccgagggggccatttggtga

SEQ ID NO: 20821 - RNA, 9873 nt, synthetic construct
  misc_feature 1..9873: note = derived and/or modified CDS sequence (opt5) from DENV-3__EU529688__SS-prME
  source 1..9873: mol_type = other RNA
acaagcctgtgcctcatgatgatcctgcccgccgctcttgccttccacctgacatcccgggacggagaacctcggatgattgtggggaagaacgaacgcggaaaatctctcctgtttaagacggcgagcggcatcaatatgtgtacccttattgctatggatctgggggagatgtgcgacgatacagtgacctacaaatgtccgcacatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacacgatcggagtgctggagcagggcaaacggacccttacacctcagcccatggagctgaagtactcttggaaaacctgggggaaggccaagattgtcacagccgaaacccaaaactccagcttcatcattgatggacctaatacacccgagtgcccgtctgcttccagagcgtggaacgtgtgggaagtggaggactatggctttggcgtcttcaccacgaatatctggctcaaactgcgcgaagtttacacacagctgtgtgaccaccggcttatgagcgccgctgtgaaggatgagagagccgtgcacgccgacatggggtactggatcgagtcccagaaaaacggatcttggaagctcgaaaaagctagcctgattgaggtcaagacctgcacctggcctaagtcccatacactgtggtctaatggcgtgctcgaaagcgatatgatcattcccaaatccctggccgggcctatcagccagcacaactatcgccccggataccatacccaaacggcgggcccttggcaccttgggaagctggagctcgactttaattattgcgagggaacaaccgttgtgattacagaaaactgtggcacccggggcccctctctgagaacaaccacggtctccgggaaactgatccacgagtggtgctgtcgcagctgcacccttccgcctctccggtacatgggagaagatggctgttggtatgggatggagatcagacccatttctgaaaaggaggagaatatggtgaaatccctggttagcgctggatctggcgaagtggacaacttcacaatgggggtcctgtgcctcgccatcctgtttgaggaagtgatgcggggaaagttcggcaagaaacatatgattgccggcgttttctttaccttcgtgcttctgctcagcgggcagatcacatggcgcgatatggctcacaccctgattatgatcggatccaatgccagcgacagaatgggcatgggggtcacgtacctggcgcttattgctacatttaagatccagcccttcctggccctcggatttttcctgcggaaactcacctctagagagaacctgcttctgggcgtggggctcgccatggctacaaccctgcaactgcctgaagatatcgagcagatggccaatggaattgctcttggcctgatggccctcaagctgatcacccagtttgagacatatcagctctggacggcgctgatttcccttacctgtagcaacacaatcttcaccctgacagtggcctggcgcaccgctacgctcattctggccggcgtctccctgcttccggtttgccaatctagctccatgcggaaaacagactggctgcccatgaccgtggctgccatgggggtgcctcccctccctctgtttatcttctctctcaaggataccctgaagagacgcagctggccccttaatgaaggagtcatggccgtgggcctggtttccatcctggcttctagcctcctgagaaacgacgtgcctatggcggggccccttgtcgccggaggcctgctcattgcttgttacgtgatcacagggacctccgccgatctgacagttgagaaagccgctgacgtgacgtgggaagaggaagccgagcagaccggagtcagccataacctcatgattacagtggacgatgacggcaccatgcggatcaaggatgacgagacagaaaatattctgaccgtccttctgaaaacggcgctgctcatcgtgtctggcatctttccgtactccattcctgctaccctgcttgtttggcacacatggcagaagcagacccaacgcagcggggtgctgtgggatgtcccctctcctcccgagacacagaaagccgaactcgaggagggagtgtatagaatcaagcagcagggcattttcgggaaaacccaagttggagtgggcgtccagaaggaaggggtgtttcatacaatgtggcacgtgacgcggggagccgttctgacctacaacggcaagcgcctcgagccgaattgggcttccgtcaaaaaggacctgatcagctatggcgggggatggagactttctgcccagtggcaaaaaggcgaagaggtccaggtgattgcggtcgaacctgggaagaaccccaaaaatttccagacaatgcctggaaccttccagaccacaacgggcgagatcggggctattgccctggattttaagcccggaacctccggcagccccatcatcaaccgggagggcaaggtggttgggctgtacggaaatggcgtggtcaccaagaacgggggatatgtgtccggcattgcccaaaccaatgctgaacctgacgggccgacacccgagctcgaagaggaaatgttcaagaaacgcaacctgaccatcatggatcttcaccctggcagcggaaagacgagaaaatacctgcccgccattgttcgggaggctatcaagcgcagactccggacactgattctcgcccctaccagagtggtcgcggccgagatggaagaggctctgaagggccttcccatccgctatcagaccacagccaccaaatctgaacatacagggcgggagatcgtggacctgatgtgccacgctacctttacgatgagactgctcagccctgttcgcgtgccgaattacaacctgattatcatggatgaagcccatttcacagaccccgcctccattgctgcgcggggatacatctctaccagagtcggcatgggggaggccgctgccatttttatgacagccacccctcccggaacggctgatgccttccctcagagcaatgcgcccatccaggacgaggaacgcgacatcccggagcggtcctggaactctggcaatgaatggattaccgattttgctgggaagacagtgtggttcgtgcctagcatcaaagccggcaacgacattgccaactgtcttagaaagaatggcaaaaaggtcatccaactgtcccgcaagacctttgatacagagtatcagaaaaccaagctcaacgactgggatttcgttgtgacaaccgacatttctgagatgggagctaattttaaagccgatcgggtgatcgaccccagacggtgcctgaagcccgtcattctgacggatgggcctgaacgcgtgatcctcgcgggacccatgcctgttacagccgctagcgccgctcagagacggggccgcgtggggagaaacccgcagaaagagaatgaccaatacatcttcaccggacagccccttaacaatgatgaagaccacgcccattggaccgaggctaagatgctgctggacaacattaatacacctgaaggcatcattcccgccctcttcgagcctgagcgggaaaagtccgcggccatcgatggggagtatagactgaaaggcgaaagccgcaagacctttgtcgagcttatgcggagaggagacctgcccgtgtggctcgctcacaaagttgcctctgaaggcattaagtacacagatcgcaaatggtgcttcgacgggcagcggaacaatcagatcctggaggagaacatggatgtggaaatctggacgaaggagggagagaagaagaagctgagaccgcgctggctcgacgctcggacctattccgatcctcttgccctgaaagagtttaaggacttcgccgctggcagaaaaagcattgcgctggatctcgtcacagaaatcgggcgcgtgccctctcacctggcccatagaacccggaatgctcttgacaacctggtcatgctccacacatccgagcatggaggcaaggcctaccgccacgccgtggaggaactgcctgagaccatggaaacgctgctccttctgggcctgatgattctcctgaccgggggagctatgctttttctgatcagcggcaaagggattggaaagacatccatcggcctcatctgtgttattgcctctagcgggatgctgtggatggcggagatccccctgcaatggattgcctccgctatcgtgctcgagttctttatgatggtgcttctgattcctgaacccgagaagcagagaaccccgcaggataatcaactggcctatgtcgttatcggcattctcacactggctgccatcatcgcggccaacgaaatgggccttctggagaccacgaaacgggacctcggcatgagcaaggaacctggggtggtgtctcccacatcctacctggatgtcgacctgcaccccgctagcgcctggaccctctacgctgtggccacaaccgttattacccctatgcttcgccatacaatcgaaaattctacggctaacgtgagcctggccgcgattgccaaccaggctgtcgtgctgatgggactcgacaaaggctggccgatctccaagatggatctgggggtcccccttctggccctcggatgctattctcaggtgaatcctctgaccctgacagctgccgttctccttctgattacccactacgccatcatcggccccgggctgcaggcgaaagctacaagagaggcccaaaagcggaccgctgccggaattatgaagaaccctacggtggacggcatcatgacaattgatctcgaccccgtcatctatgatagcaaattcgagaagcagctgggccaggtgatgcttctggttctctgtgccgtgcagctgctgctcatgagaacctcctgggctctttgcgaggccctgaccctggcgacagggcctattaccacactctgggaaggatctccgggcaaattttggaatacgaccatcgccgtcagcatggctaacatcttccgcgggtcctacctggccggagctggccttgcctttagcattatgaagtctgtggggacaggaaaacggggcaccggctcccaaggggagacactgggagaaaagtggaagaaaaagctcaatcagctgagcagaaaagagttcgacctgtataagaaatccggcatcaccgaggtggatcgcacggaagcgaaggaggggctcaaacggggagaaattacccatcacgccgtttctagaggcagcgctaaacttcagtggtttgtcgagcggaacatggtgatccccgaagggcgcgtgattgacctgggatgtggcagaggcgggtggtcctactattgcgccggactgaagaaagtcacagaggttcggggctacaccaaagggggacctggccatgaggaacccgtgcctatgtctacatacgggtggaatatcgtgaaactcatgagcggaaaggatgtcttctatctgcccccggagaaatgtgacacccttctgtgcgatattggcgaatccagcccttctcccacagtggaggagtcccgcaccatcagagttctcaagatggtggaaccctggctgaagaacaatcagttctgtatcaaagtcctgaacccttacatgcccacggtgattgagcacctcgaacggcttcaacgcaagcacggcgggatgctggttagaaatcctctgagccggaactctacacatgagatgtattggatctccaatggaaccggcaacattgtggctagcgtcaatatggtgtctcgcctcctgcttaacagatttaccatgacacaccggagaccgacgatcgaaaaagacgtggatctgggggccggaacccgccatgtcaacgctgagcccgagacacctaatatggacgttattggcgaacggatcaagagaatcaaagaggaacacaacagcacctggcactacgacgatgagaatccctataagacatgggcctaccatgggtcctatgaagtgaaggcgaccggatctgccagctccatgattaacggcgtggtcaaactcctgacaaagccttgggacgtggttcccatggtgacccagatggctatgacggataccacaccgttcggccagcaacgcgtctttaaagagaaggtggacacccggacacctagaagcatgcccgggacccgccgggttatgggaatcacggccgagtggctgtggagaacactcggccgcaataaaaagcctcggctgtgcaccagagaagagttcacaaagaaagtgcgcaccaacgctgccatgggggccgtctttacggaagagaatcagtgggattccgcgaaggctgccgtggaagacgaggatttctggaaacttgttgaccgggagagagaactgcacaagctcggaaaatgtggctcttgcgtgtacaacatgatggggaagcgcgagaaaaagctgggcgaatttggaaaggccaaaggcagcagagctatttggtacatgtggcttggggcccggtatctggagttcgaggctctcggatttctgaatgaagatcattggttctcccgcgagaactcttacagcggcgtcgaaggggagggactgcacaagctcggctatatcctgagagacatttccaaaatccccgggggcgccatgtacgcggatgacaccgccggatgggacacacggatcaccgaagatgaccttcataatgaggagaagattacacagcagatggatcctgaacacagacaactggctaacgccatctttaaactcacctatcagaataaggtggtcaaggtgcagcggcccacaccgaccggcacggttatggacattatctctcgcaaagatcagagagggagcggacaagtgggcacatacgggctgaacaccttcaccaatatggaggctcagcttattcggcagatggaaggagagggcgtcctgtccaaggccgacctcgaaaaccctcatctgcccgagaaaaagatcacacagtggctggagaccaaaggggtggaacgcctcaagagaatggcgatcagcggcgatgactgcgtggttaagcccattgatgaccggtttgccaacgctctgcttgccctgaatgatatgggaaaagtgcgcaaggacatccctcaatggcagccgtctaaaggctggcatgattggcagcaggtccccttctgttcccaccatttccacgagctcattatgaaggacgggagaaaactggtggttccttgccggccccaagacgaacttatcggacgcgctagaattagccagggcgccgggtggtctctgcgggagacagcttgtctcggaaaggcctatgcgcagatgtggtccctgatgtactttcaccgcagagatctgcggctcgccagcaacgctatctgctctgccgtgcctgtccattgggtgcccacgtcccgcaccacatggagcattcacgcccatcaccaatggatgaccacagaagacatgctgaccgtctggaatagagtgtggatcgaggataacccttggatggaggacaagacgcccgttaccacatgggaaaatgtgccgtaccttggcaaacgggaggatcagtggtgtgggtccctgatcggcctcaccagcagagctacatgggcccagaacattcctaccgcgatccagcaagtccgctctctgattggaaatgaagagttccttgactatatgcccagcatgaagcggtttagaaaagaggaagagtccgaaggcgctatctggtga

SEQ ID NO: 20822 - RNA, 9873 nt, synthetic construct
  misc_feature 1..9873: note = derived and/or modified CDS sequence (opt5) from DENV-3__EU482613__SS-prME
  source 1..9873: mol_type = other RNA
accagcctgtgcctcatgatgatcctgcccgccgctcttgccttccacctgacatcccgggacggcgagcctcggatgattgtggggaagaacgaacgcggaaagtctctcctgtttaagacggcgagcggcatcaatatgtgtacccttattgctatggatctgggggaaatgtgcgacgatacagtgacctacaagtgtccgcacatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacatcattggagtgctggagcagggcaaacggacgcttacccctcagcccatggagctgaagtactcttggaaaacatgggggaaggccaagatcgtcaccgccgaaacacaaaactccagcttcattatcgatggacctaatacccccgagtgcccgtctgcttccagagcgtggaacgtgtgggaagtggaggactatggctttggcgtcttcacaaccaatatctggctcaaactgcgcgaagtttacacgcagctgtgtgaccaccggcttatgagcgccgctgtgaaggatgagagagccgtgcacgccgacatggggtactggattgagtcccagaaaaacggatcttggaagctcgaaaaagctagcctgatcgaggtcaagacatgcacctggcctaagtcccataccctgtggtctaatggcgtgctcgaaagcgatatgattatccccaaatccctggccgggcctattagccagcacaactatcgccccggataccatacacaaaccgcgggcccttggcaccttgggaagctggagctcgactttaattattgcgagggaacgacagttgtgatcaccgaaaactgtggcacacggggcccctctctgagaaccacaaccgtctccgggaaactgatccacgagtggtgctgtcgcagctgcacgcttccgcctctccggtacatgggagaagatggctgttggtatgggatggagattagacccatctctgaaaaggaggagaatatggtgaaatccctggttagcgctggatctggcgaagtggacaacttcaccatgggggtcctgtgcctcgccattctgtttgaggaagtgatgcggggaaagttcggcaagaaacatatgatcgccggcgttttctttacattcgtgcttctgctcagcgggcagattacctggcgcgatatggctcacacactgatcatgattggatccaatgccagcgacagaatgggcatgggggtcacctacctggcgcttatcgctacgtttaagatccagcccttcctggccctcggatttttcctgcggaaactcacatctagagagaacctgcttctgggcgtggggctcgccatggctaccacactgcaactgcctgaagatattgagcagatggccaatggaatcgctcttggcctgatggccctcaagctgattacccagtttgagacctatcagctctggacagcgctgatctcccttacgtgtagcaacaccattttcacactgaccgtggcctggcgcacagctaccctcatcctggccggcgtctccctgcttccggtttgccaatctagctccatgcggaaaacggactggctgcccatgacagtggctgccatgggggtgcctcccctccctctgtttatcttctctctcaaggataccctgaagagacgcagctggccccttaatgaaggagtcatggccgtgggcctggtttccattctggcttctagcctcctgagaaacgacgtgcctatggcggggccccttgtcgccggaggcctgctcatcgcttgttacgtgattaccgggacatccgccgatctgaccgttgagaaagccgctgacgtgacatgggaagaggaagccgagcagacgggagtcagccataacctcatgatcaccgtggacgatgacggcacaatgcggattaaggatgacgagaccgaaaatatcctgacagtccttctgaaaaccgcgctgctcatcgtgtctggcatttttccgtactccatccctgctacgctgcttgtttggcacacctggcagaagcagacacaacgcagcggggtgctgtgggatgtcccctctcctcccgagacccagaaagccgaactcgaggagggagtgtatagaattaagcagcagggcatcttcgggaaaacacaagttggagtgggcgtccagaaggaaggggtgtttcataccatgtggcacgtgacacggggagccgttctgacgtacaacggcaagcgcctcgagccgaattgggcttccgtcaaaaaggacctgattagctatggcgggggatggagactttctgcccagtggcaaaaaggcgaagaggtccaggtgatcgcggtcgaacctgggaagaaccccaaaaatttccagaccatgcctggaacattccagaccaccacaggcgagattggggctatcgccctggattttaagcccggaacgtccggcagccccatcattaaccgggagggcaagatcgtggggctgtacggaaatggcgttgtgaccaaaaacgggggatatgtctccggcattgcccaaacaaatgctgaacctgacgggccgacccccgagctcgaagaggaaatgttcaagaaacgcaacctgacaatcatggatcttcaccctggcagcggaaagaccagaaaatacctgcccgccattgtgcgggaggctatcaagcgcagactccggacgctgatcctcgcccctacaagagttgtggcggccgagatggaagaggctctgaagggccttcccattcgctatcagaccaccgccacaaaatctgaacataccgggcgggagatcgtcgacctgatgtgccacgctacatttaccatgagactgctcagccctgtgcgcgttccgaattacaacctgattatcatggatgaagcccatttcacggaccccgcctccattgctgcgcggggatacatctctacaagagtgggcatgggggaggccgctgccatctttatgaccgccacacctcccggaaccgctgatgccttccctcagagcaatgcgcccattcaggacgaggaacgcgacatcccggagcggtcctggaactctggcaatgaatggattacggattttgctgggaagaccgtctggttcgtgcctagcatcaaagccggcaacgacattgccaactgtcttagaaagaatggcaaaaaggtgatccaactgtcccgcaagacatttgataccgagtatcagaaaacaaagctcaacgactgggatttcgtcgttaccacagacatttctgagatgggagctaattttaaagccgatcgggtgatcgaccccagacggtgcctgaagcccgtgatcctgaccgatgggcctgaacgcgtcattctcgcgggacccatgcctgtgacggccgctagcgccgctcagagacggggccgcgttgggagaaacccgcagaaagagaatgaccaatacatcttcacaggacagccccttaacaatgatgaagaccacgcccattggaccgaggctaagatgctgctggacaacattaatacccctgaaggcatcattcccgccctcttcgagcctgagcgggaaaagtccgcggccatcgatggggagtatagactgaaaggcgaaagccgcaagacatttgtggagcttatgcggagaggagacctgcccgtctggctcgctcacaaagtggcctctgaaggcatcaagtacaccgatcgcaaatggtgcttcgacgggcagcggaacaatcagattctggaggagaacatggatgttgaaatctggacaaaggagggagagaagaagaagctgagaccgcgctggctcgacgctcggacgtattccgatcctcttgccctgaaagagtttaaggacttcgccgctggcagaaaaagcattgcgctggatctcgtgaccgaaatcgggcgcgtccccacacacctggcccatagaacccggaatgctcttgacaacctggtgatgctccacacatctgagcatggaggcaaggcctaccgccacgccgtcgaggaactgcctgagaccatggaaacgctgctccttctgggcctgatgattctcctgaccgggggagctatgctttttctgatctccggcaaagggatcggaaagacaagcattggcctcatctgtgtgattgcctcctctgggatgctgtggatggcggagatccccctgcaatggattgccagcgctatcgttctcgagttctttatgatggtgcttctgattcctgaacccgagaagcagagaaccccgcaggataatcaactggcctatgtggtcatcggaatcctcacactggctgccattatcgcggccaacgaaatgggccttctggagaccacgaaacgggacctcggcatgtccaaggaacctggggttgtgagccccacatcttacctggatgtggacctgcaccccgcttccgcctggaccctctacgctgtcgccacaaccgtgattacccctatgcttcgccatacaatcgagaatagcacggctaacgtttctctggccgcgattgccaaccaggctgtggtcctgatgggactcgacaaaggctggccgatcagcaagatggatctgggggtgccccttctggccctcggatgctattcccaggtcaatcctctgaccctgacagctgccgtgctccttctgatcacccactacgccattatcggccccgggctgcaggcgaaagctacaagagaggcccaaaagcggaccgctgccggaattatgaagaaccctacggttgacggcatcatgacaattgatctcgaccccgtgatctatgattctaaattcgaaaagcagctgggccaggtcatgcttctggtgctctgtgccgttcagctgctgctcatgagaaccagctgggctctttgcgaggccctgaccctggcgacagggcctatcaccacactctgggaaggatccccgggcaaattttggaatacgaccattgccgtgtctatggctaacatcttccgcgggagctacctggccggagctggccttgccttttccattatgaaaagcgtcgggacaggaaaacggggcaccggctctcaaggggagacactgggagaaaagtggaagaaaaagctcaatcagctgtccagaaaagagttcgacctgtataagaaaagcggcatcaccgaggtggatcgcacggaagcgaaggaggggctcaaacggggagaaattacccatcacgccgtgtccagaggctctgctaaacttcagtggtttgttgagcggaacatggtcatccccgaagggcgcgtgattgacctgggatgtggcagaggcgggtggagctactattgcgccggactgaagaaagtgacagaggtccggggctacaccaaagggggacctggccatgaggaacccgttcctatgtccacatacgggtggaatatcgtgaaactcatgtctggaaaggatgtgttctatctgcccccggagaaatgtgacacccttctgtgcgatatcggcgaaagctcccctagccccacagtcgaggagtctcgcaccattagagtgctcaagatggttgaaccctggctgaagaacaatcagttctgtatcaaagtgctgaacccttacatgcccacggtcattgagcacctcgaacggcttcaacgcaagcacggcgggatgctggtgagaaatcctctgtcccggaacagcacacatgagatgtattggatctctaatggaaccggcaacattgttgcttccgtgaatatggtcagccgcctcctgcttaacagatttaccatgacacaccggagaccgacgatcgaaaaagacgtggatctgggggccggaacccgccatgtgaacgctgagcccgagacacctaatatggacgtcatcggcgaacggattaagagaatcaaagaggaacacaactctacctggcactacgacgatgagaatccctataagacatgggcctaccatgggagctatgaagttaaggcgaccggatccgcctctagcatgattaacggcgtggtgaaactcctgacaaagccttgggacgtcgtgcccatggttacccagatggctatgacggataccacaccgttcggccagcaacgcgtgtttaaagagaaggtcgacacccggacacctagatccatgcccgggacccgccgggtgatgggaatcacggccgagtggctgtggagaacactcggccgcaataaaaagcctcggctgtgcaccagagaagagttcacaaagaaagttcgcaccaacgctgccatgggggccgtgtttacggaagagaatcagtgggatagcgcgaaggctgccgtcgaagacgaggatttctggaaacttgtggaccgggagagagaactgcacaagctcggaaaatgtggctcctgcgtttacaacatgatggggaagcgcgagaaaaagctgggcgaatttggaaaggccaaaggctctagagctatttggtacatgtggcttggggcccggtatctggagttcgaggctctcggatttctgaatgaagatcattggttcagccgcgagaactcctactctggcgtggaaggggagggactgcacaagctcggctatatcctgagagacatcagcaaaattcccgggggcgccatgtacgcggatgacaccgccggatgggacacacggatcaccgaagatgaccttcataatgaggagaagattacacagcagatggatcctgaacacagacaactggctaacgccatctttaaactcacctatcagaataaggtcgtgaaggtccagcggcccacaccgaccggcacggtgatggacattatctcccgcaaagatcagagagggtctggacaagttggcacatacgggctgaacaccttcaccaatatggaggctcagcttatccggcagatggaaggagagggcgtgctgagcaaggccgacctcgaaaaccctcatctgcccgagaaaaagattacacagtggctggagaccaaaggggtcgaacgcctcaagagaatggcgatctccggcgatgactgcgtggtgaagcccattgatgaccggtttgccaacgctctgcttgccctgaatgatatgggaaaagttcgcaaggacatccctcaatggcagccgagcaaaggctggcatgattggcaacaggtgcccttctgttctcaccatttccacgagctcattatgaaggacgggagaaaactggtcgtgccttgccggccccaagacgaacttatcggacgcgctagaatttcccagggcgccgggtggagcctgcgggagacagcttgtctcggaaaggcctatgcgcagatgtggtctctgatgtactttcaccgcagagatctgcggctcgcctccaacgctatctgcagcgccgttcctgtgcattgggtccccacgtctcgcaccacatggtccatccacgcccatcaccaatggatgaccacagaagacatgctgaccgtgtggaatagagtctggattgaggataacccttggatggaggacaagacgcccgtgaccacatgggaaaatgttccgtaccttggcaaacgggaggatcagtggtgtgggagcctgatcggcctcacctccagagctacatgggcccagaacattcctaccgcgatccagcaagtgcgcagcctgattggaaatgaagagttccttgactatatgccctctatgaagcggtttagaaaagaggaagagagcgaaggcgctatctggtga

SEQ ID NO: 20823 - RNA, 9873 nt, synthetic construct
  misc_feature 1..9873: note = derived and/or modified CDS sequence (opt5) from DENV-3__EU529690__SS-prME
  source 1..9873: mol_type = other RNA
acaagcctgtgcctcatgatgatcctgcccgccgctcttgccttccacctgacatcccgggacggcgagcctcggatgattgtggggaagaatgaacgcggaaaatctctcctgtttaagacggcgagcggcatcaatatgtgtacccttattgctatggatctgggggaaatgtgcgacgatacagtgacctacaaatgtccgcacatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggatacccggacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacacagggtgtgtcatcaattggaaaggaaaggagctgaagtgcggcagcgggattttcgtgacgaacgaggttcatacctggacagaacagtacaaatttcaagccgattcccccaagcggctggcgaccgccatcgctggcgcctgggagaatggagtgtgtggcattagaagcacaacccgcatggaaaaccttctctggaaacagatcgctaatgagctgaactatatcctgtgggaaaataacattaagctcacggtcgtggttggggacatcattggagtgctggagcagggcaaacggacccttacacctcagcccatggagctgaagtactcttggaaaacctgggggaaggccaagatcgtcacagccgaaacccaaaactccagcttcattatcgatggacctaatacacccgagtgcccgtctgcttccagagcgtggaacgtgtgggaagtggaggactatggctttggcgtcttcaccacgaatatctggctcaaactgcgcgaagtttacacacagctgtgtgaccaccggcttatgagcgccgctgtgaaggatgagagagccgtgcacgccgacatggggtactggattgagtcccagaaaaacggatcttggaagctcgaaaaagctagcctgatcgaggtcaagacctgcacctggcctaagtcccatacactgtggtctaatggcgtgctcgaaagcgatatgattatccccaaatccctggccgggcctattagccagcacaactatcgccccggataccatacccaaacggcgggcccttggcaccttgggaagctggagctcgactttaattattgcgagggaacaaccgttgtgatcacagaaaactgtggcacccggggcccctctctgagaacaaccacggtctccgggaaactgatccacgagtggtgctgtcgcagctgcacccttccgcctctccggtacatgggagaagatggctgttggtatgggatggagattagacccatctctgaaaaggaggagaatatggtgaaatccctggttagcgctggatctggcgaagtggacaacttcacaatgggggtcctgtgcctcgccattctgtttgaggaagtgatgcggggaaagttcggcaagaaacatatgatcgccggcgttttctttaccttcgtgcttctgctcagcgggcagattacatggcgcgatatggctcacaccctgatcatgattggatccaatgccagcgacagaatgggcatgggggtcacgtacctggcgcttatcgctacatttaagatccagcccttcctggccctcggatttttcctgcggaaactcacctctagagagaacctgcttctgggcgtggggctcgccatggctacaaccctgcaactgcctgaagatattgagcagatggccaatggaatcgctcttggcctgatggccctcaagctgattacccagtttgagacatatcagctctggacggcgctgatctcccttacctgtagcaacacaattttcaccctgacagtggcctggcgcaccgctacgctcatcctggccggcgtctccctgcttccggtttgccaatctagctccatgcggaaaacagactggctgcccatgaccgtggctgccatgggggtgcctcccctccctctgtttatcttcaatctcaaggataccctgaagagacgctcttggccccttaacgaaggagtcatggccgtgggcctggttagcattctggcttcctctctcctgagaaacgacgtgcctatggcggggccccttgtcgccggaggcctgctcatcgcttgttacgtgattacagggaccagcgccgatctgacagttgagaaagccgctgacgtgacgtgggaagaggaagccgagcagaccggagtctcccataatctcatgatcacagtggacgatgacggcaccatgcggattaaggatgacgagacagaaaacatcctgaccgtccttctgaaaacggcgctgctcatcgtgagcggcatttttccgtactctatccctgctaccctgcttgtttggcacacatggcagaagcagacccaacgctccggggtgctgtgggatgtccccagccctcccgagacacagaaagccgaactcgaggagggagtgtatagaattaagcagcagggcatcttcgggaaaacccaagttggagtgggcgtccagaaggaaggggtgtttcatacaatgtggcacgtgacgcggggagccgttctgacctacaatggcaagcgcctcgagccgaactgggcttctgtcaaaaaggacctgatttcctatggcgggggatggagacttagcgcccagtggcaaaaaggcgaagaggtccaggtgatcgcggtcgaacctgggaagaatcccaaaaacttccagacaatgcctggaaccttccagaccacaacgggcgagattggggctatcgccctggattttaagcccggaacctctggctcccccatcattaatcgggagggcaaggtggttgggctgtacggaaacggcgtggtcaccaagaatgggggatatgtgagcggcatcgcccaaaccaacgctgaacctgacgggccgacacccgagctcgaagaggaaatgttcaagaaacgcaatctgaccattatggatcttcaccctggctccggaaagacgagaaaatacctgcccgccatcgttcgggaggctattaagcgcagactccggacactgatcctcgcccctaccagagtggtcgcggccgagatggaagaggctctgaagggccttcccatccgctatcagaccacagccaccaaaagcgaacatacagggcgggagattgtggacctgatgtgccacgctacctttacgatgagactgctctctcctgttcgcgtgccgaactacaatctgatcattatggatgaagcccatttcacagaccccgccagcatcgctgcgcggggatacatttccaccagagtcggcatgggggaggccgctgccatctttatgacagccacccctcccggaacggctgatgccttccctcagtctaacgcgcccatccaggacgaggaacgcgacattccggagcggagctggaactccggcaacgaatggatcaccgattttgctgggaagacagtgtggttcgtgccttctattaaagccggcaacgacatcgccaattgtcttagaaagaacggcaaaaaggtcattcaactgagccgcaagacctttgatacagagtatcagaaaaccaagctcaatgactgggatttcgttgtgacaaccgacatctccgagatgggagctaactttaaagccgatcgggtgattgaccccagacggtgcctgaagcccgtcatcctgacggatgggcctgaacgcgtgatcctcgcgggacccatgcctgttacagccgcttctgccgctcagagacggggccgcgtggggagaaatccgcagaaagagaacgaccaatacattttcaccggacagccccttaataacgatgaagaccacgcccattggaccgaggctaagatgctgctggacaatatcaacacacctgaaggcattatccccgccctcttcgagcctgagcgggaaaagagcgcggccattgatggggagtatagactgaaaggcgaatcccgcaagacctttgtcgagcttatgcggagaggagacctgcccgtgtggctcgctcacaaagttgccagcgaaggcatcaagtacacagatcgcaaatggtgcttcgacgggcagcggaataaccagatcctggaggagaatatggatgtggaaatttggacgaaggagggagagaagaagaagctgagaccgcgctggctcgacgctcggacctattctgatcctcttgccctgaaagagtttaaggacttcgccgctggcagaaaatccatcgcgctggatctcgtcacagaaattgggcgcgtgcccacccacctggcccatagaacacggaacgctcttgacaatctggtcatgctccacaccagcgagcatggaggcaaggcctaccgccacgccgtggaggaactgcctgagacgatggaaaccctgctccttctgggcctgatgatcctcctgacagggggagctatgctttttctgatttctggcaaagggatcggaaagacctccatcggcctcatttgtgttatcgccagctccgggatgctgtggatggcggagattcccctgcaatggatcgcctctgctattgtgctcgagttctttatgatggtgcttctgatccctgaacccgagaagcagagaacaccgcaggataaccaactggcctatgtcgttattggaatcctcaccctggctgccatcattgcggccaatgaaatgggccttctggagacgacaaaacgggacctcggcatgagcaaggaacctggggtggtgtcccccaccagctacctggatgtcgacctgcaccccgcttctgcctggacactctacgctgtggccaccaccgttatcacacctatgcttcgccatacgattgagaactccaccgctaacgtgagcctggccgcgatcgccaatcaggctgtcgtgctgatgggactcgacaaaggctggccgatttctaagatggatctgggggtcccccttctggccctcggatgctatagccaggtgaaccctctgacactgaccgctgccgttctccttctgatcacacactacgccatcattggccccgggctgcaggcgaaagctaccagagaggcccaaaagcggacggctgccggaatcatgaagaatcctacagtggacggcattatgaccatcgatctcgaccccgtcatttatgattccaaattcgaaaagcagctgggccaggtgatgcttctggttctctgtgccgtgcagctgctgctcatgagaacctcttgggctctttgcgaggccctgacactggcgaccgggcctatcacaacgctctgggaaggaagcccgggcaaattttggaacaccacaatcgccgtctccatggctaatattttccgcgggtcttacctggccggagctggccttgcctttagcatcatgaagtccgtggggaccggaaaacggggcacaggcagccaaggggagaccctgggagaaaagtggaagaaaaagctcaaccagctgtctagaaaagagttcgacctgtataagaaatccggcattacggaggtggatcgcaccgaagcgaaggaggggctcaaacggggagaaatcacacatcacgccgttagcagaggctccgctaaacttcagtggtttgtcgagcggaatatggtgattcccgaagggcgcgtgatcgacctgggatgtggcagaggcgggtggtcttactattgcgccggactgaagaaagtcaccgaggttcggggctacacaaaagggggacctggccatgaggaacccgtgcctatgagcacctacgggtggaacattgtgaaactcatgtccggaaaggatgtcttctatctgcccccggagaaatgtgacacacttctgtgcgatatcggcgaatctagcccttcccccaccgtggaggagagccgcacgatcagagttctcaagatggtggaaccctggctgaagaataaccagttctgtattaaagtcctgaatccttacatgcccacagtgatcgagcacctcgaacggcttcaacgcaagcacggcgggatgctggttagaaaccctctgtctagaaattccacccatgagatgtattggattagcaacggaaccggcaatatcgtggcttctgtcaacatggtgtcccgcctcctgcttaacagatttacaatgacgcaccggagaccgaccattgaaaaagacgtggatctgggggccggaacacgccatgtcaatgctgagcccgagacccctaacatggacgttatcggcgaacggatcaagagaattaaagaggaacacaatagcacatggcactacgacgatgagaacccctataagacctgggcctaccatgggtcttatgaagtgaaggcgacaggaagcgcctcctctatgatcaatggcgtggtcaaactcctgaccaagccttgggacgtggttcccatggtgacgcagatggctatgaccgatacaaccccgttcggccagcaacgcgtctttaaagagaaggtggacacacggacccctagaagcatgcccgggacgcgccgggttatgggaattacagccgagtggctgtggagaaccctcggccgcaacaaaaagcctcggctgtgcacaagagaagagttcaccaagaaagtgcgcacgaatgctgccatgggggccgtctttaccgaagagaaccagtgggattccgcgaaggctgccgtggaagacgaggatttctggaaacttgttgaccgggagagagaactgcacaagctcggaaaatgtggcagctgcgtgtacaatatgatggggaagcgcgagaaaaagctgggcgaatttggaaaggccaaaggctccagagctatctggtacatgtggcttggggcccggtatctggagttcgaggctctcggatttctgaacgaagatcattggttctctcgcgagaatagctactccggcgtcgaaggggagggactgcacaagctcggctatattctgagagacatctctaaaatccccgggggcgccatgtacgcggatgacacagccggatgggacacccggattacagaagatgaccttcataacgaggagaagatcacccagcagatggatcctgaacacagacaactggctaatgccatttttaaactcacatatcagaacaaggtggtcaaggtgcagcggcccaccccgacgggcacagttatggacatcattagccgcaaagatcagagagggtccggacaagtgggcacctacgggctgaataccttcacaaacatggaggctcagcttatccggcagatggaaggagagggcgtcctgtctaaggccgacctcgaaaaccctcatctgcccgagaaaaagatcacccagtggctggagacaaaaggggtggaacgcctcaagagaatggcgattagcggcgatgactgcgtggttaagcccatcgatgaccggtttgccaatgctctgcttgccctgaacgatatgggaaaagtgcgcaaggacattcctcaatggcagccgtccaaaggctggcatgattggcagcaggtccccttctgtagccaccatttccacgagctcatcatgaaggacgggagaaaactggtggttccttgccggccccaagacgaacttattggacgcgctagaatctctcagggcgccgggtggtccctgcgggagacggcttgtctcggaaaggcctatgcgcagatgtggagcctgatgtactttcaccgcagagatctgcggctcgcctctaatgctatttgctccgccgtgcctgtccattgggtgcccaccagccgcacaacctggtctatccacgcccatcaccaatggatgacaaccgaagacatgctgacggtctggaacagagtgtggatcgaggataatccttggatggaggacaagacccccgttacaacctgggaaaacgtgccgtaccttggcaaacgggaggatcagtggtgtgggtccctgattggcctcacaagcagagctacctgggcccagaatatccctacggcgattcagcaagtccgctccctgatcggaaacgaagagttccttgactatatgcccagcatgaagcggtttagaaaagaggaagagtctgaaggcgctatttggtga

SEQ ID NO: 20824 - RNA, 9873 nt, synthetic construct
  misc_feature 1..9873: note = derived and/or modified CDS sequence (opt5) from DENV-3__EU529691__SS-prME
  source 1..9873: mol_type = other RNA
accagcctgtgcctcatgatgatcctgcccgccgctcttgccttccacctgacatcccgggacggcgaacctcggatgattgtggggaagaacgaacgcggaaaatctctcctgtttaagacggcgagcggcatcaatatgtgtacccttattgctatggatctgggggaaatgtgcgacgatacagtgacctacaaatgtccgcatatcacagaagttgaacccgaagacattgattgctggtgtaacctcacctccacatgggtgacctatggaacgtgcaatcaggccggcgaacacagacgggacaagcgctctgtggccctggctcctcatgtggggatgggactggataccagaacacagacctggatgagcgccgaaggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgccccctgtaaaattcctttcagcaccgaggacggccaagggaaggcgcattccggaagactgatcacagctaaccccgttgtgaccaaaaaggaggaacccgtcaatattgaggccgaacctccgttcggcgagtctaacatcgtgattgggatcggcgataatgccctgaaaatcaactggtataagaagggaagctccattggcaaaatgtttgaagctacggccagaggggctagacgcatggccatccttggagacacagcgtgggatttcggcagcgtcgggggagttctcaattctctgggcaagatggtccaccagatttttgggtccgcctacaccgctctgttcagcggcgtgtcttgggtgatgaaaatcggaattggcgtcctcctgacctggatcgggcttaacagcaagaatacatccatgtcttttagctgcattgccgtgggaatcatcaccctgtatctcggcgctgttgtgcaggccgacatggggtgtgtcattaactggaaaggaaaggagctgaagtgcggctccgggatcttcgtgacaaatgaggttcatacgtggaccgaacagtacaaatttcaagcggatagccccaagcggctggccacagctattgccggcgcttgggagaacggagtgtgtggcatcagatctaccacacgcatggaaaatcttctctggaaacagattgccaacgagctgaattatatcctgtgggaaaacaatatcaagctcaccgtcgtggttggggacattatcggagtgctggagcagggcaaacggacgcttacccctcagcccatggagctgaagtactcctggaaaacatgggggaaggccaagattgtcaccgctgaaacacaaaacagctctttcatcattgatggacctaacacccccgagtgcccgtccgcgagcagagcctggaatgtgtgggaagtggaggactatggctttggcgtcttcacaaccaacatctggctcaaactgcgcgaagtttacacgcagctgtgtgaccaccggcttatgtccgctgccgtgaaggatgagagagccgtgcacgctgacatggggtactggatcgagtctcagaaaaatggaagctggaagctcgaaaaagcctccctgattgaggtcaagacatgcacctggcctaagtctcataccctgtggagcaacggcgtgctcgaatccgatatgatcattcccaaaagcctggcggggcctatctctcagcacaatcatcgccccggatatcacacacaaaccgctggcccttggcaccttgggaagctggagctcgactttaactactgcgagggaacgacagttgtgattaccgaaaattgtggcacacggggcccctccctgagaaccacaaccgtcagcgggaaactgatccatgagtggtgctgtcgctcttgcacgcttccgcctctccggtatatgggagaagatggctgttggtacgggatggagatcagacccatttccgaaaaggaggagaacatggtgaaaagcctggtttctgccggaagcggcaaggtggacaatttcaccatgggggtcctgtgcctcgccatcctgtttgaagaggtgatgcggggaaagttcggcaaaaagcacatgattgctggcgttttctttacattcgtgcttctgctctccgggcagatcacctggcgcgatatggcccatacactgattatgatcggaagcaacgcgtctgacagaatgggcatgggggtcacctatctggctcttattgccacgtttaaaatccagcccttcctggccctcggatttttcctgcggaagctcacatccagagaaaatctgcttctgggcgtggggctcgctatggccaccacactgcaactgcctgaggatatcgaacagatggctaacggaattgcccttggcctgatggcgctcaaactgatcacccagtttgagacctaccagctctggacagccctgattagccttacgtgttccaataccatgttcacactgaccgtggcttggcgcacagccaccctcatcctggctggcgtctctctgcttccggtttgccaaagctcctctatgcggaagacggactggctgcccatggccgtggccgctatgggggtgcctcccctccctctgtttattttcagcctcaaggatacactgaaaagacgctcctggccccttaacgagggagtcatggcggtgggcctggtttctatcctggccagctccctcctgagaaatgacgtgcctatggctgggccccttgtcgccggaggcctgctcatcgcctgttatgtgattaccgggaccagcgctgatctgacagttgaaaaggccgcggacatcacctgggaggaagaggctgaacagacaggagtgtctcacaacctcatgattacggtcgacgatgacggcaccatgcggatcaaagatgacgagacagagaacattctgaccgtgcttctgaagacagccctgctcatcgtctccggcgtgtttccgtacagcatccctgccaccctgcttgtttggcatacgtggcagaaacagacccaacgctctggggtgctgtgggatgtcccctcccctcccgaaacacagaaggctgagctcgaagagggagtgtacagaattaaacagcagggcatcttcgggaagacccaagttggagtgggcgtccagaaggagggggtgtttcacacaatgtggcacgtgacccggggagccgttctgacatataatggcaaacgcctcgaaccgaactgggcgagcgtcaagaaagacctgatttcttacggcgggggatggagactttccgctcagtggcaaaagggcgaggaagtccaggtgatcgccgtcgagcctgggaaaaatcccaagaacttccagacgatgcctggaaccttccagacaaccaccggcgaaattggggccatcgctctggattttaagcccggaacaagcggctcccccattatcaatcgggagggcaaagtggttgggctgtatggaaacggcgtggtcacgaagaatgggggatacgtgagcggcatcgcccaaaccaacgctgagcctgacgggccgacacccgaactcgaggaagagatgttcaaaaagcgcaatctgaccattatggatcttcatcctggctctggaaaaacaagaaagtatctgcccgccatcgttcgggaagcgattaagcgcagactccggaccctgatcctcgcccctacgagagtggtcgctgccgagatggaggaagctctgaaaggccttcccattcgctaccagacaaccgccaccaagagcgagcacacagggcgggaaatcgtggacctgatgtgccatgccacctttacaatgagactgctctcccctgttcgcgtgccgaactataatctgatcattatggatgaggctcacttcaccgaccccgcgtctatcgccgctcggggatacattagcacgagagtcggcatgggggaagccgccgctatctttatgacagccacccctcccggaacagcggatgctttccctcagtccaacgcccccattcaggacgaggagcgcgacatcccggaacggtcttggaatagcggcaacgagtggatcaccgattttgccgggaaaacggtgtggttcgtgccttccattaaggctggcaatgacatcgccaactgtcttcgcaaaaacggaaagaaggtcattcaactgtctagaaaaacctttgatacagaataccagaagaccaaactcaatgactgggatttcgttgtgacaaccgacatcagcgagatgggcgcgaactttaaggccgatcgggtgattgaccccagacggtgcctgaaacccgtcatcctgacagatgggcctgagcgcgtgattctcgctggacccatgcctgttaccgccgcttccgccgctcagagacggggccgcgtggggagaaatccgcagaaggaaaacgaccaatatatcttcacgggacagccccttaataacgatgaggaccatgcccactggacagaagcgaagatgctgctggacaatatcaacacccctgagggcattatccccgccctcttcgaacctgagcgggagaaaagcgctgccattgatggggaatacagactgaagggcgagtctcgcaaaacctttgtcgaacttatgcggagaggagacctgcccgtgtggctcgctcacaaggttgcctccgagggcatcaaatatacagatcgcaagtggtgcttcgacgggcagcggaataaccagattctggaagagaatatggatgtggagatctggaccaaagaaggagagaagaagaaactgagaccgcgctggctcgacgcccggacatacagcgatcctcttgctctgaaggaatttaaagacttcgcggccggcagaaagtctatcgctctggatctcgtcacggagattgggcgcgtgccctcccatctggcccacagaacccggaacgcccttgacaatctggtcatgctccatacaagcgaacacggaggccgcgcttatagacacgccgtggaggagctgcctgaaaccatggagacactgctccttctgggcctgatgatcctcctgaccgggggagcgatgctttttctgatttccggcaaagggatcggaaagacgtctattggcctcatctgtgttatcgccagctccgggatgctgtggatggctgaaattcccctgcaatggatcgccagcgctattgtgctcgagttctttatgatggtgcttctgatccctgagcccgaaaagcagcggaccccgcaggataaccaactggcctacgtcgttattggaatcctcacactggcggccattatcgctgccaatgagatgggccttctggaaaccacaaaacgcgacctcggcatgtctaaggagcctggggtggtgtcccccaccagctatctggatgtcgacctgcatcccgcttctgcctggacgctctacgctgtggccacaaccgttatcacacctatgcttagacacaccattgaaaacagcaccgcgaatgtgtccctggccgctatcgccaaccaggctgtcgtgctgatgggactcgacaaaggctggccgatttctaagatggatctgggggtcccccttctggccctcggatgctacagccaggtgaaccctctgacactgacggccgcggttctccttctgatcacccattatgctattatcggccccgggctgcaggccaaagctacacgggaggcccaaaagagaaccgccgctggaatcatgaagaatcctacagtggacggcattatgaccatcgatctcgaccccgtcatttacgattccaaattcgagaagcagctgggccaggtgatgcttctggttctctgtgccgtgcagctgctgctcatgcgcacgtcttgggcgctttgcgaagccctgacactggctaccgggcctatcaccacactctgggagggaagcccgggcaaattttggaacaccacaattgccgtctccatggctaatatcttccgggggagctatctggccggagcgggccttgccttttctatcatgaagtccgtggggacgggaaaaagaggcaccggcagccaaggggaaacactgggagagaagtggaagaaaaagctcaaccagctgtcccgcaaagagttcgacctgtacaagaaatctggcattaccgaggtggatcggacagaggctaaggaagggctcaaaagaggagagaccacgcaccatgccgttagccggggctccgctaaacttcagtggtttgtcgaacgcaatatggtgatccccgaggggagagtgattgacctgggatgtggccggggcgggtggtcttattactgcgccggactgaagaaagtcaccgaagttcgcggctatacaaaagggggacctggccacgaggagcccgtgcctatgagcacctacgggtggaacatcgtgaaactcatgtccggaaaggatgtcttctacctgcccccggaaaaatgtgacacacttctgtgcgatattggcgagagctctccttcccccaccgtggaagagagcagaacaatccgggttctcaagatggtggagccctggctgaagaataaccagttctgtattaaagtcctgaatccttatatgcccaccgtgatcgaacacctcgagcgccttcaaagaaagcatggcgggatgctggttcggaaccctctgtctcgcaattccacgcacgaaatgtactggatcagcaacggaacaggcaatattgtggcttctgtcaacatggtgagcagactcctgcttaatcggtttaccatgacccatagacgcccgacaatcgagaaagacgtggatctgggggccggaacgcggcacgtcaacgcggaacccgagacccctaacatggacgttattggcgagagaatcaagcgcattaaagaagaacacaattccacatggcattatgacgatgaaaacccctacaagacctgggcctatcacgggtcttacgaggtgaaggctacaggaagcgcctccagcatgatcaatggcgtggtcaaactcctgaccaagccttgggacgtggttcccatggtgacacagatggctatgaccgatacgaccccgttcggccagcaacgggtctttaaagaaaaggtggacacaagaacccctcgctccatgcccgggacacggagagttatgggaatcaccgccgagtggctgtggcgcacgctcggccggaacaaaaagcctagactgtgcacacgcgaggagttcaccaagaaagtgcggacaaatgccgcgatgggggctgtctttaccgaggaaaaccagtgggattctgccaaggccgctgtggaggacgaagatttctggaaacttgttgacagagagcgcgagctgcataagctcggaaaatgtggcagctgcgtgtataatatgatggggaagagagagaagaagctgggcgagtttggaaaggccaaaggctcccgggctatttggtacatgtggcttggggcccgctacctggagttcgaggcgctcggatttctgaacgaggatcactggttctctagagaaaatagctattccggcgtcgagggggaaggactgcataagctcggctacatcctgcgggacatttctaaaatccccgggggcgccatgtatgctgatgacacggccggatgggacaccagaattacagaggatgaccttcacaacgaagagaagatcacccagcagatggatcctgagcaccggcaactggctaatgccatctttaaactcacataccagaacaaggtggtcaaggtgcagcgccccaccccgacaggcaccgttatggacattatcagcagaaaagatcagcgggggtccggacaagtgggcacgtatgggctgaatacattcaccaacatggaagcgcagcttattcgccagatggagggagaaggcgtcctgagcaaggccgacctcgagaatcctcatctgcccgagaagaagatcacccagtggctggagacaaaaggggtggagagactcaagcggatggctatttctggcgatgactgcgtggttaagcccatcgatgaccgctttgccaacgctctgcttgccctgaacgatatgggaaaagtgagaaaggacatccctcaatggcagccgtccaaaggctggcacgattggcagcaggtccccttctgtagccatcacttccacgaactcattatgaaggacgggcggaaactggtggttccttgccgcccccaagacgagcttatcggacgggctcggatttctcagggcgccgggtggtccctgcgcgaaaccgcgtgtctcggaaaggcctacgctcagatgtggagcctgatgtattttcatagacgggatctgcgcctcgcctctaatgccatctgctccgctgtgcctgtccactgggtgcccacaagcagaacgacctggtccattcatgcccaccatcaatggatgacaaccgaggacatgctgacagtctggaaccgggtgtggatcgaagataatccttggatggaggacaagacccccgttacgacctgggagaacgtgccgtaccttggcaaaagagaagatcagtggtgtgggagcctgattggcctcacatctcgcgcgacctgggctcagaatatccctacagccatccagcaagtccggagcctgattggaaacgaggagttccttgactacatgccctccatgaagagatttcgcaaagaggaggaatctgagggcgccatctggtga

SEQ ID NO: 20825 - RNA, 9873 nt, synthetic construct
  misc_feature 1..9873: note = derived and/or modified CDS sequence (opt5) from DENV-3__EU569689__SS-prME
  source 1..9873: mol_type = other RNA
accagcctgtgcctcatgatgatcctgcccgccgctcttgccttccacctgacgtcccgggacggcgagcctcggatgattgtggggaagaacgaacgcggaaagtctctcctgtttaagacggcgagcggcatcaatatgtgtacccttattgctatggatctgggggaaatgtgcgacgatacagtgacctacaagtgtccgcacatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacatcattggagtgctggagcagggcaaacggacgcttacccctcagcccatggagctgaagtactcttggaaagcctgggggaaggccaagatcgtcacagctgaaacccaaaactccagcttcattatcgatggacctaatacacccgagtgcccgtctgcgtccagagcctggaacgtgtgggaagtggaggactatggctttggcgtcttcaccacaaatatctggctcaaactgcgcgaagtttacacccagctgtgtgaccaccggcttatgagcgctgccgtgaaggatgagagagccgtgcacgctgacatggggtactggattgagtcccagaaaaacggatcttggaagctcgaaaaagccagcctgatcgaggtcaagacgtgcacatggcctaagtcccataccctgtggtctaatggcgtgctcgaaagcgatatgattatccccaaatccctggcggggcctattagccagcacaactatcgccccggataccatacccaaacagctggcccttggcaccttgggaagctggagctcgactttaattattgcgagggaaccacggttgtgatcacagaaaactgtggcacccggggcccctctctgagaacaaccacagtctccgggaaactgatccacgagtggtgctgtcgcagctgcacccttccgcctctccggtacatgggagaagatggctgttggtatgggatggagattagacccatctctgaaaaggaggagaatatggtgaaatccctggttagcgccggatctggcgaagtggacaacttcacgatgggggtcctgtgcctcgccattctgtttgaggaagtgatgcggggaaagttcggcaagaaacatatgatcgctggcgttttctttaccttcgtgcttctgctcagcgggcagattacatggcgcgatctggcccacaccctgatcatgattggatccaatgcgagcgacagaatgggcatgggggtcacataccttgctctgatcgccacctttaagatccagcccttcctcgccctgggatttttcctccggaaactgacgtctagagagaaccttctgctcggcgtggggctggctatggccacaaccctgcaacttcctgaagatattgagcagatggctaatggaatcgccctgggcctcatggcgctgaagctcattacacagtttgagacctatcagctgtggaccgcccttatctccctgacatgtagcaacacgattttcaccctcacagtggcttggcgcaccgccacactgatcctggctggcgtctcccttctgccggtttgccaatctagctccatgcggaaaaccgactggctccccatgacggtggccgccatgggggtgcctcccctgcctctctttatcttctctctgaaggatacacttaagagacgcagctggcccctgaatgaaggagtcatggctgtgggcctggtttccattctcgcgtctagcctgcttagaaacgacgtgcctatggccgggcccctggtcgctggaggcctcctgatcgcctgttacgtgattaccgggacctccgccgatctcacagttgagaaagctgccgacgtgacctgggaagaggaagcggagcagacaggagtcagccataacctgatgatcacggtggacgatgacggcaccatgcggattaaggatgacgagacagaaaatatccttaccgtcctgctgaaaacagctctcctgatcgtgtctggcatttttccgtactccatccctgccacccttctggtttggcacacgtggcagaagcagacccaacgcagcggggtgctctgggatgtcccctctcctcccgagacacagaaagccgaactggaggagggagtgtatagaattaagcagcagggcatcttcgggaaaacccaagttggagtgggcgtccagaaggaaggggtgtttcatacaatgtggcacgtgacccggggagctgttctcacatacaacggcaagcgcctggagccgaattgggcctccgtcaaaaaggaccttattagctatggcgggggatggagactgtctgcgcagtggcaaaaaggcgaagaggtccaggtgatcgctgtcgaacctgggaagaaccccaaaaatttccagacgatgcctggaaccttccagacaaccaccggcgagattggggccatcgccctggattttaagcccggaacatccggcagccccatcattaaccgggagggcaaggtggttgggctctacggaaatggcgtggtcacgaaaaacgggggatatgtgtccggcatcgctcaaaccaatgccgaacctgacgggccgacacccgagctggaagaggaaatgttcaagaaacgcaaccttaccattatggatctgcaccctggcagcggaaagacaagaaaatacctccccgctatcgttcgggaggccattaagcgcagactgcggaccctcatcctggcgcctacgagagtggtcgccgctgagatggaagaggcccttaagggcctgcccatccgctatcagacaaccgctaccaaatctgaacatacagggcgggagattgtggacctgatgtgccacgccacctttacaatgagactcctgagccctgttcgcgtgccgaattacaaccttatcattatggatgaagcccatttcaccgaccccgcttccatcgcggcccggggatacatttctacgagagtcggcatgggggaggctgccgccatctttatgacagctacccctcccggaacagccgatgcgttccctcagagcaatgctcccatccaggacgaggaacgcgacattccggagcggtcctggaactctggcaatgaatggatcaccgattttgccgggaagacggtgtggttcgtgcctagcattaaagccggcaacgacatcgctaactgtctgagaaagaatggcaaaaaggtcattcaactctcccgcaagacctttgatacagagtatcagaaaaccaagctgaacgactgggatttcgttgtgacaaccgacatctctgagatgggagccaattttaaagcggatcgggtgattgaccccagacggtgcctgaagcccgtcatcctcacagatgggcctgaacgcgtgatccttgccggacccatgcctgttaccgctgccagcgctgcccagagacggggccgcgtggggagaaacccgcagaaagagaatgaccaatacattttcacgggacagcccctgaacaatgatgaagaccacgctcattggacagaggccaagatgctgctcgacaacatcaatacccctgaaggcattatccccgcgctgttcgagcctgagcgggaaaagtccgccgctattgatggggagtatagacttaaaggcgaaagccgcaagacctttgtcgagctgatgcggagaggagacctccccgtgtggctggcccacaaagttgcttctgaaggcatcaagtacacagatcgcaaatggtgcttcgacgggcagcggaacaatcagatcctggaggagaacatggatgtggaaatttggaccaaggagggagagaagaagaagctcagaccgcgctggcttgacgcccggacatattccgatcctctggccctgaaagagtttaaggacttcgctgcgggcagaaaaagcatcgccctcgatctggtcacggaaattgggcgcgtgcccacccaccttgctcatagaacacggaatgccctggacaacctcgtcatgctgcacacctctgagcatggaggcaaggcctaccgccacgctgtggaggaactgcctgagacaatggaaaccctccttctgctgggcctcatgatcctgcttacagggggagccatgctgtttctcatttccggcaaagggatcggaaagaccagcatcggcctgatttgtgttatcgcgtcctctgggatgctgtggatggccgagattcccctccaatggatcgctagcgccattgtgcttgagttctttatgatggtgctgctgatccctgaacccgagaagcagagaacaccgcaggataatcaactcgcttatgtcgttattggaatcctgacccttgccgcgatcattgccgctaacgaaatgggcctgctcgagacaaccaaacgggacctgggcatgtccaaggaacctggggtggtgagccccacgtcttacctggatgtcgacctccaccccgcctccgcttggacactttacgccgtggctaccacagttatcacccctatgctgcgccataccattgagaatagcacagccaacgtgtctctggcggccatcgctaaccaggccgtcgtgctcatgggactggacaaaggctggccgattagcaagatggatcttggggtccccctgctcgctctgggatgctattcccaggtgaatcctctgacgctcaccgccgccgttcttctgctgatcacacactacgcgatcattggccccgggctccaggctaaagccaccagagaggctcaaaagcggacagccgccggaatcatgaagaaccctaccgtggacggcattatgacgatcgatctggaccccgtcatttatgattctaaattcgaaaagcagcttggccaggtgatgctgctcgttctgtgtgctgtgcagctgctccttatgagaacaagctgggccctgtgcgaggcgctgaccctcgccaccgggcctatcacaaccctgtgggaaggatccccgggcaaattttggaatacaacgatcgctgtctctatggccaacattttccgcgggagctaccttgctggagccggcctggcgttttccatcatgaaaagcgtggggaccggaaaacggggcacaggctctcaaggggagaccctcggagaaaagtggaagaaaaagctgaatcagctgtccagaaaagagttcgacctctataagaaaagcggcattacagaggtggatcgcaccgaagccaaggaggggcttaaacggggagaaatcacgcatcacgctgtttccagaggctctgccaagctgcagtggtttgtcgagcggaacatggtgattcccgaagggcgcgtgatcgacctgggatgtggcagaggcgggtggagctactattgcgctggactcaagaaagtcaccgaggttcggggctacacaaaagggggacctggccatgaggaacccgtgcctatgtccacctacgggtggaatattgtgaaactgatgtctggaaaggatgtcttctatcttcccccggagaaatgtgacacactgctctgcgatatcggcgaaagctcccctagccccaccgtggaggagtctcgcacaatcagagttctgaagatggtggaaccctggctgaagaacaatcagttctgtattaaagtcctcaacccttacatgcccaccgtgatcgagcaccttgaacggctgcaacgcaagcacggcgggatgctggttagaaatcctctctcccggaacagcacgcatgagatgtattggatttctaatggaacaggcaacatcgtggcctccgtcaatatggtgagccgcctgcttctgaacagatttaccatgacccaccggagaccgacaattgaaaaagacgtggatctcggggctggaacgcgccatgtcaacgccgagcccgagacccctaatatggacgttatcggcgaacggatcaagagaattaaagaggaacacaactctacatggcactacgacgatgagaatccctataagacctgggcgtaccatgggagctatgaagtgaaggccacaggatccgcttctagcatgatcaacggcgtggtcaaactgctgaccaagccttgggacgtggttcccatggtgacacagatggccatgaccgatacgaccccgttcggccagcaacgcgtctttaaagagaaggtggacacacggacccctagatccatgcccgggacacgccgggttatgggaattaccgctgagtggctctggagaacgctgggccgcaataaaaagcctcggctttgcacaagagaagagttcaccaagaaagtgcgcacaaacgccgccatgggggcggtctttaccgaagagaatcagtgggatagcgctaaggccgccgtggaagacgaggatttctggaaactggttgaccgggagagagaactccacaagctgggaaaatgtggctcctgcgtgtacaacatgatggggaagcgcgagaagaaacttggcgaatttggaaaagctaaaggctctagagccatctggtacatgtggctgggggctcggtatctcgagttcgaggccctgggatttctgaatgaagatcattggttcagccgcgagaactcctactctggcgtcgaaggggagggactccacaagctgggctatattcttagagacatcagcaaaatccccgggggcgcgatgtacgccgatgacacggctggatgggacacccggattacagaagatgacctgcataatgaggagaagatcacccagcagatggatcctgaacacagacaactcgccaacgctatttttaaactgacatatcagaataaggtggtcaaggtgcagcggcccaccccgacaggcaccgttatggacatcatttcccgcaaagatcagagagggtctggacaagtgggcacgtacgggcttaacacattcaccaatatggaggcccagctgatccggcagatggaaggagagggcgtcctcagcaaggcggacctggaaaaccctcatctgcccgagaaaaagatcacccagtggctcgagacaaaaggggtggaacgcctgaagagaatggccatttccggcgatgactgcgtggttaagcccatcgatgaccggtttgctaacgcccttctggctctcaatgatatgggaaaagtgcgcaaggacattcctcaatggcagccgagcaaaggctggcatgattggcagcaggtccccttctgttctcaccatttccacgagctgatcatgaaggacgggagaaaacttgtggttccttgccggccccaagacgaactgattggacgcgccagaatctcccagggcgctgggtggagcctccgggagaccgcctgtctgggaaaggcgtatgcccagatgtggtctctgatgtactttcaccgcagagatctccggctggcttccaacgccatttgcagcgccgtgcctgtccattgggtgcccacatctcgcacgacctggtccatccacgctcatcaccaatggatgacaaccgaagacatgcttacagtctggaatagagtgtggatcgaggataacccttggatggaggacaagacccccgttacgacctgggaaaatgtgccgtacctgggcaaacgggaggatcagtggtgtgggagcctcattggcctgacatccagagccacctgggcgcagaacatccctacagctattcagcaagtccgcagccttatcggaaatgaagagttcctggactatatgccctctatgaagcggtttagaaaagaggaagagagcgaaggcgccatttggtga

SEQ ID NO: 20826 - RNA, 9873 nt, synthetic construct
  misc_feature 1..9873: note = derived and/or modified CDS sequence (opt5) from DENV-3__EU482614__SS-prME
  source 1..9873: mol_type = other RNA
accagcctgtgcctcatgatgatcctgcccgccgctcttgccttccacctgacgtcccgggacggcgaacctcggatgattgtggggaagaacgaacgcggaaagtctctcctgtttaagacggcgagcggcatcaatatgtgtacccttattgctatggatctgggggagatgtgcgacgatacagtgacctacaaatgtccgcatatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgttccctgtaaaattcctttcagcaccgaggacggccaagggaaggcccataacggaagactgatcacagcgaatcccgtggtcaccaaaaaggaggaacccgtgaacattgaggctgaacctccgttcggcgagtccaatatcgtgattgggatcggcgataacgccctgaaaatcaattggtataagaagggatctagcattggcaaaatgtttgaagccacggctagaggggccagacgcatggctatccttggagacacagcctgggatttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgacatggggtgtgtcatcaattggaaaggaaaggagctgaagtgcggcagcgggattttcgtgacaaacgaggttcatacgtggaccgaacagtacaaatttcaagccgattcccccaagcggctggcgacagccatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacatcattggagtgctggagcagggcaaacggacgcttacccctcagcccatggagctgaagtactcttggaaaacatgggggaaggccaagatcgtcaccgccgaaacacaaaactccagcttcattatcgatggacctaatacccccgagtgcccgtctgcttccagagcgtggaacgtgtgggaagtggaggactatggctttggcgtcttcacaaccaatatctggctcaaactgcgcgaagtttacacgcagctgtgtgaccaccggcttatgagcgccgctgtgaaggatgagagagccgtgcacgccgacatggggtactggattgagtcccagaaaaacggatcttggaagctcgaaaaagctagcctgatcgaggtcaagacatgcacctggcctaagtcccataccctgtggtctaatggcgtgctcgaaagcgatatgattatccccaaatccctggccgggcctattagccagcacaactatcgccccggataccatacacaaaccgcgggcccttggcaccttgggaagctggagctcgactttaattattgcgagggaacgacagttgtgatcaccgaaaactgtggcacacggggcccctctctgagaaccacaaccgtctccgggaaactgatccacgagtggtgctgtcgcagctgcacgcttccgcctctccggtacatgggagaagatggctgttggtatgggatggagattagacccatctctgaaaaggaggagaatatggtgaaatccctggttagcgctggatctggcgaagtggacaacttcaccatgggggtcctgtgcctcgccattctgtttgaggaagtgatgcggggaaagttcggcaagaaacatatgatcgccggcgttttctttacattcgtgcttctgctcagcgggcagattacctggcgcgatatggctcacacactgatcatgattggatccaatgccagcgacagaatgggcatgggggtcacctacctggcgcttatcgctacgtttaagatccagcccttcctggccctcggatttttcctgcggaaactcacatctagagagaacctgcttctgggcgtggggctcgccatggctaccacactgcaactgcctgaagatattgagcagatggccaatggaatcgctcttggcctgatggccctcaagctgattacccagtttgagacctatcagctctggacagcgctgatctcccttacgtgtagcaacaccattttcacactgaccgtggcctggcgcacagctaccctcatcctggccggcgtctccctgcttccggtttgccaatctagctccatgcggaaaacggactggctgcccatgacagtggctgccatgggggtgcctcccctccctctgtttatcttctctctcaaggataccctgaagagacgcagctggccccttaatgaaggagtcatggccgtgggcctggtttccattctggcttctagcctcctgagaaacgacgtgcctatggcggggccccttgtcgccggaggcctgctcatcgcttgttacgtgattaccgggacatccgccgatctgaccgttgagaaagccgctgacgtgacatgggaagaggaagccgagcagacgggagtcagccataacctcatgatcaccgtggacgatgacggcacaatgcggattaaggatgacgagaccgaaaatatcctgacagtccttctgaaaaccgcgctgctcatcgtgtctggcatttttccgtactccatccctgctacgctgcttgtttggcacacctggcagaagcagacacaacgcagcggggtgctgtgggatgtcccctctcctcccgagacccagaaagccgaactcgaggagggagtgtatagaattaagcagcagggcatcttcgggaaaacacaagttggagtgggcgtccagaaggaaggggtgtttcataccatgtggcacgtgacacggggagccgttctgacgcacaacggcaagcgcctcgagccgaattgggcttccgtcaaaaaggacctgattagctacggcgggggatggagactttctgcccagtggcaaaaaggcgaagaggtccaggtgatcgcggtcgaacctgggaagaaccccaaaaatttccagaccatgcctggaacattccagaccaccacaggcgagattggggctatcgccctggattttaagcccggaacgtccggcagccccatcattaaccgggagggcaaggtggttgggctgtatggaaatggcgtggtcaccaaaaacgggggatacgtgtccggcatcgcccaaacaaatgctgaacctgacgggccgacccccgagctcgaagaggaaatgttcaagaaacgcaacctgacaattatggatcttcatcctggcagcggaaagaccagaaaatatctgcccgccatcgttcgggaggctattaagcgcagactccggacgctgatcctcgcccctacaagagtggtcgcggccgagatggaagaggctctgaagggccttcccatccgctaccagaccaccgccacaaaatctgaacacaccgggcgggagattgtggacctgatgtgccatgctacatttaccatgagactgctcagccctgttcgcgtgccgaattataacctgatcattatggatgaagcccacttcacggaccccgcctccatcgctgcgcggggatacatttctacaagagtcggcatgggggaggccgctgccatctttatgaccgccacacctcccggaaccgctgatgccttccctcagagcaatgcgcccatccaggacgaggaacgcgacattccggagcggtcctggaactctggcaatgaatggatcacggattttgctgggaagaccgtgtggttcgtgcctagcattaaagccggcaacgacatcgccaactgtcttagaaagaatggcaaaaaggtcattcaactgtcccgcaagacatttgataccgagtaccagaaaacaaagctcaacgactgggatttcgttgtgaccacagacatctctgagatgggagctaattttaaagccgatcgggtgattgaccccagacggtgcctgaagcccgtcatcctgaccgatgggcctgaacgcgtgatcctcgcgggacccatgcctgttacggccgctagcgccgctcagagacggggccgcgtggggagaaacccgcagaaagagaatgaccaatatattttcacaggacagccccttaacaatgatgaagaccatgcccactggaccgaggctaagatgctgctggacaacatcaatacccctgaaggcattatccccgccctcttcgagcctgagcgggaaaagtccgcggccattgatggggagtacagactgaaaggcgaaagccgcaagacatttgtcgagcttatgcggagaggagacctgcccgtgtggctcgctcacaaagttgcctctgaaggcatcaagtataccgatcgcaaatggtgcttcgacgggcagcggaacaatcagatcctggaggagaacatggatgtggaaatttggacaaaggagggagagaagaagaagctgagaccgcgctggctcgacgctcggacgtactccgatcctcttgccctgaaagagtttaaggacttcgccgctggcagaaaaagcatcgcgctggatctcgtcaccgaaattgggcgcgtgccctctcatctggcccacagaacacggaatgctcttgacaacctggtcatgctccatacctccgagcacggaggcaaggcctatcgccacgccgtggaggaactgcctgagacaatggaaaccctgctccttctgggcctgatgatcctcctgacagggggagctatgctttttctgattagcggcaaagggatcggaaagacctccatcggcctcatttgtgttatcgcctctagcgggatgctgtggatggcggagattcccctgcaatggatcgcctccgctattgtgctcgagttctttatgatggtgcttctgatccctgaacccgagaagcagagaacaccgcaggataatcaactggcctacgtcgttattggaatcctcaccctggctgccatcattgcggccaacgaaatgggccttctggagacaaccaaacgggacctcggcatgagcaaggaacctggggtggtgtctcccacgtcctatctggatgtcgacctgcatcccgctagcgcctggacactctacgctgtggccaccacagttatcacccctatgcttcgccacaccattgaaaattctacagctaacgtgagcctggccgcgatcgccaaccaggctgtcgtgctgatgggactcgacaaaggctggccgatttccaagatggatctgggggtcccccttctggccctcggatgctactctcaggtgaatcctctgacgctgaccgctgccgttctccttctgatcacacattatgccatcattggccccgggctgcaggcgaaagctaccagagaggcccaaaagcggacagctgccggaatcatgaagaaccctaccgtggacggcattatgacgatcgatctcgaccccgtcatttacgatagcaaattcgagaagcagctgggccaggtgatgcttctggttctctgtgccgtgcagctgctgctcatgagaacatcctgggctctttgcgaggccctgaccctggcgaccgggcctatcacaaccctctgggaaggatctccgggcaaattttggaatacaacgatcgccgtcagcatggctaacattttccgcgggtcctatctggccggagctggccttgcctttagcatcatgaagtctgtggggaccggaaaacggggcacaggctcccaaggggagaccctgggagaaaagtggaagaaaaagctcaatcagctgagcagaaaagagttcgacctgtacaagaaatccggcattacagaggtggatcgcaccgaagcgaaggaggggctcaaacggggagaaatcacgcaccatgccgtttctagaggcagcgctaaacttcagtggtttgtcgagcggaacatggtgattcccgaagggcgcgtgatcgacctgggatgtggcagaggcgggtggtcctattactgcgccggactgaagaaagtcaccgaggttcggggctatacaaaagggggacctggccacgaggaacccgtgcctatgtctacctacgggtggaatattgtgaaactcatgagcggaaaggatgtcttctacctgcccccggagaaatgtgacacacttctgtgcgatatcggcgaatccagcccttctcccaccgtggaggagtcccgcacaatcagagttctcaagatggtggaaccctggctgaagaacaatcagttctgtattaaagtcctgaacccttatatgcccaccgtgatcgagcacctcgaacggcttcaacgcaagcatggcgggatgctggttagaaatcctctgagccggaactctacgcacgagatgtactggatttccaatggaacaggcaacatcgtggctagcgtcaatatggtgtctcgcctcctgcttaacagatttaccatgacccatcggagaccgacaattgaaaaagacgtggatctgggggccggaacgcgccacgtcaacgctgagcccgagacccctaatatggacgttatcggcgaacggatcaagagaattaaagaggaacacaacagcacatggcattatgacgatgagaatccctacaagacctgggcctatcacgggtcctacgaagtgaaggcgacaggatctgccagctccatgatcaacggcgtggtcaaactcctgaccaagccttgggacgtggttcccatggtgacacagatggctatgaccgatacgaccccgttcggccagcaacgcgtctttaaagagaaggtggacacacggacccctagaagcatgcccgggacacgccgggttatgggaattaccgccgagtggctgtggagaacgctcggccgcaataaaaagcctcggctgtgcacaagagaagagttcaccaagaaagtgcgcacaaacgctgccatgggggccgtctttaccgaagagaatcagtgggattccgcgaaggctgccgtggaagacgaggatttctggaaacttgttgaccgggagagagaactgcataagctcggaaaatgtggctcttgcgtgtataacatgatggggaagcgcgagaaaaagctgggcgaatttggaaaggccaaaggcagcagagctatctggtacatgtggcttggggcccggtacctggagttcgaggctctcggatttctgaatgaagatcactggttctcccgcgagaactcttatagcggcgtcgaaggggagggactgcataagctcggctacattctgagagacatctccaaaatccccgggggcgccatgtatgcggatgacacggccggatgggacacccggattacagaagatgaccttcacaatgaggagaagatcacccagcagatggatcctgaacacagacaactggctaacgccatttttaaactcacataccagaataaggtggtcaaggtgcagcggcccaccccgacaggcaccgttatggacatcatttctcgcaaagatcagagagggagcggacaagtgggcacgtatgggctgaacacattcaccaatatggaggctcagcttatccggcagatggaaggagagggcgtcctgtccaaggccgacctcgaaaaccctcatctgcccgagaaaaagatcacccagtggctggagacaaaaggggtggaacgcctcaagagaatggcgattagcggcgatgactgcgtggttaagcccatcgatgaccggtttgccaacgctctgcttgccctgaatgatatgggaaaagtgcgcaaggacattcctcaatggcagccgtctaaaggctggcacgattggcagcaggtccccttctgttcccatcacttccacgagctcatcatgaaggacgggagaaaactggtggttccttgccggccccaagacgaacttattggacgcgctagaatcagccagggcgccgggtggtctctgcgggagaccgcttgtctcggaaaggcctacgcgcagatgtggtccctgatgtattttcatcgcagagatctgcggctcgccagcaacgctatttgctctgccgtgcctgtccactgggtgcccacatcccgcacgacctggagcatccatgcccaccatcaatggatgacaaccgaagacatgctgacagtctggaatagagtgtggatcgaggataacccttggatggaggacaagacccccgttacgacctgggaaaatgtgccgtaccttggcaaacgggaggatcagtggtgtgggtccctgattggcctcacaagcagagctacctgggcccagaacatccctacagcgattcagcaagtccgctctctgatcggaaatgaagagttccttgactacatgcccagcatgaagcggtttagaaaagaggaagagtccgaaggcgctatttggtga

SEQ ID NO: 20827 - RNA, 9873 nt, synthetic construct
  misc_feature 1..9873: note = derived and/or modified CDS sequence (opt5) from DENV-3__EU569690__SS-prME
  source 1..9873: mol_type = other RNA
accagcctgtgcctcatgatgatcctgcccgccgctcttgccttccacctgacatcccgggacggcgagcctcggatgattgtggggaagaacgaacgcggaaaatctctcctgtttaagacggcgagcggcatcaatatgtgtacccttattgctatggatctgggggagatgtgcgacgatacagtgacctacaaatgtccgcacatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggatacccggacacaaacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgcggtgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggtctcggaaagagcttctggtgacatttaagaatgctcacgcgaaaaagcaagaagtcgtggttctcgggtcccaggagggagccatgcacaccgctctgacaggcgccaccgaaatccagaacagcgggggcacctctattttcgccggacatctgaagtgtcgcctcaaaatggacaagctggagcttaaaggcatgtcctacgctatgtgcacaaatacgtttgtgctgaagaaagaggtcagcgaaacccagcacgggacaatcctcatcaaggtggagtacaagggagaagatgttccctgtaaaattcctttctccaccgaggacgagcaaggcaaggcccataacgggagactgatcacagcgaaccccgtggtcaccaaaaaggaagaacccgtgaatattgaagctgagcctccgttcggagaatctaacatcgtgattggcatcggggataatgccctgaaaatcaactggtataagaagggcagctccattggaaaaatgtttgaggccacggctcggggcgccagacgcatggctatccttggggacacagcctgggatttcggaagcgttggcggggtcctcaattctctgggaaagatggtgcaccagatttttggctccgcgtacaccgccctgttcagcggggtgtcttgggtcatgaaaatcggcattggagtgctcctgacctggatcggccttaacagcaagaatacatccatgtcttttagctgcattgctatcgggatcattaccctgtatctcggagccgttgtgcaggctgacatgggctgtgtcatcaactggaaagggaaggagctgaagtgcggatccggcattttcgtgacaaatgaagttcatacgtggaccgagcagtacaaatttcaagccgatagccccaagcggctggcgacagccatcgctggggcctgggaaaacggcgtgtgtggaattagatctaccacacgcatggagaatcttctctggaaacagatcgctaacgaactgaattatatcctgtgggagaacaatattaagctcaccgtcgtggttggcgacatcattggggtgctggagcagggaaaacggacgcttatccctcagcccatggaactgaagtactcctggaaaacctggggcaaggccaagattgtcacagccgagacccaaaacagctctttcatcatcgatgggcctaacacacccgaatgcccgtccgctagcagagcgtggaatgtgtgggaggtggaagactatggatttggcgtcttcaccacaaacatttggctcaaactgcgcgaggtttacacccagctgtgtgaccaccggcttatgtccgccgctgtgaaggatgagagagccgtgcacgccgacatgggctactggatcgaatctcagaaaaatgggagctggaagctcgagaaggcttccctgattgaagtcaagacgtgcacatggcctaagtctcataccctgtggagcaacggagtgctcgagtccgatatgatcattcccaaaagcctggccggccctatctctcagcacaattatcgccccgggtaccatacccaaacagcgggaccttggcaccttggcaagctggagctcgactttaactattgcgaagggaccacggttgtgatcacagagaattgtggaacccggggcccctccctgagaacaaccacagtcagcggcaaactgattcacgaatggtgctgtcgctcttgcacccttccgcctctccggtacatgggggaggatggatgttggtatggcatggaaatcagacccatttccgagaaggaggaaaacatggtgaaaagcctggtttctgctgggagcggagaggtggacaatttcacgatgggcgtcctgtgcctcgccatcctgtttgaagaggtgatgcgggggaagttcggaaagaaacatatgattgccggcgttttctttaccttcgtgcttctgctctccggccagatcacatggcgcgatatggctcacaccctgattatgatcgggagcaacgcctctgacagaatgggaatgggcgtcacatacctggcgcttatcgctacctttaagattcagcccttcctggccctcgggtttttcctgcggaaactcacgtccagagaaaatctgcttctgggagtgggcctcgccatggctacaaccctgcaactgcctgaggatatcgagcagatggccaacgggattgctcttggactgatggccctcaagctgatcacacagtttgaaacctatcagctctggaccgcgctgattagccttacatgttccaatacgatcttcaccctgacagtggcctggcgcaccgctacactcatcctggccggcgtctctctgcttccggtttgccaaagctcctctatgcggaaaaccgactggctgcccatgacggtggctgccatgggcgtgcctcccctccctctgtttattttcagcctcaaggatacactgaagagacgctcctggccccttaacgagggggtcatggccgtgggactggtttctatcctggctagctccctcctgagaaatgacgtgcctatggcgggcccccttgtcgccgggggactgctcattgcttgttacgtgatcaccggcaccagcgccgatctgacagttgaaaaagccgctgacgtgacctgggaggaagaggccgagcagacaggggtctctcataacctcatgattacggtggacgatgacggaaccatgcggatcaaggatgacgaaacagagaacatcctgaccgtccttctgaaaacagcgctgctcattgtgtccggcatctttccgtacagcattcctgctaccctgcttgtttggcacacgtggcagaagcagacccaacgctctggcgtgctgtgggatgtcccctcccctcccgaaacacagaaagccgagctcgaggaaggggtgtatagaatcaagcagcagggaattttcggcaaaacccaagttggggtgggagtccagaaggagggcgtgtttcatacaatgtggcacgtgaccagaggggccgttctgacatacaatggaaagcgcctcgaaccgaactgggctagcgtcaaaaaggacctgatctcttatggcggcgggtggagactttccgcccagtggcaaaaaggagaggaagtccaggtgattgcggtcgagcctggcaagaatcccaaaaacttccagacgatgcctgggaccttccagacaaccaccggagagatcggcgctatcgccctggattttaagcccgggacaagcggatcccccattatcaatcgggaaggcaaggtggttggcctgtacgggaacggagtggtcacgaaaaatggcgggtatgtgagcggaattgcccaaaccaacgctgagcctgacggcccgacacccgaactcgaggaagagatgttcaagaaacgcaatctgaccatcatggatcttcaccctgggtctggcaagacaagaaaatacctgcccgccattgttcgggaggctatcaagcgcagactccggaccctgatcctcgcccctacgagagtggtcgcggccgaaatggaggaagctctgaagggacttcccattcgctatcagacaaccgccaccaaaagcgagcatacaggccgggaaatcgtggacctgatgtgccacgctacctttacaatgagactgctctcccctgttcgcgtgccgaactacaatctgattatcatggatgaggcccatttcaccgaccccgcctctattgctgcgcgggggtacatcagcacgagagtcggaatgggcgaggccgctgccatctttatgacagccacccctcccgggacagctgatgccttccctcagtccaacgcgcccattcaggacgaagaacgcgacatcccggaacggtcttggaatagcggaaacgagtggattaccgattttgctggcaagacggtgtggttcgtgccttccatcaaagccgggaatgacattgccaactgtcttagaaagaacggcaaaaaggtcatccaactgtctcgcaagacctttgatacagagtatcagaaaaccaagctcaatgactgggatttcgttgtgacaaccgacattagcgaaatgggagctaactttaaagccgatcgggtgatcgaccccagacggtgcctgaagcccgtcatcctgacagatggccctgagcgcgtgattctcgcggggcccatgcctgttaccgccgcttccgccgctcagagacggggacgcgtgggcagaaatccgcagaaagaaaacgaccaatacatcttcacggggcagccccttaataacgatgaggaccacgcccattggacagaagctaagatgctgctggacaatattaacacccctgagggaatcattcccgccctcttcgagcctgaacgggagaaaagcgcggccatcgatggcgaatatagactgaaaggggaatctcgcaagacctttgtcgaacttatgcggagaggcgacctgcccgtgtggctcgctcacaaagttgcctccgagggaatcaagtacacagatcgcaaatggtgcttcgacggccagcggaataaccagattctggaggaaaatatggatgtggagatctggaccaaggaaggggagaaaaagaagctgagaccgcgctggctcgacgctcggacatatagcgatcctcttgccctgaaagaatttaaggacttcgccgctggaagaaaatctattgcgctggatctcgtcacggagatcggccgcgtgcccacccacctggcccatagaacacggaacgctcttgacaatctggtcatgctccacacctccgagcatgggggaaaggcctaccgccacgccgtggaggaactgcctgaaacaatggagaccctgctccttctgggcctgatgattctcctgacgggcggggctatgctttttctgatcagcggaaaaggcatcgggaagacctccattggactcatctgtgttattgcctctagcggcatgctgtggatggcggagatccccctgcaatggattgcctccgctatcgtgctcgagttctttatgatggtgcttctgattcctgagcccgaaaagcagagaacaccgcaggataaccaactggcctatgtcgttatcgggatcctcaccctggctgccattatcgcggccaatgagatgggacttctggaaacaaccaaacgggacctcggcatgagcaaggagcctggcgtggtgtctcccacgtcctacctggatgtcgacctgcaccccgctagcgcctggacactctacgctgtggccaccacagttattacccctatgcttcgccataccatcgagaactctacagctaatgtgagcctggccgcgattgccaaccaggctgtcgtgctgatggggctcgacaaaggatggccgatctccaagatggatctgggcgtcccccttctggccctcgggtgctattctcaggtgaaccctctgacgctgaccgctgccgttctccttctgatcacacactacgccattatcggacccggcctgcaggcgaaagctaccagagaagcccaaaagcggacagctgccgggattatgaagaatcctaccgtggacggaatcatgacgattgatctcgaccccgtcatctatgatagcaaattcgagaagcagctgggccaggtgatgcttctggttctctgtgccgtgcagctgctgctcatgagaacatcctgggctctttgcgaagccctgaccctggcgaccggccctatcacaaccctctgggaggggtctccgggaaaattttggaacacaacgattgccgtcagcatggctaatatcttccgcggctcctacctggccggggctggacttgcctttagcattatgaagtctgtgggcaccgggaaacggggaacaggctcccaaggcgaaaccctgggggagaagtggaagaaaaagctcaaccagctgagcagaaaagagttcgacctgtataagaaatccggaatcacagaagtggatcgcaccgaggcgaaggaaggcctcaaaagaggggaaattacgcatcacgccgtttctagaggaagcgctaaacttcagtggtttgtcgaacggaatatggtgatccccgagggccgcgtgattgacctggggtgtggaagaggcggctggtcctactattgcgccgggctgaagaaagtcaccgaggttcggggatacacaaagggcgggcctggacatgaggaacccgtgcctatgtctacctacggctggaacatcgtgaaactcatgagcgggaaggatgtcttctatctgcccccggaaaaatgtgacacacttctgtgcgatatcggagagtccagcccttctcccaccgtggaggaatcccgcacaattagagttctcaagatggtggagccctggctgaagaataaccagttctgtatcaaagtcctgaatccttacatgcccaccgtgattgaacacctcgagcggcttcaacgcaagcacggcggcatgctggttagaaaccctctgagcagaaattctacgcatgaaatgtattggatctccaacgggacaggaaatattgtggctagcgtcaacatggtgtctcgcctcctgcttaatagatttaccatgacccaccggagaccgacaatcgagaaagacgtggatctgggcgccgggacgcgccatgtcaacgctgagcccgaaacccctaacatggacgttatcggagagcggattaagagaatcaaagaggagcacaatagcacatggcactacgacgatgaaaacccctataagacctgggcctaccatggctcctatgaggtgaaggcgacagggtctgccagctccatgattaatggagtggtcaaactcctgaccaagccttgggacgtggttcccatggtgacacagatggctatgaccgatacgaccccgttcggccagcaacgcgtctttaaagagaaggtggacacacggacccctagaagcatgcccggcacacgccgggttatggggatcaccgccgaatggctgtggagaacgctcggacgcaacaaaaagcctcggctgtgcacaagagaggagttcaccaagaaagtgcgcacaaatgctgccatgggcgccgtctttaccgaggaaaaccagtgggattccgcgaaggctgccgtggaggacgaggatttctggaaacttgttgaccgggaaagagagctgcacaagctcgggaaatgtggatcttgcgtgtacaatatgatgggcaagcgcgagaagaagctgggggagtttggcaaggccaaaggaagcagagctatttggtacatgtggcttggcgcccggtatctggagttcgaagctctcgggtttctgaacgaggatcattggttctcccgcgaaaattcttacagcggagtcgagggcgaagggctgcacaagctcggatatatcctgagagacatctccaaaattcccggcggggccatgtacgcggatgacacggccggctgggacacccggatcacagaggatgaccttcataacgaggaaaagattacccagcagatggatcctgagcacagacaactggctaatgccatctttaaactcacatatcagaacaaggtggtcaaggtgcagcggcccaccccgacaggaaccgttatggacattatctctcgcaaagatcagagaggcagcgggcaagtgggaacgtacggcctgaatacattcaccaacatggaagctcagcttatccggcagatggagggggaaggagtcctgtccaaggccgacctcgagaatcctcatctgcccgagaaaaagattacccagtggctggaaacaaaaggcgtggagcgcctcaagagaatggcgatcagcggggatgactgcgtggttaagcccattgatgaccggtttgccaacgctctgcttgccctgaacgatatgggcaaagtgcgcaaggacatccctcaatggcagccgtctaaaggatggcatgattggcagcaggtccccttctgttcccaccatttccacgaactcattatgaaggacggcagaaaactggtggttccttgccggccccaagacgagcttatcgggcgcgctagaattagccagggagccggctggtctctgcgggaaaccgcttgtctcgggaaggcctatgcgcagatgtggtccctgatgtactttcaccgcagagatctgcggctcgccagcaatgctatctgctctgccgtgcctgtccattgggtgcccacatcccgcacgacctggagcatccacgcccatcaccaatggatgacaaccgaggacatgctgacagtctggaacagagtgtggattgaggataatccttggatggaagacaagacccccgttacgacctgggagaacgtgccgtaccttggaaaacgggaagatcagtggtgtggctccctgatcgggctcacaagcagagctacctgggcccagaatattcctacagcgatccagcaagtccgctctctgattggcaacgaggagttccttgactatatgcccagcatgaagcggtttagaaaagaagaggaatccgagggagctatctggtga

SEQ ID NO: 20828 - RNA, 9873 nt, synthetic construct
  misc_feature 1..9873: note = derived and/or modified CDS sequence (opt5) from DENV-3__EU569691__SS-prME
  source 1..9873: mol_type = other RNA
accagcctgtgcctcatgatgatcctgcccgccgctcttgccttccacctgacatcccgggacggagaacctcggatgattgtggggaagaacgaacgcggaaagtctctcctgtttaagacggcgagcggcaccaatatgtgtacacttatcgctatggatctgggggagatgtgcgacgataccgtgacatacaagtgtccgcatattaccgaagttgagcccgaagacatcgattgctggtgtaacctcacatccacctgggtgacgtatggaacctgcaatcaggccggcgagcacagacgggacaagcgctctgtggccctggctcctcatgtcgggatgggactggatacaagaacccagacatggatgagcgccgagggcgcttggagacaggtggaaaaagttgagacctgggccctccgccaccccggcttcacgattctggcgctttttctggcccattacatcgggacatccctcacccagaaggtggtcatcttcattctgcttatgctggtgacaccttctatgaccatgagatgtgttggagtgggcaaccgggactttgtcgaagggctcagcggagctacctgggtggatgtggtcctggagcacggcgggtgcgttacaacgatggccaagaataaacccaccctggacatcgagctccagaagacagaagctacccaactggccacacttcgcaaactgtgtattgagggaaagatcaccaacattacgacagattccagatgccctacccagggcgaagcggtgctcccggaggaacaggaccagaattatgtgtgtaaacacacctacgtcgatcggggctgggggaacggatgcggcctgttcgggaagggaagccttgtgacatgcgccaagtttcaatgtctggagcccatcgagggcaaagttgtgcagtatgaaaatctcaagtacaccgtcattatcacagtgcatacgggggaccagcaccaggttggaaacgagacccaaggcgtgacagctgaaatcacccctcaggcctctacaaccgaggctattctgcccgaatatggcacgctggggctcgagtgctcccctcgcaccggactggacttcaatgagatgatccttctgacaatgaaaaacaaggcctggatggtccatagacagtggtttttcgatctccccctgccgtggaccagcggcgccacaaccgaaacgcctacatggaatcggaaagagcttctggtgacctttaagaacgctcacgcgaaaaagcaagaagtcgtggttctcgggtctcaggagggagccatgcacacagctctgaccggcgccaccgaaattcaaaattccgggggcacaagcatcttcgccggacatctgaagtgtcgcctcaaaatggacaagctggagcttaaaggcatgtcttacgctatgtgcacgaacacctttgtgctgaagaaagaggtctccgaaacacagcacgggaccattctcatcaaggtggagtacaagggagaagatgttccctgtaaaatccctttcagcacagaggacggccaagggaaggcccataacggaagactgattaccgcgaatcccgtggtcacgaaaaaggaggaacccgtgaacatcgaggctgaacctccgttcggcgagtccaatattgtgatcgggattggcgataacgccctgaaaatcaattggtataagaagggatctagcatcggcaaaatgtttgaagccacagctagaggggccagacgcatggctattcttggagacaccgcctgggatttcggctccgttgggggagtcctcaacagcctgggcaagatggtgcaccagatctttgggtctgcgtacaccgccctgttctccggcgtgagctgggtcatgaaaattggaatcggcgtgctcctgacatggattgggcttaattctaagaacaccagcatgtccttttcttgcatcgctattggaatcatcacactgtatctcggcgccgttgtgcaggctgacatggggtgtgtcattaattggaaaggaaaggagctgaagtgcggcagcgggatcttcgtgacgaacgaggttcatacctggacagaacagtacaaatttcaagccgattcccccaagcggctggcgaccgccattgctggcgcctgggagaatggagtgtgtggcatcagaagcacaacccgcatggaaaaccttctctggaaacagattgctaatgagctgaactatatcctgtgggaaaataacatcaagctcacggtcgtggttggggacattatcggagtgctggagcagggcaaacggacccttacacctcagcccatggagctgaagtactcttggaaaacctgggggaaggccaagattgtcacagccgaaacccaaaactccagcttcatcattgatggacctaatacacccgagtgcccgtctgcttccagagcgtggaacgtgtgggaagtggaggactatggctttggcgtcttcaccacgaatatctggctcaaactgcgcgaagtttacacacagctgtgtgaccaccggcttatgagcgccgctgtgaaggatgagagagccgtgcacgccgacatggggtactggatcgagtcccagaaaaacggatcttggaagctcgaaaaagctagcctgattgaggtcaagacctgcacctggcctaagtcccatacactgtggtctaatggcgtgctcgaaagcgatatgatcattcccaaatccctggccgggcctatcagccagcacaactatcgccccggataccatacccaaacggcgggcccttggcaccttgggaagctggagctcgactttaattattgcgagggaacaaccgttgtgattacagaaaactgtggcacccggggcccctctctgagaacaaccacggtctccgggaaactgatccacgagtggtgctgtcgcagctgcacccttccgcctctccggtacatgggagaagatggctgttggtatgggatggagatcagacccatttctgaaaaggaggagaatatggtgaaatccctggttagcgctggatctggcgaagtggacaacttcacaatgggggtcctgtgcctcgccatcctgtttgaggaagtgatgcggggaaagttcggcaagaaacatatgattgccggcgttttctttaccttcgtgcttctgctcagcgggcagatcacatggcgcgatatggctcacaccctgattatgatcggatccaatgccagcgacagaatgggcatgggggtcacgtacctggcgcttattgctacatttaagatccagcccttcctggccctcggatttttcctgcggaaactcacctctagagagaacctgcttctgggcgtggggctcgccatggctacaaccctgcaactgcctgaagatatcgagcagatggccaatggaattgctcttggcctgatggccctcaagctgatcacccagtttgagacatatcagctctggacggcgctgatttcccttacctgtagcaacacaatcttcaccctgacagtggcctggcgcaccgctacgctcattctggccggcgtctccctgcttccggtttgccaatctagctccatgcggaaaacagactggctgcccatgaccgtggctgccatgggggtgcctcccctccctctgtttatcttcaccctcaaggatacactgaagagacgctcttggccccttaatgaaggagtcatggccgtgggcctggttagcatcctggcttcctctctcctgagaaacgacgtgcctatggcggggccccttgtcgccggaggcctgctcattgcttgttacgtgatcaccgggacaagcgccgatctgacggttgagaaagccgctgacgtgacctgggaagaggaagccgagcagacaggagtctcccataacctcatgattaccgtggacgatgacggcacaatgcggatcaaggatgacgagaccgaaaatattctgacggtccttctgaaaaccgcgctgctcatcgtgagcggcatctttccgtactctattcctgctacactgcttgtttggcacacctggcagaagcagacacaacgctccggggtgctgtgggatgtccccagccctcccgagacccagaaagccgaactcgaggagggagtgtatagaatcaagcagcagggcattttcgggaaaacacaagttggagtgggcgtccagaaggaaggggtgtttcatacgatgtggcacgtgacccggggagccgttctgacacacaacggcaagcgcctcgagccgaattgggcttctgtcaaaaaggacctgatctcctacggcgggggatggagacttagcgcccagtggcaaaaaggcgaagaggtccaggtgattgcggtcgaacctgggaagaaccccaaaaatttccagaccatgcctggaaccttccagacaacgaccggcgagatcggggctattgccctggattttaagcccggaacatctggctcccccatcatcaaccgggagggcaaggtggttgggctgtatggaaatggcgtggtcaccaaaaacgggggatacgtgagcggcattgcccaaacaaatgctgaacctgacgggccgacccccgagctcgaagaggaaatgttcaagaaacgcaacctgacgatcatggatcttcatcctggctccggaaagacaagaaaatatctgcccgccattgttcgggaggctatcaagcgcagactccggaccctgattctcgcccctaccagagtggtcgcggccgagatggaagaggctctgaagggccttcccatccgctaccagacaaccgccacaaaaagcgaacacaccgggcgggagatcgtggacctgatgtgccatgctacgtttacaatgagactgctctctcctgttcgcgtgccgaattataacctgattatcatggatgaagcccacttcaccgaccccgccagcattgctgcgcggggatacatctccacaagagtcggcatgggggaggccgctgccatttttatgaccgccacgcctcccggaaccgctgatgccttccctcagtctaatgcgcccatccaggacgaggaacgcgacatcccggagcggagctggaactccggcaatgaatggattacagattttgctgggaagaccgtgtggttcgtgccttctatcaaagccggcaacgacattgccaactgtcttagaaagaatggcaaaaaggtcatccaactgagccgcaagacatttgataccgagtaccagaaaacaaagctcaacgactgggatttcgttgtgaccacggacatttccgagatgggagctaattttaaagccgatcgggtgatcgaccccagacggtgcctgaagcccgtcattctgacagatgggcctgaacgcgtgatcctcgcgggacccatgcctgttaccgccgcttctgccgctcagagacggggccgcgtggggagaaacccgcagaaagagaatgaccaatatatcttcaccggacagccccttaacaatgatgaagaccatgcccactggacagaggctaagatgctgctggacaacattaatacccctgaaggcatcattcccgccctcttcgagcctgagcgggaaaagagcgcggccatcgatggggagtacagactgaaaggcgaatcccgcaagacatttgtcgagcttatgcggagaggagacctgcccgtgtggctcgctcacaaagttgccagcgaaggcattaagtatacggatcgcaaatggtgcttcgacgggcagcggaacaatcagatcctggaggagaacatggatgtggaaatctggaccaaggagggagagaagaagaagctgagaccgcgctggctcgacgctcggacatactctgatcctcttgccctgaaagagtttaaggacttcgccgctggcagaaaatccattgcgctggatctcgtcaccgaaatcgggcgcgtgcccacacatctggcccacagaacccggaatgctcttgacaacctggtcatgctccatacgagcgagcacggaggcaaggcctatcgccacgccgtggaggaactgcctgagaccatggaaacactgctccttctgggcctgatgattctcctgaccgggggagctatgctttttctgatctctggcaaagggattggaaagacatccatcggcctcatctgtgttattgccagctccgggatgctgtggatggcggagatccccctgcaatggattgcctctgctatcgtgctcgagttctttatgatggtgcttctgattcctgaacccgagaagcagagaaccccgcaggataatcaactggcctacgtcgttatcggcattctcacgctggctgccatcatcgcggccaacgaaatgggccttctggagacaaccaaacgggacctcggcatgagcaaggaacctggggtggtgtcccccacaagctatctggatgtcgacctgcatcccgcttctgcctggaccctctacgctgtggccaccacagttattacgcctatgcttcgccacaccatcgaaaattccacagctaacgtgagcctggccgcgattgccaaccaggctgtcgtgctgatgggactcgacaaaggctggccgatctctaagatggatctgggggtcccccttctggccctcggatgctacagccaggtgaatcctctgaccctgacagctgccgttctccttctgattacccattatgccatcatcggccccgggctgcaggcgaaagctacgagagaggcccaaaagcggacagctgccggaattatgaagaaccctaccgtggacggcatcatgaccattgatctcgaccccgtcatctacgattccaaattcgagaagcagctgggccaggtgatgcttctggttctctgtgccgtgcagctgctgctcatgagaacatcttgggctctttgcgaggccctgaccctggcgacagggcctattacgaccctctgggaaggaagcccgggcaaattttggaatacaaccatcgccgtctccatggctaacatcttccgcgggtcttatctggccggagctggccttgcctttagcattatgaagtccgtggggacaggaaaacggggcaccggcagccaaggggagacgctgggagaaaagtggaagaaaaagctcaatcagctgtctagaaaagagttcgacctgtacaagaaatccggcatcaccgaggtggatcgcacagaagcgaaggaggggctcaaacggggagaaattacccaccatgccgttagcagaggctccgctaaacttcagtggtttgtcgagcggaacatggtgatccccgaagggcgcgtgattgacctgggatgtggcagaggcgggtggtcttattactgcgccggactgaagaaagtcacagaggttcggggctataccaaagggggacctggccacgaggaacccgtgcctatgagcacatacgggtggaatatcgtgaaactcatgtccggaaaggatgtcttctacctgcccccggagaaatgtgacacccttctgtgcgatattggcgaatctagcccttcccccacggtggaggagagccgcacaatcagagttctcaagatggtggaaccctggctgaagaacaatcagttctgtatcaaagtcctgaacccttatatgcccaccgtgattgagcacctcgaacggcttcaacgcaagcatggcgggatgctggttagaaatcctctgtctcggaactccacccacgagatgtactggatcagcaatggaacaggcaacattgtggcttctgtcaatatggtgtcccgcctcctgcttaacagatttacgatgacccatcggagaccgacaatcgaaaaagacgtggatctgggggccggaacccgccacgtcaacgctgagcccgagacacctaatatggacgttattggcgaacggatcaagagaatcaaagaggaacacaacagcacctggcattatgacgatgagaatccctaccgcacatgggcctatcacgggtcttacgaagtgaaggcgaccggaagcgcctcctctatgattaacggcgtggtcaagctcctgacgaaaccttgggacgtggttcccatggtgacccagatggctatgacagataccacaccgttcggccagcaacgggtctttaaggagaaagtggacaccagaacgcctcgcagcatgcccgggacacggagagttatgggaatcaccgccgagtggctgtggcgcacactcggccggaataagaaacctagactgtgcacccgcgaagagttcacgaagaaggtgcggaccaacgctgccatgggggccgtctttacagaagagaatcagtgggattccgcgaaagctgccgtggaagacgaggatttctggaaacttgttgacagagagcgcgaactgcataaactcggaaagtgtggcagctgcgtgtataacatgatggggaaaagagagaagaaactgggcgaatttggaaaggccaagggctcccgggctatttggtacatgtggcttggggcccgctacctggagttcgaggctctcggatttctgaatgaagatcactggttctctagagagaacagctattccggcgtcgaaggggagggactgcataaactcggctacatcctgcgggacatttctaagatccccgggggcgccatgtatgcggatgacaccgccggatgggacacaagaatcaccgaagatgaccttcacaatgaggagaaaattacacagcagatggatcctgaacaccggcaactggctaacgccatctttaagctcacctaccagaataaagtggtcaaggtgcagcgccccacgccgacaggcaccgttatggacattatcagcagaaaggatcagcgggggtccggacaagtgggcacctatgggctgaacacattcaccaatatggaggctcagcttattcgccagatggaaggagagggcgtcctgtctaaagccgacctcgaaaaccctcatctgcccgagaagaaaatcacacagtggctggagacgaagggggtggaaagactcaaacggatggcgatcagcggcgatgactgcgtggttaagcccattgatgaccgctttgccaacgctctgcttgccctgaatgatatgggaaaggtgagaaaagacatccctcaatggcagccgtccaagggctggcacgattggcagcaggtccccttctgtagccatcacttccacgagctcattatgaaagacgggcggaagctggtggttccttgccgcccccaagacgaacttatcggacgggctcggatttctcagggcgccgggtggtccctgcgcgagaccgcttgtctcggaaaagcctacgcgcagatgtggagcctgatgtattttcatagacgggatctgcgcctcgcctctaacgctatctgctccgccgtgcctgtccactgggtgcccacaagcagaaccacatggtctattcatgcccaccatcaatggatgaccacggaagacatgctgaccgtctggaatcgggtgtggatcgaggataacccttggatggaggacaagacacccgttaccacatgggaaaatgtgccgtaccttggcaagagagaggatcagtggtgtgggtccctgatcggcctcaccagccgcgctacgtgggcccagaacattcctacagcgatccagcaagtccggtccctgattggaaatgaagagttccttgactacatgcccagcatgaaaagatttcgcaaggaggaagagtctgaaggcgctatctggtga

SEQ ID NO: 20829 - RNA, 9873 nt, synthetic construct
  misc_feature 1..9873: note = derived and/or modified CDS sequence (opt5) from DENV-3__EU482452__SS-prME
  source 1..9873: mol_type = other RNA
accagcctctgcctcatgatgatgctgcccgccacacttgctttccacctgacgtcccgggacggcgaacctcggatgatcgtggggaagaacgaacgcggaaagtctctcctgtttaagaccgcctccggcattaatatgtgtacacttatcgcgatggatctgggggagatgtgcgacgataccgtcacatacaagtgtccgctcattgctgaagttgagcccgaagacatcgattgctggtgtaacctgacctccacatgggtgacctatggaacgtgcaatcaggccggcgagcatcggcgggacaagcgctctgtggccctggctcctcacgtcgggatgggactcgataccagaacacagacctggatgagcgccgagggcgcttggagacaggtggaaaaggttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagaataagcccacgctcgacatcgagctgcagaagaccgaagctacacagcttgccaccctgcgcaaactctgtattgagggaaagatcacaaacattaccacggattccagatgccctacacagggcgaagcgatcctgccggaggaacaggaccagaattatgtgtgtaaacacacctacgtggatcggggctgggggaacggatgcggccttttcgggaagggaagcctggtcacatgcgccaagtttcaatgtctcgagcccattgagggcaaagtggttcagtatgaaaatctgaagtacacagtgatcatcaccgtccacacaggggaccagcatcaggtgggaaacgacacgcaaggcgttaccgtggagattacacctcaggcttctaccgtcgaagccgtgctgcccgagtatggcacactcgggctggaatgctcccctcgcaccggacttgatttcaatgagatgatcctgctcacgatgaaaaacaaggcttggatggtccacagacagtggtttttcgacctgccccttccgtggaccagcggcgccacaaccgagacacctacctggaatcggaaagaactgctcgtgacgtttaagaacgcccatgctaaaaagcaagaggttgtggtcctggggtctcaggaaggagcgatgcacacagccctgaccggcgctacagagattcaaaattccgggggcaccagcatcttcgccggacacctcaagtgtcgcctgaaaatggataaacttgaactgaaaggcatgtcttacgccatgtgcctcgacacctttgtgctgaagaaagaggtttccgagacacagcatgggacgattctgatcaaggtggaatacaagggagaggatgctccctgtaaaatccctttcagcaccgaagacggccaagggaaggcccacaacggaagacttattacagcgaaccccgtcgtgaccaaaaaggaggagcccgtgaatatcgaagctgagcctccgttcggcgaatccaacattgttatcgggattggcgataaagccctcaagatcaattggtataagaaaggatctagcatcggcaagatgtttgaggccacagctagaggggccagacgcatggctattctgggagacaccgcctgggatttcggctccgtcgggggagtgctgaacagcctcggcaaaatggtgcatcagatctttgggtctgcgtacacggccctgttctccggcgtcagctggattatgaagatcggaattggcgtgcttctgacatggatcgggctcaattctaaaaacaccagcatgtccttttcttgcattgttatcggaatcattaccctgtatctgggcgctgtggtccaggccgacatggggtgtgtgatcaattggaagggaaaggaacttaaatgcggcagcgggattttcgttacaaacgaggtgcacacctggacagagcagtacaagtttcaagctgattcccccaaacggctcgccacggcgatcgccggcgcttgggaaaatggagtctgtggcattagaagcaccacacgcatggagaacctgctgtggaagcagatcgccaatgaactcaactatatcctgtgggagaataacattaaacttaccgtggttgtgggggacgtcatcggagtgctggaacagggcaagcggacactcacccctcagcccatggagctgaaatactcttggaagacgtgggggaaggctaaaattgtgaccgccgagacacaaaattccagcttcatcattgacggactgaacacccctgaatgcccctctgcctccagagcttggaacgtctgggaggttgaagattatggctttggcgtgttcacaaccaatatctggcttaagctccgcgaggtgtacacacagagctgtgaccatcggctgatgtccgcggccatcaaagatgaaagagctgtccacgccgacatggggtactggattgagtctcagaagaacggaagctggaaactggagaaggcctcctttatcgaagtgaagacctgcacgtggccgaaatctcacacactctggagcaatggcgttctggagtccgatatgattatccctaagagccttgctgggcccatttctcagcataaccaccgccctggatatcatacccaaaccgccggcccctggcacctggggaaactcgaactggacttcaattactgcgagggaacaaccgtggtcatcacggagaactgtggcacacggggcccttccctgagaaccacaaccgtgagcgggaaacttatccacgaatggtgctgtcgctcttgcacactgcccccgctgcggtatatgggagaggatggctgttggtacgggatggaaattagacctatcaatgagaaagaagagaacatggttaagtccctggtgagcgcgggatctggcaaggtcgacaattttaccatgggggtgctctgcctggctattcttttcgaggaagttatgcggggaaaattcggcaagaaacatatgatcgccggcgtgctgtttacgttcgtcctcctgctgagcgggcagattacctggcgcgatatggcccacacacttatcatgattggatccaacgctagcgacagaatgggcatgggggtgacctatctggccctcatcgcgacatttaagatccagcccttcctggctctcggatttttcctgcggaaacttacctctagagagaatctgctcctgggcgtggggctggccatggccacgacacttcaactgcccgaagatattgagcagatggctaacggaatcgccctcggcctgatgaccctcaagctgattacacagtttgaaacctaccagctttggaccgctctggtctccctcacatgtagcaatacgatcttcaccctgacagttgcctggcgcaccgcgacactgattcttgccggcgtgtccctgctccctctgtgccaatctagctccatgcggaagaccgactggctcccgatgacggtggctgccatgggggtctctcccctgcctctttttatcttcagcctgaaagatacacccaagagacgctcctggcctctgaacgagggagtgatggctgttggcctcgtgtctatcctggccagctcccttctgagaaatgacgtccccatggccgggcctctcgtggctggaggcctgctcattgcgtgttatgttatcaccgggaccagcgccgacctgacagtggagaaagctgccgatgtcacctgggaagaggaagccgagcagacaggagtgtctcataaccttatgattacggtcgacgatgacggcaccatgcggatcaaggatgacgaaacagagaacattctgaccgtgctgctcaaaacagctctgcttatcgtttccggcatctttccctacagcattccggccaccctgctcgtgtggcacacgtggcagaagcagacccaacgctctggggtcctgtgggatgtgccttctccccctgagacacagaaagcggaactcgaggaaggagtttacagaatcaagcagcagggcattttcgggaagacccaagtgggagtcggcgtgcagaaagagggggtgtttcatacaatgtggcacgttacccggggagctgtcctgacacacaatggcaagcgccttgagcccaactgggccagcgtgaaaaaggacctgatcagctatggcgggggatggagactgtccgcccagtggcaaaaaggcgaagaggtgcaggtcattgctgtggaaccggggaagaatcctaagaacttccagacgatgcccggaatcttccagaccacaaccggcgagattggggccatcgcgctcgattttaaacctggaaccagcggctcccccatcattaatcgggaaggcaaggttgtggggctgtacggaaacggcgtcgtgaccaagaatgggggatatgttagcggcatcgctcaaacgaacgccgagcccgacgggcctaccccggagcttgaagaggaaatgttcaagaaacgcaatctgacaattatggatctccatcccggctctggaaagaccagaaagtacctgcctgccatcgtgcgggaggctattaaacgcagactccggacactgatccttgcccccaccagagtcgtggctgccgaaatggaggaggcgctgaagggcctgcctatccgctatcagacgacagccaccaaaagcgaacacaccgggcgggagattgttgacctcatgtgccatgctacatttaccatgagactgctttcccccgtgcgcgtccctaactacaatctgatcattatggatgaagcccacttcacagacccggcttctatcgccgcccggggatatattagcaccagagtgggcatgggggaggctgcggccatctttatgacggctacaccccctggaaccgccgaagccttcccccagtccaacgctcctatccaggacgaggagcgcgatattcccgaacggtcttggaatagcggcaacgagtggatcacagactttgtggggaagaccgtctggttcgttccgtccattaaagccggcaatgatatcgcgaactgtctcagaaagaacggaaagaaagtgattcaactgtctcgcaagacgtttgacaccgaataccagaaaacacggctgaatgattgggacttcgtggtcaccacagatatcagcgagatgggcgctaactttaaggccgacagagtgattgatcctcggcgctgcctcaaacccgttatccttaccgacgggcccgagagagtgatcctggccggacctatgcccgtcacagctgcctccgcggcccagcggcgcggcagagtggggcggaatcctcagaaggaaaacgatcaatacattttcaccggacagccgctgaataacgacgaggaccatgctcactggacggaagccaagatgctcctggataatatcaacacacccgagggcattatccctgctcttttcgaacccgagagagagaaaagcgccgctattgacggggaatatcgcctgaagggcgagtctcggaaaacctttgttgaactcatgagacgcggagatctgcctgtgtggctggcccacaaggtcgcgtccgagggcatcaaatacaccgaccggaagtggtgcttcgatggggaaagaaataaccagatcctcgaggagaatatggacgtggaaatttggacaaaagagggagaacgcaagaaacttcggcccagatggctggatgcccgcacctatagcgacccgctggctctcaaagagtttaaggatttcgccgctggcagaaaatctatcgccctggaccttgtcacagaaattgggcgggtgccttcccatctggcctaccgcacgagaaacgctctcgataatctggttatgctgcacaccagcgagcatggaggccgggcgtatcgccacgccgtggaggaactccccgagacaatggaaacccttctgctgctcggcctgatgatccttctgacagggggagctatgctctttctgatttccggcaaggggatcggaaaaacctctatcggcctgatttgtgtgatcgtcagctccgggatgctctggatggccgacattcctcttcagtggatcgccagcgctattgttctggagttctttatgatggtgctgctcatccccgagcctgaaaagcaaagaacgccccaggataaccagctggcctacgtggtcattggaatccttaccctggcggccatcgtggctgccaatgagatgggcctcctggaaacaaccaagcgggacctgggcatgtctaaagagccgggggttgtgtcccctacaagctatctcgacgtcgatcttcaccccgcttctgcctggaccctgtacgcggtggccacgacagtcattacccccatgctgagacatacaatcgaaaacagcaccgctaatgtgtccctcgccgctattgccaaccaagctgttgtgctgatgggacttgacaagggctggcctatctctaaaatggatctgggggtcccgctcctggccctgggatgctacagccaggtgaaccccctcacccttacagcggccgttctgctgctcgtgacgcactatgctattatcggccctgggctgcaggccaaggctacccgcgaggcccagaaacggacagccgcgggaatcatgaagaatcccaccgtcgacggcattatgacaatcgatcttgaccctgtgatttacgattccaagttcgagaaacaactgggccaggtgatgctcctggttctgtgtgctgtccagctccttctgatgagaacctcttgggccctgtgcgaagctctcacgctggccacagggcccatcaccaccctttgggagggaagccctggcaagttttggaacacaaccattgccgtgtccatggctaatatcttccgcgggagctatctggccggagcgggcctcgccttttctatcatgaaatccgtggggacaggacggagaggcacgggcagccagggggaaaccctgggagagaagtggaaaaagaagctgaaccaactctcccggaaagagttcgacctttacaagaaatctggcattacagaggtcgatcgcaccgaggctaaggaagggctgaaaagaggagagacaacccatcacgccgttagccggggctccgctaagctgcagtggtttgtggaacgcaatatggtgatcccggaggggagagtcattgacctcggatgtggccggggcgggtggtcttattactgcgccggactgaaaaaggtgacggaagttcgcggctataccaaaggcgggcccgggcatgaggagcctgtgcccatgagcacatacgggtggaacatcgtcaaacttatgtccggaaaggatgtgttctacctgcctcccgaaaaatgtgacaccctcctgtgcgatattggcgagagctctccgtcccctacagttgaagagagcagaaccatccgggtgctgaagatggtcgagccctggctcaaaaataaccagttctgtattaaggtgcttaatccctatatgcctacagtgatcgaacacctggagcgcctgcagagaaagtacggcgggatgctcgtccggaaccccctgtctagaaattccacccacgaaatgtattggatcagcaacggaacgggcaatattgtttctagcgtgaacatggtgtcccgccttctgctcaatcggtttacaatgacccatagacgccctaccatcgagaaagacgtcgacctgggggcgggaacacggcacgtgaacgccgaaccggagacgcccaacatggatgttattggcgagagaatcaagcgcattaaagaagaacattctagcacctggcactacgacgatgaaaatccttataagacatgggcttaccacgggtcctatgaggtgaaagccaccggaagcgcttcctctatgatcaacggcgtcgtgaagctgctcacaaagccctgggacgttgtgcctatggtcacccaaatggccatgacagataccacgcccttcggccagcagcgggtgtttaaagaaaaggttgacaccagaacaccgcgccctatgcccgggacccggaaagtgatggagatcacagctgagtggctgtggagaacccttggacgcaataagaaacctcggctgtgcacgagagaagagttcacaaagaaggtccgcaccaacgccgcgatgggcgccgtgtttacagaagagaatcaatgggatagcgctagagccgctgtcgaagacgaggagttctggaaactcgtggatcgggaacgcgagctgcataaacttgggaaatgtggatcctgcgtttacaacatgatgggcaagagagagaagaagctgggggagtttggcaaagccaagggatctcgggccatttggtacatgtggctcggcgcgagatatctggagttcgaagctctggggtttctcaatgaggaccactggttcagccgggaaaactcctactctggagtggagggcgaagggctgcataaacttggatatatcctgcgcgatattagcaaaatccccggcggggccatgtacgccgacgacaccgctggctgggatacgagaattaccgaggacgatctccacaatgaggaaaagatcacacagcagatggaccctgagcatcggcagctggccaacgctatctttaaacttacctatcaaaataaggtcgtgaaagtgcagcgccccacaccgaagggaaccgttatggatattatctccagaaaggaccagcggggcagcggacaggtgggaacatacggcctgaacaccttcacgaatatggaagcccaactcgtccgccagatggagggggaaggagtgctgtctaaagcggatctggagaaccctcacctcctggagaagaaaattacacagtggcttgaaaccaagggcgttgagagactgaaacggatggccatctccggggacgattgcgtggtcaagcccattgacgatcgctttgctaatgccctcctggctcttaacgacatgggcaaggtgagaaaagatatcccccagtggcaacctagcaagggatggcacgactggcagcaggtcccgttctgttctcatcacttccatgaactgatcatgaaagacggccggaagctcgtggttccctgccgccctcaggatgagctgattgggagagcccggatctcccaaggagcgggctggagcctgaaagaaaccgcctgtctcgggaaggcttatgcccagatgtggtctctgatgtactttcaccgcagagaccttcggctggcttccaacgccatttgcagcgctgtgcccgtccactggatccctacatccagaaccacatggagcattcatgcccaccatcagtggatgacgaccgaggatatgctcacagtgtggaatcgcgtttggatcgaggacaacccctggatggaagataagacccctgtgacaacctgggaggacgtcccctacctgggaaaacgggaagatcaatggtgtggctctcttattgggctgacgagcagagcgacctgggcccagaatatcctcacagctatccaacaggtgcgctccctgattggcgacgaggagttcctggattatatgccgtctatgaagcggtttagaaaagaagaggaaagcgagggagccatctggtga

SEQ ID NO: 20830 - RNA, 9873 nt, synthetic construct
  misc_feature 1..9873: note = derived and/or modified CDS sequence (opt5) from DENV-3__EU482453__SS-prME
  source 1..9873: mol_type = other RNA
accagcctgtgcctcatcatgatgctgcccgccacccttgctttccacctgacgtcccgggacggcgaacctcggatgattgtggggaagaacgaacgcggaaagtctctcctgtttaagaccgccagcggcatcaatatgtgtacccttattgcgatggatctgggggagatgtgcgacgataccgtcacatacaagtgtccgctcatcgctgaagttgagcccgaagacattgattgctggtgtaacctgacctccacatgggtgacctatggaacgtgcaatcaggccggcgagcatagacgggacaagcgctctgtggccctggctcctcacgtcgggatgggactcgataccagaacacagacctggatgagcgccgagggcgcttggcggcaggtcgaaaaggttgagacatgggccctgcgccatcccggcttcaccatccttgcgctgtttctcgcccactacatcgggacgtccctgacacagaaggtggtcattttcatccttctgatgctcgtgaccccttctatgacaatgagatgtgttggagtgggcaaccgggactttgtcgaagggctgagcggagctacctgggtggatgtggtcctggagcatggcgggtgcgttaccacaatggccaagaataaacccacgctcgacattgagctgcagaagaccgaagctacacagcttgccaccctgcgcaaactctgtatcgagggaaagattacaaacatcaccacggattccagatgccctacacagggcgaagcgattctgccggaggaacaggaccagaattatgtgtgtaaacacacctacgtggatcggggctgggggaacggatgcggccttttcgggaagggaagcctggtgacctgcgccaagtttcaatgtctcgagcccatcgagggcaaagtggttcagtatgaaaatctgaagtacacagtgatcattaccgtccacacaggggaccagcatcaggtgggaaacgacacgcaaggcgttaccgtggagatcacacctcaggcttctaccgtcgaagccgtgctgcccgagtatggcacactcgggctggaatgctcccctcgcaccggacttgatttcaatgagatgattctgctcacgatgaaaaacaaggcttggatggtccacagacagtggtttttcgacctgccccttccgtggaccagcggcgccacaaccgagacacctacctggaatcggaaagaactgctcgtgacgtttaagaacgcccatgctaaaaagcaagaggttgtggtcctggggtctcaggaaggagcgatgcacacagccctgaccggcgctacagagatccaaaattccgggggcaccagcattttcgccggacacctcaagtgtcgcctgaaaatggataaacttgaactgaaaggcatgtcttacgccatgtgcctcaacacctttgtgctgaagaaagaggtttccgagacacagcatgggacgatcctgatcaaggtggaatacaagggagaggacgctccctgtaaaattcctttcagcaccgaagatggccaagggaaggcccacaacggaagacttatcacagcgaatcccgtcgtgaccaaaaaggaggagcccgtgaacattgaagctgagcctccgttcggcgaatccaatatcgttattgggatcggcgacaaagccctcaagatcaactggtataagaaaggatctagcattggcaagatgtttgaggccacagctagaggggccagacgcatggctatcctgggagataccgcctgggacttcggctccgtcgggggagtgctgaatagcctcggcaaaatggtgcatcagatttttgggtctgcgtacacggccctgttctccggcgtcagctggatcatgaagattggaatcggcgtgcttctgacatggattgggctcaactctaaaaataccagcatgtccttttcttgcatcgctatcggaattatcaccctgtatctgggcgccgttgtgcaggctgatatggggtgtgccattaactggaagggaaaggaacttaaatgcggcagcgggatcttcgtcacaaatgaggtgcacacctggacagagcagtacaagtttcaagcggactcccccaaacggctcgccacggctattgccggcgcttgggaaaacggagtttgtggcatcagaagcaccacacgcatggagaatctgctgtggaagcagatcgccaacgaactcaattatattctgtgggagaacaatatcaaacttaccgtggtcgtgggggatattatcggagttctggaacagggcaagcggacactcacccctcagcccatggagctgaaatactcttggaagacgtgggggaaggccaaaattgtgaccgctgagacacaaaactccagcttcatcatcgacggacctaacacccccgaatgcccgtctgcgtccagagcctggaatgtctgggaggtggaagactatggctttggcgtgttcacaaccaacatttggctgaaacttcgcgaggtctacacacagagctgtgatcatcggctcatgtccgctgccatcaaagacgaaagagccgttcacgctgatatggggtactggattgagtctcagaagaatggaagctggaaactggagaaggcctcctttatcgaagtgaagacctgcacgtggcctaaatctcacacactgtggagcaacggcgtgctcgagtccgacatgattatccccaagagcctggcggggcctatctctcagcataatcaccgccccggatatcatacccaaaccgctggcccttggcaccttgggaaactggaactcgatttcaactactgcgagggaacaaccgtcgtgattacggagaattgtggcacacggggcccctccctgagaaccacaaccgttagcgggaagctgatccacgaatggtgctgtcgctcttgcacacttccgcctctccggtatatgggagaggacggctgttggtacgggatggaaattagacccaccaacgagaaagaagagaatatggtgaagtccctggtcagcgccggatctggcaaggtggataactttacgatgggggttctgtgcctcgccatcctgttcgaggaagtgatgcggggaaaattcggcaagaaacatatgattgctggcgtcctttttaccttcgtgctgctcctgagcgggcagatcacatggcgcgacatggcccacaccctgattatgatcggatccaatgcgagcgatagaatgggcatgggggttacatatcttgctctgatcgccacctttaagattcagcccttcctcgccctgggatttttcctccggaaactgacgtctagagagaaccttctgctcggcgtggggctggctatggccacaaccctgcaacttcctgaagacatcgagcagatggctaatggaattgccctgggcctcatgacactgaagctcatcacccagtttgaaacctaccagctgtggacagcgcttgtctccctgacgtgtagcaacaccattttcacactcaccgtggcctggcgcacagctaccctgatcctggccggcgtgtcccttctgccgctctgccaatctagctccatgcggaagacggattggctgcccatgacagtcgctgccatgggggttcctcccctccctctgtttatcttctctcttaaagacacccccaagagacgcagctggcctctgaatgagggagtgatggccgtgggcctggtctccattctcgcttctagcctgcttagaaacgatgtgcccatggcggggccgctggttgccggaggcctcctgatcgcttgttatgtgattaccgggacatccgccgacctcaccgtcgagaaagccgctgacgtgacatgggaagaggaagccgagcagacgggagttagccataacctgatgatcaccgtggatgacgatggcacaatgcggattaaggacgatgaaaccgagaatatccttacagtcctgctgaaaaccgcgctcctgatcgtgtctggcatttttccttactccatccccgctacgcttctggtctggcacacctggcagaagcagacacaacgcagcggggtgctctgggacgttccttctcccccggagacccagaaagccgaactggaggaaggagtgtacagaattaagcagcagggcatcttcgggaagacacaagtcggagtgggcgttcagaaagagggggtgtttcataccatgtggcacgtcacacggggagccgtgctcacgcacaacggcaagcgcctggagcctaattgggcttccgtgaaaaaggatcttattagctatggcgggggatggagactgtctgcccagtggcaaaaaggcgaagaggttcaggtcatcgcggtggaacccgggaagaaccctaagaatttccagaccatgcccggaattttccagacaaccaccggcgagatcggggctatcgccctggactttaaacccggaacatccggcagccctattatcaaccgggaaggcaaggtggtcgggctctacggaaatggcgtggttacgaaaaacgggggatatgtgtccggcattgcccaaaccaatgctgagccggatgggcccacacctgagctggaagaggaaatgttcaagaaacgcaaccttaccatcatggacctgcatcccggcagcggaaagacaagaaagtacctccctgccattgtccgggaggctatcaaacgcagactgcggaccctcatcctggcccccacgagagtggttgcggccgaaatggaggaggctcttaagggcctgcctattcgctatcagacaaccgccaccaaatctgaacacacagggcgggagatcgtggatctgatgtgccatgctacctttacaatgagactcctgagcccggtccgcgtgcccaattacaaccttattatcatggacgaagcccacttcaccgatcctgcctccattgctgcgcggggatatatctctacgagagttggcatgggggaggccgctgccatctttatgacagccacaccccctggaacagctgaagccttcccccagagcaatgcgccgattcaggacgaggagcgcgacatccctgaacggtcctggaactctggcaatgagtggattaccgattttgtggggaagacggtctggttcgtgcccagcatcaaagctggcaacgacattgccaactgtctgagaaagaatggaaagaaagtgatccaactctcccgcaagacctttgatacagaataccagaaaacccggctgaacgactgggatttcgtcgttacaaccgacatttctgagatgggcgccaattttaaggctgatagagtgatcgacccccggcgctgcctgaaacctgtgatcctcacagatgggcccgagagagtcattcttgccggacctatgccggtgaccgcggccagcgctgcccagcggcgcggcagagttgggcggaacccccagaaggaaaatgaccaatacatcttcacgggacagcctctgaacaatgatgaggaccatgctcactggacagaagccaagatgctgctcgacaacattaatacccccgagggcatcattcctgctctgttcgaacccgagagagagaaatccgccgcgatcgatggggaatatcgccttaagggcgagagccggaaaacctttgtggaactgatgagacgcggagacctcccggtctggctggcccacaaggtggcttctgagggcatcaaatacacagatcggaagtggtgcttcgacggggaaagaaacaatcagattctggaggagaacatggatgttgaaatctggaccaaagagggagaacgcaagaagctccggcctagatggcttgacgcccgcacatattccgatcccctggctctgaaagagtttaaggacttcgccgccggcagaaaaagcattgctctcgatctggtgacggaaatcgggcgggtcccttctcatcttgcgtaccgcaccagaaatgccctggacaacctcgtgatgctgcacacatccgagcatggaggccgggcttatcgccacgccgtcgaggaactgcccgagaccatggaaacactccttctgctgggcctcatgattctgcttaccgggggagccatgctgtttctcatcagcggcaaggggatcggaaaaacgtccattggcctgatctgtgtgattgtttctagcgggatgctgtggatggctgatgtgcctctccagtggatcgcctccgcgattgtgcttgagttctttatgatggtcctgctgatccccgagccggaaaagcaaagaacccctcaggacaatcagctcgcctacgttgtgattggaatcctgacacttgctgccatcgtggctgccaacgagatgggcctgctcgaaaccacaaagcgggatctgggcatgagcaaagagcccggggtcgtgtctcccacctcctatctggacgttgacctccaccctgcgagcgcctggacgctttacgctgtggccacaaccgtcattacaccgatgctgagacataccatcgaaaattctaccgctaacgtgagcctggccgctattgccaaccaagcggtcgtgctcatgggactggataagggctggcccatctccaaaatggaccttggggttcctctgctcgccctgggatgctactctcaggtgaatcccctgacactcacggctgccgtccttctgctggtgacccactatgctattatcggccctgggctccaggccaaggccacacgcgaggcgcagaaacggaccgctgccggaatcatgaagaaccccacagttgatggcattatgaccatcgacctggatcctgtgatttacgacagcaagttcgagaaacaacttggccaggtcatgctgctcgtgctgtgtgctgtgcagctgctccttatgagaacgtcctgggccctgtgcgaagccctgacactcgctaccgggccgatcaccacactgtgggagggatctcccggcaagttttggaataccacaattgccgttagcatggcgaacatcttccgcgggtcctatcttgccggagctggcctggcctttagcatcatgaaatctgtcgggacgggacggagaggcaccggctcccagggggaaacactcggagagaagtggaaaaagaagctgaatcaactgagccggaaagagttcgatctctacaagaaatccggcattaccgaggtggaccgcacagaggctaaggaagggcttaaaagaggagagaccacgcatcacgccgtgtctcggggcagcgcgaagctgcagtggtttgtcgaacgcaacatggttatccctgaggggagagtgattgatctgggatgtggccggggcgggtggtcctattactgcgccggactcaaaaaggtgaccgaagtccgcggctatacaaaaggcgggcccgggcatgaggagcctgtgcccatgtctacctacgggtggaatatcgttaaactgatgagcggaaaggacgtgttctaccttccgcctgaaaaatgtgatacactgctctgcgacattggcgagtccagcccctctcccaccgtcgaagagtccagaacaatccgggtgctgaagatggttgagccttggctgaaaaacaatcagttctgtattaaggtgctcaacccctatatgcctaccgtcatcgaacaccttgagcgcctgcagagaaagtacggcgggatgctggtgcggaatccgctcagcagaaactctacgcacgaaatgtattggatctccaatggaacaggcaacattgtgagctctgtcaatatggttagccgcctgcttctgaaccggtttaccatgacccatagacgccccacaatcgagaaagatgtggacctcggggctggaacgcggcacgtgaacgccgaacctgagacccccaatatggacgtcattggcgagagaatcaagcgcattaaagaagaacactcctctacatggcactacgatgacgaaaacccttataagacctgggcttaccacgggagctatgaggtgaaagccacaggatccgctagctccatgatcaatggcgttgtgaagctgctgaccaagccctgggatgtcgtgccgatggttacacaaatggccatgaccgacacgacccctttcggccagcagcgggtgtttaaagaaaaggtcgatacaagaacaccccgccctatgcccgggacacggaaagtgatggagatcaccgcggagtggctctggagaacgctgggacgcaacaagaaacctcggctttgcacaagagaagagttcaccaagaaggttcgcacaaatgccgctatgggcgccgtgtttaccgaagagaaccaatgggactctgctagagccgccgtcgaagatgaggagttctggaaactggtggaccgggaacgcgagctccataagctggggaaatgtggaagctgcgtctacaatatgatgggcaagagagagaagaaacttggggagtttggcaaagcgaagggatcccgggctatttggtacatgtggctgggcgccagatatctcgagttcgaagccctggggtttctgaacgaggatcactggttctctcgggaaaatagctactccggagtggagggcgaagggctccataagctgggatatatccttcgcgacatttctaaaatccccggcggggctatgtacgccgatgacacggctggctgggacaccagaattacagaggatgacctgcacaacgaggaaaagatcacccagcagatggatccggagcatcggcagctcgccaatgcgatctttaaactgacatatcaaaacaaggttgtgaaagtccagcgccctacccccaagggaacagtgatggacattatcagcagaaaggatcagcggggctccggacaggtgggaacctacggccttaatacgttcacaaacatggaagcccaactggttcgccagatggagggggaaggagtgctcagcaaagctgacctggagaatccccatctgctcgagaagaaaattacccagtggctggaaaccaagggcgtcgagagacttaaacggatggccatctctggggatgactgcgtggttaagcctattgatgaccgctttgctaacgccctgctcgcgctgaacgatatgggcaaggtgagaaaagacatcccgcagtggcaaccctccaagggatggcacgattggcagcaggtccctttctgtagccatcacttccatgaacttatcatgaaagacggccggaagctggtggtcccctgccgccctcaggacgagctcattgggagagcccggatctctcaaggagctggctggtccctgaaagaaacagcctgtctggggaaggcttatgcccagatgtggagcctcatgtactttcaccgcagagatctgcggcttgcttctaatgccatttgctccgcggtgcccgttcactggatccctaccagcagaacaacgtggtccattcatgcccaccatcagtggatgaccacagaggacatgctgaccgtgtggaaccgcgtctggatcgaggataatccctggatggaagacaagacaccggtgaccacgtgggaggatgttccttacctcggaaaacgggaagaccaatggtgtggcagcctgattgggcttacctctagagctacatgggcccagaacatcctgaccgccatccaacaggtgcgcagcctcattggcgatgaggagttcctggactatatgccctccatgaagcggtttagaaaagaagaggaactggagggagctatctggtga

SEQ ID NO: 20831 - RNA, 9873 nt, synthetic construct
  misc_feature 1..9873: note = derived and/or modified CDS sequence (opt5) from DENV-3__EU482454__SS-prME
  source 1..9873: mol_type = other RNA
accagcctgtgcctcatgatgatgctgcccgccacacttgctttccacctgacgtccagagacggcgagcctcggatgatcgtggggaagaacgaacgcggaaaatctctcctgtttaagaccgccagcggcattaatatgtgtacacttatcgcgatggatctgggggagatgtgcgacgataccgtcacatacaaatgtccgctcattgctgaagttgagcccgaagacatcgattgctggtgtaacctgacctccacatgggtgacctatggaacgtgcaatcaggccggcgagcatagacgggacaagcgctctgtggccctggctcctcacgtcgggatgggactcgataccagaacacaaacctggatgagcgccgagggcgcttggcggcaggtggaaaaagttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagaataaacccacgctcgacatcgagctgcagaagaccgaagctacacaacttgccaccctgcgcaaactctgtattgagggaaagatcacaaacattaccacggattccagatgccctacacagggcgaagcgaccctgccggaggaacaggaccagaattatgtgtgtaaacacacctacgtggatcggggctgggggaacggatgcggccttttcgggaagggaagcctggtcacatgcgccaagtttcaatgtctcgagcccatcgagggcaaagtggttcagtatgaaaatctgaagtacaccgtgattatcacagtccacacgggggaccagcatcaggtgggaaacgacacccaaggcgttacagtggagatcacccctcaggcttctacagtcgaagccgtgctgcccgagtatggcaccctcgggctggaatgctcccctcgcacgggacttgatttcaatgagatgattctgctcaccatgaaaaacaaggcttggatggtccacagacagtggtttttcgacctgccccttccgtggacaagcggcgccaccacagagacccctacgtggaatcggaaagaactgctcgtgacatttaagaacgcccatgctaaaaagcaagaggttgtggtcctggggtctcaggaaggagcgatgcacaccgccctgacaggcgctaccgagatccagaattccgggggcaccagcattttcgccggacacctcaagtgtcgcctgaaaatggataagcttgaactgaaaggcatgtcttacgccatgtgcctcaacacatttgtgctgaagaaagaggtttccgagacgcagcatgggaccatcctgattaaggtggaatacaagggagaggacgctccctgtaaaatccctttcagcacagaagatggccaagggaaggcccacaacggaagacttatcaccgcgaatcccgtcgtgacaaaaaaggaggagcccgtgaacattgaagctgagcctccgttcggcgaatccaatatcgttattgggatcggcgacaaagccctcaagattaactggtataagaaaggatctagcatcggcaagatgtttgaggccaccgctaaaggggcccggagaatggctatcctgggagatacggcctgggacttcggctccgtcgggggagtgctgaatagcctcggcaagatggtgcatcagatttttgggtctgcgtacacagccctgttctccggcgtcagctggatcatgaaaattggaatcggcgtgcttctgacctggattgggctcaactctaagaataccagcatgtccttttcttgcatcgttattggaatcatcacactgtatctgggcgctgtggtccaggccgatatggggtgtgtgattaactggaagggaaaagaacttaagtgcggcagcgggatcttcgttaccaatgaggtgcacacatggacggagcagtacaaatttcaagctgactcccccaagcgcctcgccaccgcgattgccggcgcttgggaaaacggagtctgtggcatccggagcacaaccagaatggagaatctgctgtggaaacagattgccaacgaactcaattatatcctgtgggagaacaatatcaagcttacagtggttgtgggggatattatcggagtcctggaacagggcaaacgcaccctcacgcctcagcccatggagctgaagtactcttggaagacctgggggaaagctaagattgtgacagccgagacccaaaactccagcttcatcattgacggacctaacacacccgaatgcccgtctgcctcccgggcttggaatgtgtgggaggtcgaagactatggctttggcgttttcaccacaaacatctggctgaaacttagagaggtgtacacccagagctgtgatcatcgcctcatgtccgcggccatcaaggacgaacgggctgtgcacgccgatatggggtactggattgagtctcagaaaaatggaagctggaagctggagaaggcctcctttatcgaagtcaaaacgtgcacatggcctaagtctcacaccctgtggagcaacggcgtgctcgagtccgacatgattatccccaaaagcctggctgggcctatttctcagcataatcacagacccggatatcatacccaaacagccggcccttggcaccttgggaagctggaactcgatttcaactactgcgagggaaccacggttgtgatcacagagaattgtggcacccgcggcccctccctgcggacaaccacagtcagcgggaaactgatccacgaatggtgctgtagatcttgcacccttccgcctctccgctatatgggagaggacggctgttggtacgggatggaaattcggcccatcaacgagaaggaagagaatatggtgaagtccctggttagcgcgggatctggcaaagtggataactttacgatgggggtcctgtgcctcgctattctgttcgaggaagtgatgagaggaaagttcggcaaaaagcatatgatcgccggcgttctttttaccttcgtgctgctcctgagcgggcagattacatggcgggacatggcccacaccctgatcatgattggatccaatgctagcgatcgcatgggcatgggggtcacatatcttgccctgatcgcgacctttaaaatccagcccttcctcgctctgggatttttcctcagaaagctgacgtctcgggagaaccttctgctcggcgtggggctggccatggccacaaccctgcaacttcctgaagacattgagcagatggctaatggaatcgccctgggcctcatgacactgaagctcattacccagtttgaaacctaccagctgtggacagctcttgtgtccctgacgtgtagcaacaccatcttcacactcaccgtcgcctggagaacagcgaccctgattctggccggcgtttcccttctgccgctctgccaatctagctccatgcgcaaaacggattggctgcccatgacagtggctgccatgggggtgcctcccctccctctgtttatcttctctcttaaggacacccccaaacggagaagctggcctctgaatgagggagtcatggctgtgggcctggtttccatcctcgcctctagcctgcttcgcaacgatgtgcccatggccgggccgctggtcgctggaggcctcctgattgcgtgttatgtgatcaccgggacatccgccgacctcaccgttgagaaggctgccgacgtgacatgggtcgaagaggccgaacagacgggagtgagccataacctgatgattaccgtcgatgacgatggcacaatgagaatcaaagacgatgagaccgaaaatattcttacagtgctgctgaagaccgctctcctgatcgtttctggcatctttccttactccattcccgccacgcttctggtgtggcacacctggcagaaacagacacaacggagcggggtcctctgggacgtgccttctcccccggagacccagaaggcggagctggaagagggagtttaccgcatcaagcagcagggcattttcgggaaaacacaagtgggagtcggcgtgcagagagaaggggtgtttcataccatgtggcacgttacacggggagctgtcctcacgcacaacggcaagcgcctggagcctaattgggcctccgtgaaaaaggatcttatcagctatggcgggggatggagactgtctgcccagtggcaaaaaggcgaggaagtgcaggtcattgctgtggagcccgggaagaaccctaagaatttccagaccatgcccggaacattccagaccaccacaggcgaaatcggggccattgcgctggactttaaacccggaacgtccggcagccctatcatcaaccgggagggcaaggttgtggggctctacggaaatggcgtcgtgaccaaaaacgggggatatgtttccggcattgctcaaacaaatgccgaaccggatgggcccacccctgagctggaggaagagatgttcaagaaacgcaaccttacaatcatggacctgcatcccggcagcggaaagaccagaaagtacctccctgccattgtgcgggaagctatcaaacgcagactgcggacgctcattctggcccccacaagagtcgtggctgccgagatggaagaggcgcttaagggcctgcctatccgctatcagaccaccgccacaaaatctgagcacaccgggcgggaaatcgttgatctgatgtgccatgctacatttaccatgagactcctgagcccggtgcgcgtccccaattacaaccttattatcatggacgaggcccacttcacggatcctgcttccattgccgcccggggatatatctctacaagagtgggcatgggggaagctgcggccatttttatgaccgctacaccccctggaaccgccgaggccttcccccagagcaatgctccgatccaggacgaagagcgcgacatccctgagcggtcctggaactctggcaatgaatggattacggattttgtggggaagaccgtctggttcgttcccagcatcaaagccggcaacgacattgcgaactgtctgagaaagaatggaaagaaagtgatccaactctcccgcaagacatttgataccgagtaccagaaaacacggctgaacgactgggatttcgtggtcaccacagacatttctgaaatgggcgctaattttaaggccgatagagtgatcgacccccggcgctgcctgaaacctgttattctcaccgatgggcccgagagagtgatccttgccggacctatgccggtcacggctgccagcgcggcccagcggcgcggcagagtggggcggaacccccagaaggagaatgaccaatacatcttcacaggacagcctctgaacaatgatgaagaccatgctcactggaccgaggccaagatgctgctcgacaacattaatacccccgaaggcatcattcctgctctgttcgagcccgaaagagagaaatccgccgctatcgatggggagtatcgccttaagggcgaaagccggaaaacatttgttgagctgatgagacgcggagacctcccggtgtggctggcccacaaggtcgcgtctgaaggcattaaatacaccgatcggaagtggtgcttcgacggggagagaaacaatcagatcctggaagagaacatggatgtggagatctggacaaaagaaggagagcgcaagaagctccggcctagatggcttgacgcccgcacgtattccgatcccctggctctgaaagaatttaaggacttcgccgctggcagaaaaagcattgccctcgatctggtcaccgagatcgggcgggtgccttctcatcttgcccaccgcacaagaaatgctctggacaacctcgttatgctgcataagtccgaacacggaggccgggcgtaccgccacgccgtggaggagctgcccgaaaccatggagacactccttctgctgggcctcatgattctgcttaccgggggagctatgctgtttctcatcagcggcaaagggattggaaagacgtccatgggcctgatctgtgtgatcgtctctagcgggatgctgtggatggccgatgttcctctccagtggattgcctccgctatcgtgcttgaattctttatgatggtgctgctgattcccgagccggagaagcaaagaacccctcaggacaatcagctcgcctatgtcgtgatcggaattctgacacttgcggccatcgttgctgccaacgaaatgggcctgctcgagaccacaaaacgggatctgggcatgagcaaggaacccggggtggtctctcccacctcctacctggacgtggacctccatcctgctagcgcctggacgctttatgcggtcgccacaaccgtgattacaccgatgctgagacacaccatcgagaattctaccgctaacgttagcctggccgctatcgccaaccaagctgtggtcctcatgggactggataaaggctggcccatttccaagatggaccttggggtgcctctgctcgccctgggatgctactctcaggttaatcccctgacactcacggcggccgtgcttctgctggtcacccattacgctatcattggccctgggctccaggccaaagctacacgcgaagcccagaagcggaccgccgcgggaatcatgaagaaccccacagtggatggcattatgaccatcgacctggatcctgtgatctatgacagcaaattcgagaagcaacttggccaggttatgctgctcgtcctgtgtgctgtgcagctgctccttatgagaacgtcctgggccctgtgcgaggctctgacactcgccaccgggccgattaccacactgtgggaaggatctcccggcaaattttggaataccacaatcgccgtgagcatggctaacattttccgcgggtcctaccttgccggagcgggcctggcctttagcatcatgaagtctgtcgggacgggacggagaggcaccggctcccagggggagacactcggagaaaaatggaagaagaaactgaatcaactgagccggaaggagttcgatctctataaaaagtccggcattaccgaagttgaccgcacagaggctaaagaggggcttaagagaggagaaaccacgcaccatgccgtgtctcggggcagcgctaaactgcagtggtttgtggagcgcaacatggtcatccctgaagggagagtgatcgatctgggatgtggccggggcgggtggtcctactattgcgccggactcaagaaggttaccgaggtgcgcggctacacaaaagggggacccggccacgaagagcctgtccccatgtctacctatgggtggaatattgtgaagctgatgagcggaaaagacgttttctaccttccgcctgagaagtgtgatacactgctctgcgacatcggcgaatccagcccctctcccaccgtggaggaatccagaacaattcgggtcctgaaaatggtggagccttggctgaagaacaatcagttctgtatcaaggtgctcaacccctacatgcctaccgtcattgagcaccttgaacgcctgcagagaaaatatggcgggatgctggttcggaatccgctcagcagaaactctacgcatgagatgtactggatctccaatggaacaggcaacattgtgagctctgtgaatatggtcagccgcctgcttctgaaccggtttaccatgacccacagacgccccacaatcgaaaaggatgtggacctcggggcgggaacgcggcatgttaacgccgagcctgaaacccccaatatggacgtgatcggcgagagaattaaacgcatcaaggaggaacactcctctacatggcactatgatgacgagaacccttacaaaacctgggcttatcatgggagctacgaagtcaaggccacaggatccgctagctccatgattaatggcgtggttaagctgctgaccaaaccctgggatgtggtcccgatggtgacacaaatggccatgaccgacacgacccctttcggccagcagcgggtttttaaggagaaagtggatacaagaaccccccgccctatgcccgggacacggaaggtcatggaaatcaccgctgagtggctctggagaacgctgggacgcaacaaaaagcctcggctttgcacaagagaggaattcaccaagaaagtgcgcacaaatgccgcgatgggcgccgtctttaccgaggaaaaccaatgggactctgctagagccgctgtggaggatgaagagttctggaagctggttgaccgggagcgcgaactccacaaactggggaagtgtggaagctgcgtgtataatatgatgggcaaaagagagaagaaacttggggaatttggcaaggccaagggatcccgggccatttggtacatgtggctgggcgcgagatacctcgagttcgaggctctggggtttctgaacgaagatcattggttctctcgggagaatagctattccggagtcgaaggcgaggggctccacaaactgggatacatccttcgcgacatctctaagattcccggcggggccatgtatgccgatgacacggctggctgggacaccagaatcacagaagatgacctgcataacgaggagaaaattacccagcagatggatccggaacaccggcagctcgccaatgctatctttaagctgacataccaaaacaaagtggtgaaggttcagcgccctacccccaagggaacagtgatggacattatcagcagaaaagatcagcggggctccgggcaggtcggaacctatggccttaatacgttcacaaacatggaggcccaactggtgcgccagatggaaggggagggagttctcagcaaggcggacctggaaaatccccacctgctcgagaaaagaatcacccagtggctggagaccaagggcgtggaacggcttaaacgcatggccatttctggggatgactgcgtcgtgaagcctatcgatgacagatttgctaacgccctgctcgctctgaacgatatgggcaaggtccggaaagacattccgcagtggcaaccctccaagggatggcatgattggcagcaggtgcctttctgtagccaccatttccacgagcttatcatgaaagacggccgcaagctggttgtgccctgcagacctcaggacgaactcattgggcgggcccgcatctctcaaggagcgggctggtccctgaaagagacagcctgtctggggaaggcttacgcccagatgtggagcctcatgtattttcacagacgggatctgagacttgcttctaatgccatctgctccgctgtccccgcccattggattcctaccagccgcacaacgtggtccatccacgcgcatcaccagtggatgaccacagaagacatgctgaccgtgtggaaccgggtttggattgaggataatccctggatggaggacaagacaccggtgaccacgtgggaagatgtcccttacctcggaaaaagagaggaccaatggtgtggcagcctgatcgggcttacctctcgcgccacatgggctcagaacattctgaccgccatccagcaggtgcggagcctcattggcgatgaagagttcctggactacatgccctccatgaagagatttcgcaaagaggaagagtctgaaggagccatctggtga

SEQ ID NO: 20832 - RNA, 9873 nt, synthetic construct
  misc_feature 1..9873: note = derived and/or modified CDS sequence (opt5) from DENV-3__EU482455__SS-prME
  source 1..9873: mol_type = other RNA
accagcctgtgcctcatgatgatgctgcccgctacacttgctttccacctgacgtccagagacggagaacctcggatgatcgtggggaagaacgaacgcggaaaatctctcctgtttaagaccgccagcggaattaatatgtgtacacttatcgcgatggatctgggggagatgtgcgacgataccgtgacatacaaatgtccgctcgttgctgaagtggagcccgaagacattgattgctggtgtaacctgacctccacatgggtgacctatggaacgtgcaatcaggccggcgagcatagacgggacaagcgctctgtggccctggctcctcacgtggggatgggactcgataccagaacacagacctggatgagcgccgagggcgcttggcggcaggttgaaaaagtggagacatgggccctgcgccatcccggcttcaccatccttgcgctgtttctcgcccactacattgggacgtccctgacacagaaggtcgtgatcttcatccttctgatgctcgttaccccttctatgacaatgagatgtgtgggagtcggcaaccgggactttgtggaagggctgagcggagctacctgggtggatgtcgttctggagcatggcgggtgcgtgaccacaatggccaagaataaacccacgctcgacattgagctgcagaagaccgaagctacacagcttgccaccctgcgcaaactctgtatcgagggaaagattacaaacatcaccacggattccagatgccctacacagggcgaagcgattctgccggaggaacaggaccagaattatgtgtgtaaacacacctacgtcgatcggggctgggggaacggatgcggccttttcgggaagggaagcctggtgacctgcgccaagtttcaatgtctcgagcccatcgagggcaaagttgtgcagtatgaaaatctgaagtacacagtcattatcaccgtgcacacaggggaccagcatcaggttggaaacgacacgcaaggcgtgaccgtcgagatcacacctcaggcttctaccgtggaagccgtcctgcccgagtatggcacactcgggctggaatgctcccctcgcaccggacttgatttcaatgagatgattctgctcacgatgaaaaacaaggcttggatggtgcacagacagtggtttttcgacctgccccttccgtggaccagcggcgccacaaccgagacacctacctggaataaaaaggaactgctcgttacgtttaaaaacgcccatgctaagaagcaagaggtggtcgtgctggggtctcaggaaggagcgatgcacacagccctgaccggcgctacagagatccaaaattccgggggcaccagcattttcgccggacacctcaaatgtcggctgaagatggataaacttgaactgaagggcatgtcttacgccatgtgcctcaacacctttgttctgaaaaaggaggtgtccgagacacagcatgggacgatcctgattaaggtcgaatacaaaggagaggacgctccctgtaagatccctttcagcaccgaagatggccaagggaaagcccacaacggacgccttatcacagcgaatcccgtggtgaccaagaaagaggagcccgttaacattgaagctgagcctccgttcggcgaatccaatatcgtcattgggatcggcgacaaggccctcaagattaactggtataaaaagggatctagcatcggcaaaatgtttgaggccacagctagaggggcccggagaatggctatcctgggagataccgcctgggacttcggctccgtcggcggggtgctgaatagcctcgggaagatggtccatcagatttttgggtctgcgtacacggccctgttctccggcgtgagctggatcatgaaaattggaatcggcgttcttctgacatggattgggctcaactctaagaataccagcatgtccttttcttgcatcgtgattggaatcatcaccctgtatctgggcgctgtcgtgcaggccgatatggggtgtgctattaactggaagggaaaagaacttaagtgcggcagcgggatcttcgttacaaatgaggtgcacacctggacagagcagtacaaatttcaagccgactcccccaagcgcctcgcgacggccattgctggcgcctgggaaaacggagtctgtggcatccggagcaccacaagaatggagaatctgctgtggaaacagattgctaacgaactcaattatatcctgtgggagaacaatatcaaacttaccgtggttgtgggggatattatcggagtcctggaacagggcaaacgcacactcacccctcagcccatggagctgaagtactcttggaagacgtgggggaaagccaagattgtgaccgccgagacacaaaactccagcttcatcattgacggacctaacacccccgaatgcccgtctgcttcccgggcgtggaatgtgtgggaggtcgaagactatggctttggcgttttcacaaccaacatctggctgaaacttagagaggtgtacacacagagctgtgatcatcgcctcatgtccgccgctatcaaggacgaacgggccgtgcacgccgatatggggtactggattgagtctcagaaaaatggaagctggaagctggagaaggcttcctttatcgaagtcaaaacctgcacgtggcctaagtctcacacactgtggagcaacggcgtgctcgagtccgacatgattatccccaaaagcctggccgggcctatttctcagcataatcacagacccggatatcatacccaaaccgcgggcccttggcaccttgggaagctggaactcgatttcaactactgcgagggaacaaccgttgtgatcacggagaattgtggcacacgcggcccctccctgcggaccacaaccgtcagcgggaaactgatccacgaatggtgctgtagatcttgcacacttccgcctctccgctatatgggagaggacggctgttggtacgggatggaaattcggcccatcaacgagaaggaagagaatatggtgaagtccctggttagcgctggatctggcaaagtggataactttaccatgggggtcctgtgcctcgccattctgttcgaggaagtgatgagaggaaagttcggcaaaaagcatatgatcgccggcgttctttttacgttcgtgctgctcctgagcgggcagattacctggcgggacatggctcacacactgatcatgattggatccaatgccagcgatcgcatgggcatgggggtcacctatcttgcgctgatcgctacatttaaaatccagcccttcctcgccctgggatttttcctcagaaagctgacctctcgggagaaccttctgctcggcgtggggctggccatggctacgacactgcaacttcctgaagacattgagcagatggccaatggaatcgctctgggcctcatgaccctgaagctcattacacagtttgaaacctaccagctgtggaccgcccttgtgtccctgacatgtagcaacacgatcttcaccctcacagtcgcgtggagaaccgccacactgattctggctggcgtttcccttctgccgctctgccaatctagctccatgcgcaaaaccgattggctgcccatgacggtggccgctatgggggtgcctcccctccctctgtttatcttctctcttaaggacacacccaaacggagaagctggcctctgaatgagggagtcatggccgtgggcctggtttccatcctcgcctctagcctgcttcgcaacgatgtgcccatggctgggccgctggtcgcgggaggcctcctgattgcctgttatgtgatcaccgggacctccgctgacctcacagttgagaaggccgccgacgtgacctgggaagaggaagctgagcagacaggagtcagccataacctgatgattacggtggatgacgatggcaccatgagaatcaaagacgatgaaacagagaatattcttaccgtcctgctgaagacagccctcctgatcgtgtctggcatctttccttactccattcccgcgacccttctggtttggcacacgtggcagaaacagacccaacggagcggggtgctctgggacgtcccttctcccccggagacacagaaggctgaactggaggaaggagtgtaccgcatcaagcagcagggcattttcgggaaaacccaagttggagtgggcgtccagaaggagggggtgtttcatacaatgtggcacgtgaccagaggagccgttctcacacacaacggcaaacggctggagcctaattgggcctccgtcaagaaagatcttatcagctatggcgggggatggcgcctgtctgctcagtggcaaaagggcgaagaggtccaggtgattgccgtcgaacccgggaagaaccctaaaaatttccagacgatgcccggaatcttccagaccacaaccggcgagattggggcgatcgctctggactttaagcccggaacctccggcagccctatcattaacagagaaggcaaagtggttgggctctacggaaatggcgtggtcacaaagaacgggggatatgtgtccggcatcgcccaaacgaatgccgagccggatgggcccacccctgagctggaagaggaaatgttcaaaaagcggaaccttacaattatggacctgcatcccggcagcggaaagacccgcaaatacctccctgctatcgttagagaggccattaagcggcgcctgagaacactcatcctggctcccacccgggtggtcgccgcggaaatggaggaggcccttaaaggcctgcctatcagatatcagacgacagctaccaagtctgaacacaccgggcgcgagattgtggatctgatgtgccatgccacatttaccatgcggctcctgagcccggttagagtgcccaattacaaccttatcattatggacgaagctcacttcacagatcctgcctccatcgccgctcgcggatatatttctacccgggtcggcatgggggaggcggccgctatctttatgacggccacaccccctggaaccgccgaggctttcccccagagcaatgccccgatccaggacgaggagagagacattcctgaacgctcctggaactctggcaatgagtggatcacagattttgtggggaaaaccgtgtggttcgtccccagcattaaggcgggcaacgacatcgctaactgtctgcggaagaatggcaagaaggttattcaactctccagaaaaacgtttgataccgaataccagaagacacgcctgaacgactgggatttcgtggtgaccacagacatctctgagatgggcgccaattttaaagccgatcgggtcattgaccccagacggtgcctgaagcctgtgatcctcaccgatgggcccgagcgcgttatccttgctggacctatgccggtgacagccgcgagcgccgctcagagacggggccgcgtcgggagaaacccccagaaggaaaatgaccaatacattttcaccggacagcctctgaacaatgatgaggaccatgcccactggacggaagctaaaatgctgctcgacaacatcaatacacccgagggcattatccctgccctgttcgaacccgagcgggagaagtccgctgccattgatggggaatatagacttaaaggcgagagccgcaagacctttgtggaactgatgcggagaggagacctcccggtttggctggcgcacaaagtggcctctgagggcatcaagtacaccgatcgcaaatggtgcttcgacggggaacggaacaatcagatcctggaggagaacatggatgtcgaaatttggacaaaggagggagaaagaaagaaactccgccctcggtggcttgacgctagaacctattccgatcccctggccctgaaggagtttaaagacttcgctgccggccgcaagagcatcgcctttgatctcgtgacagaaattgggagagtcccttctcatctggcttaccggacgcgcaatgcgcttgacaacctggtgatgctccacacctccgagcatggaggcagagcctatcggcacgctgttgaggaactgcccgagacaatggaaaccctgctccttctgggcctgatgatcctcctgacagggggagccatgcttttcctgattagcggcaaagggatcggaaagacctccatcggcctcatttgtgtgatcgtgtctagcgggatgctgtggatggccgatgtccctctgcagtggattgcttccgccatcgttctcgagtttttcatgatggtgcttctgattcccgagccggaaaagcaacgcacgcctcaggacaatcagctggcgtacgtggtcatcggcattctcaccctggccgctatcgtggccgctaacgagatgggccttctggaaacaaccaaaagagatctcggcatgagcaaggagcccggggttgtgtctcccacatcctatctggacgtcgacctgcaccctgccagcgcgtggaccctctacgccgtggctacgacagtcatcaccccgatgcttcggcatacaattgaaaattctaccgccaacgtgagcctggctgccatcgctaaccaagccgttgtgctgatgggactcgataaaggctggcccatttccaagatggacctgggggtccctcttctggcgctcggatgctactctcaggtgaatcccctgaccctgacagccgctgttctccttctggtgacgcactatgccatcattggccctgggctgcaggctaaagccaccagagaggcccagaagcgcacagcggctggaatcatgaagaaccccaccgtcgatggcatcatgacaattgacctcgatcctgtgatctacgacagcaaatttgagaagcaactgggccaggtgatgcttctggttctctgtgccgtccagctgctgctcatgcggacctcctgggctctttgcgaagccctgacgctggccacagggccgattaccaccctctgggagggatctcccggcaaattctggaatacaaccatcgctgtgagcatggccaacatttttagagggtcctatctggcgggagccggccttgctttcagcatcatgaagtctgtggggatcggacgccggggcacaggctcccagggggaaacgctgggagagaaatggaagaagaaactcaatcaactgagcagaaaggaatttgatctgtacaaaaagtccggcattaccgaggtcgaccggacagaggccaaagaagggctcaagcgcggagagaccacacatcacgctgtttctagaggcagcgccaaacttcagtggttcgtggaacggaacatggtgatccctgaggggcgcgtcattgatctgggatgtggcagaggcgggtggtcctattactgcgcgggactgaagaaggtgaccgaagttcggggctatacgaaagggggacccggccatgaggagcctgtgcccatgtctacctacgggtggaatatcgtcaagctcatgagcggaaaagacgtgttctacctgccgcctgaaaagtgtgatacacttctgtgcgacattggcgagtccagcccctctcccaccgttgaagagtcccgcacaatcagagtgctcaaaatggtcgagccttggctgaagaacaatcagttttgtattaaggtgctgaacccctatatgcctaccgtgatcgaacacctcgagcggcttcagcgcaaatacggcgggatgctggtcagaaatccgctgagccggaactctacacacgaaatgtattggatctccaatggaaccggcaacattgttagctctgtgaatatggtgagcagactcctgcttaaccgcttcacgatgacacatcggagacccaccatcgagaaggatgtcgacctgggggccggaacccgccacgtgaacgctgaacctgagacacccaatatggacgttattggcgagcggatcaaaagaattaaggaagaacactcctctacgtggcactacgatgacgaaaacccttataaaacctgggcctaccacgggagctatgaggtgaaggctacaggatccgccagctccatgatcaatggcgtcgtgaagctcctgaccaaaccctgggatgttgtgccgatggtcacacaaatggctatgaccgacacaaccccttttggccagcagcgcgtgttcaaggaaaaagttgatacgcggacccccagacctatgcccgggacacgcaaggtgatggagatcaccgccgagtggctgtggcggacactcggaagaaacaaaaagcctcgcctgtgcacccgggaagagtttacgaagaaagtcagaacaaatgcggccatgggcgctgtgttcaccgaagagaaccaatgggactctgcccgcgctgccgtcgaagatgaggagttttggaaacttgtggacagagaacgggagctgcataaactcgggaagtgtggaagctgcgtttacaatatgatgggcaaacgcgaaaagaaactgggggagttcggcaaggccaagggatccagagcgatttggtacatgtggcttggcgctcggtatctggagtttgaagccctcgggttcctgaacgaggatcactggttttctagagaaaatagctactccggagtggagggcgaagggctgcataaactcggatatatcctgcgggacatttctaagatccccggcggggccatgtacgctgatgacacagccggctgggacacccgcattacggaggatgaccttcacaacgaggagaagatcacccagcagatggatccggagcatagacagctggctaatgccatcttcaagctcacatatcaaaacaaagtcgtgaaggtgcagcggcctacccccaagggaacagttatggacattatcagccgcaaagatcagagaggctccggacaggtgggaacctacggcctgaatacatttaccaacatggaagcgcaacttgtccggcagatggagggggaaggagtgctgagcaaggccgacctcgagaatccccatctgctggagaaaaagattacgcagtggctcgaaacaaaaggcgttgagcgcctgaagagaatggctatctctggggatgactgcgtggtcaagcctattgatgaccggttcgccaacgcccttctggccctcaacgatatgggcaaagtgcgcaaggacatcccgcagtggcaaccctccaaaggatggcacgattggcagcaggtccctttctgtagccatcactttcatgaactgatcatgaaggacggcagaaaacttgtggttccctgccggcctcaggacgagctgattgggcgcgcgagaatctctcaaggagccggctggtccctcaaggaaaccgcttgtctggggaaggcctatgctcagatgtggagcctgatgtacttccaccggcgcgatctcagactggcctctaatgctatttgctccgccgtgcccgtccactggatccctaccagccggacaacctggtccattcatgcgcaccatcagtggatgacaacggaggacatgcttaccgtgtggaacagagtttggatcgaggataatccctggatggaagacaaaacaccggtgaccacatgggaggatgtcccttacctgggaaagcgcgaagaccaatggtgtggcagcctcattgggctgacctctcgggccacgtgggctcagaacatccttaccgccatccaacaggtgagaagcctgattggcgatgaggagtttctcgactatatgccctccatgaaacgcttccggaaggaagaggaatctgagggagccatctggtga

SEQ ID NO: 20833 - RNA, 9873 nt, synthetic construct
  misc_feature 1..9873: note = derived and/or modified CDS sequence (opt5) from DENV-3__EU482456__SS-prME
  source 1..9873: mol_type = other RNA
accagcctgtgcctcatgatgatgctgcccgccacgcttgctttccacctgacgtcccgggacggagaacctcggatgatcgtggggaagaatgaacgcggaaagtctctcctgtttaagaccgccagcggcattaatatgtgtacacttatcgcgatggatctgggggagatgtgcgacgataccgtcacatacaagtgtccgctcattgctgaagttgagcccgaagacatcgattgctggtgtaacctgacctccacatgggtgacctatggaacgtgcaatcaggccggcgagcatcggcgggacaagcgctctgtggccctggctcctcacgtcgggatgggactcgataccagaacacagacctggatgagcgccgagggcgcttggagacaggtggaaaaagttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagaataaacccacgctcgacatcgagctgcagaagaccgaagctacacaacttgccaccctgcgcaaactctgtattgagggaaagatcacaaacattaccacggattccagatgccctacacagggcgaagcgatcctgccggaggaacaggaccagaattatgtgtgtaaacacacctacgtggatcggggctgggggaacggatgcggccttttcgggaagggaagcctggtgacatgcgccaagtttcaatgtctcgagcccattgagggcaaagtggttcagtatgaaaatctgaagtacacagtgatcatcaccgtccacacaggggaccagcatcaggtgggaaacgacacgcaaggcgttaccgtggagattacacctcaggcttctaccgtcgaagccgtgctgcccgagtatggcacactcgggctggaatgctcccctcgcaccggacttgatttcacggagatgatcctgctcaccatgaaaaataaggcttggatggtccacagacagtggtttttcgacctgccccttccgtggacaagcggcgccaccacagagacccctacgtggaaccggaaagaactgctcgtgacatttaagaatgcccatgctaaaaagcaagaggttgtggtcctggggtctcaggaaggagcgatgcacaccgccctgacaggcgctaccgagattcagaactccgggggcaccagcatcttcgccggacacctcaagtgtcgcctgaaaatggataaacttgaactgaaaggcatgtcttacgccatgtgcctcaatacatttgtgctgaagaaagaggtttccgagacgcagcatgggaccattctgatcaaggtggaatacaagggagaggacgctccctgtaaaatccctttcagcacagaagatggccaagggaaggcccacaacggaagacttattaccgcgaaccccgtcgtgaccaagaaggaggagcccgtgaatatcgaagctgagcctccgttcggcgaatccaacattgttatcgggattggcgacaaagccctcaagatcaattggtataagaaaggatctagcatcggcaagatgtttgaggccaccgctagaggggccagacgcatggctattctgggagatacggcctgggacttcggctccgtcgggggagtgctgaacagcctcggcaaaatggtgcatcagatctttgggtctgcgtacacagccctgttctccggcgtcagctggattatgaagatcggaattggcgtgcttctgacctggatcgggctcaattctaaaaacaccagcatgtccttttcttgcattgttatcggaatcattacactgtatctgggcgctgtggtccaggccgatatggggtgtgtgatcaattggaagggaaaggaacttaaatgcggcagcgggattttcgttaccaacgaggtgcacacatggacggagcagtacaagtttcaagctgactcccccaaacggctcgccaccgcgatcgccggcgcttgggaaaatggagtctgtggcattagaagcacaacccgcatggagaacctgctgtggaagcagatcgccaatgaactcaactatatcctgtgggagaataacattaaacttacagtggttgtgggggataccatcggagtcctggaacagggcaagcggacgctcacccctcagcccatggagctgaaatactcttggaagacatgggggaaggctaaaattgtgaccgccgagacacaaaattccagcttcatcattgacggacctaacacccccgaatgcccgtctgcctccagagcttggaacgtgtgggaggtcgaagactatggctttggcgttttcacaaccaatatctggctgaaacttcgcgaggtgtacacgcagagctgtgatcatcggctcatgtccgcggccatcaaagacgaaagagctgtgcacgccgatatggggtactggattgagtctcagaagaacggaagctggaaactggagaaggcctcctttatcgaagtcaagacatgcacctggcctaaatctcacaccctgtggagcaatggcgtgctcgagtccgacatgattatccccaagagcctggctgggcctatttctcagcataaccaccgccccggatatcatacacaaaccgccggcccttggcaccttgggaaactggaactcgatttcaattactgcgagggaacgacagttgtgatcaccgagaactgtggcacacggggcccctccctgagaaccacaaccgtcagcgggaagctgatccacgaatggtgctgtcgctcttgcacgcttccgcctctccggtatatgggagaggacggctgttggtacgggatggaaattagacccatcaatgagaaagaagagaacatggtgaagtccctggttagcgcgggatctggcaaggtggataattttaccatgggggtcctgtgcctcgctattctgttcgaggaagtgatgcggggaaaattcggcaagaaacatatgatcgccggcgttctttttacattcgtgctgctcctgagcgggcagattacctggcgcgacatggcccacacactgatcatgattggatccaacgctagcgatagaatgggcatgggggtcacctatcttgccctgatcgcgacgtttaagatccagcccttcctcgctctgggatttttcctccggaaactgacatctagagagaatcttctgctcggcgtggggctggccatggccaccacactgcaacttcctgaagacattgagcagatggctaacggaatcgccctgggcctcatgaccctgaagctcattacccagtttgaaacataccagctgtggacggctcttgtgtccctgacctgtagcaatacaatcttcaccctcacagtcgcctggcgcaccgcgacgctgattctggccggcgtttcccttctgccgctctgccaatctagctccatgcggaagacagattggctgcccatgaccgtggctgccatgggggtgcctcccctccctctgtttatcttctctcttaaagacacccccaagagacgcagctggcctctgaacgagggagtcatggctgtgggcctggtttccatcctcgcctctagcctgcttagaaatgatgtgcccatggccgggccgctggtcgctggaggcctcctgattgcgtgttatgtgatcacagggacctccgccgacctcacagttgagaaagctgccgacgtgacgtgggaagaggaagccgagcagaccggagtcagccataacctgatgattacagtggatgacgatggcaccatgcggatcaaggacgatgaaacagagaacattcttaccgtcctgctgaaaacggctctcctgatcgtgtctggcatctttccttactccattcccgccacccttctggtttggcacacatggcagaagcagacccaacgcagcggggtgctctgggacgtcccttctcccccggagacacagaaagcggaactggaggaaggagtgtacagaatcaagcagcagggcattttcgggaagacccaagttggagtgggcgtccagaaagagggggtgtttcatacaatgtggcacgtgacgcggggagctgttctcacccacaatggcaagcgcctggagcctaactgggcctccgtcaaaaaggatcttatcagctatggcgggggatggagactgtctgcccagtggcaaaaaggcgaagaggtccaggtgattgctgtcgaacccgggaagaatcctaagaacttccagacaatgcccggaatcttccagaccaccacaggcgagattggggccatcgcgctggactttaaacccggaacgtccggcagccctatcattaatcgggaaggcaaggtggttgggctctacggaaacggcgtggtcaccaaaaatgggggatatgtgtccggcatcgctcaaacaaacgccgagccggatgggcccacccctgagctggaagaggaaatgttcaagaaacgcaatcttacaattatggacctgcatcccggcagcggaaagaccagaaagtacctccctgccatcgttcgggaggctattaaacgcagactgcggacgctcatcctggcccccacaagagtggtcgctgccgaaatggaggaggcgcttaagggcctgcctatccgctatcagaccaccgccacaaaatctgaacacaccgggcgggagattgtggatctgatgtgccatgctacatttaccatgagactcctgagcccggttcgcgtgcccaactacaatcttatcattatggacgaagcccacttcacggatcctgcttccatcgccgcccggggatatatttctacaagagtcggcatgggggaggctgcggccatctttatgaccgctacaccccctggaaccgccgaagccttcccccagagcaacgctccgatccaggacgaggagcgcgacattcctgaacggtcctggaactctggcaacgagtggatcacggattttgtggggaagaccgtgtggttcgtccccagcattaaagccggcaatgacatcgcgaactgtctgagaaagaacggaaagaaagttattcaactctcccgcaagacatttgataccgaataccagaaaacacggctgaatgactgggatttcgtggtgaccacagacatctctgagatgggcgctaactttaaggccgatagagtcattgacccccggcgctgcctgaaacctgtgatcctcaccgatgggcccgagagagttatccttgccggacctatgccggtgacggctgccagcgcggcccagcggcgcggcagagtcgggcggaatccccagaaggaaaacgaccaatacattttcacaggacagcctctgaataacgatgaggaccatgctcactggaccgaagccaagatgctgctcgacaatatcaacacccccgagggcattatccctgctctgttcgaacccgagagagagaaatccgccgctattgatggggaatatcgccttaagggcgagagccggaaaacatttgtggaactgatgagacgcggagacctcccggtttggctggcccacaaggtggcgtctgagggcatcaaatacaccgatcggaagtggtgcttcgacggggaaagaaataaccagatcctggaggagaatatggatgtcgaaatttggacaaaagagggagaacgcaagaagctccggcctagatggcttgacgcccgcacgtattccgatcccctggctctgaaagagtttaaggacttcgccgctggcagaaaaagcatcgccctcgatctggtgaccgaaattgggcgggtcccttctcatcttgcctaccgcacaagaaacgctctggacaatctcgtgatgctgcacacctccgagcatggaggccgggcgtatcgccacgccgttgaggaactgcccgagacaatggaaaccctccttctgctgggcctcatgatcctgcttacaggcggggctatgctgtttctcattagcgggaaggggatcggaaaaacctccatcggcctgatttgtgtgatcgtgtctagcgggatgctgtggatggccgatgtccctctccagtggattgcctccgctatcgttcttgagttctttatgatggtgctgctgattcccgagccggaaaagcaaagaacacctcaggacaaccagctcgcctacgtggtcatcggcattctgacccttgcggccatcgtggctgccaatgagatgggcctgctcgaaacaaccaagcgggatctgggcatgagcaaagagcccggggttgtgtctcccacgtcctatctggacgtcgacctccaccctgctagcgcctggacactttacgcggtggccaccacagtcatcaccccgatgctgagacataccattgaaaactctacagctaatgtgagcctggccgctatcgccaaccaagctgttgtgctcatgggactggataagggctggcccatttccaaaatggaccttggggtccctctgctcgccctgggatgctactctcaggtgaaccccctgacgctcaccgcggccgttcttctgctggtgacacactatgctatcattggccctgggctccaggccaaggctacccgcgaggcccagaaacggacagccgcgggaatcatgaagaatcccaccgtcgatggcatcatgacgattgacctggatcctgtgatctacgacagcaagttcgagaaacaacttggccaggtgatgctgctcgttctgtgtgctgtccagctgctccttatgagaacatcctgggccctgtgcgaagctctgaccctcgccaccgggccgattacaaccctgtgggagggatctcccggcaagttttggaacacaacgatcgccgtgagcatggctaatattttccgcgggtcctatcttgccggagcgggcctggcctttagcatcatgaaatctgtggggaccggacggagaggcacaggctcccagggggaaaccctcggagagaagtggaaaaagaagctgaaccaactgagccggaaagagttcgatctctacaagaaatccggcatcacagaggtcgaccgcaccgaggctaaggaagggcttaaaagaggagagacgacccatcacgccgtttctcggggcagcgctaagctgcagtggtttgtggaacgcaatatggtgattcctgaggggagagtcatcgatctgggatgtggccggggcgggtggtcctattactgcgccggactcaaaaaggtgacagaagttcgcggctataccaaagggggacccggccatgaggagcctgtgcccatgtctacatacgggtggaacattgtcaaactgatgagcggaaaggacgtgttctaccttccgcctgaaaaatgtgataccctgctctgcgacatcggcgagtccagcccctctcccacagttgaagagtccagaaccattcgggtgctgaagatggtcgagccttggctgaaaaataaccagttctgtatcaaggtgctcaatccctatatgcctacggtgattgaacaccttgagcgcctgcagagaaagtacggcgggatgctggtccggaacccgctcagcagaaattctacacacgaaatgtattggatctccaacggaaccggcaatatcgttagctctgtgaacatggtgagccgcctgcttctgaatcggtttaccatgacacatagacgccccacgattgagaaagatgtcgacctcggggcgggaacccggcacgtgaacgccgaacctgagacacccaacatggacgttatcggcgagagaattaagcgcatcaaagaagaacactcctctacctggcactacgatgacgaaaatccttataagacatgggcttaccacgggagctatgaggtgaaagccaccggatccgctagctccatgattaacggcgtcgtgaagctgctgacaaagccctgggatgttgtgccgatggtcacccaaatggccatgacggacaccacacctttcggccagcagcgggtgtttaaagaaaaggttgataccagaacaccccgccctatgcccgggacccggaaagtgatggagatcacggctgagtggctctggagaacactgggacgcaataagaaacctcggctttgcaccagagaagagttcacaaagaaggtccgcaccaacgccgcgatgggcgccgtgtttacggaagagaatcaatgggactctgctagagccgctgtcgaagatgaggagttctggaaactggtggaccgggaacgcgagctccataagctggggaaatgtggaagctgcgtttacaacatgatgggcaagagagagaagaaacttggggagtttggcaaagccaagggatcccgggccatctggtacatgtggctgggcgcgagatatctcgagttcgaagctctggggtttctgaatgaggatcactggttctctcgggaaaacagctactccggagtggagggcgaagggctccataagctgggatatattcttcgcgacatctctaaaattcccggcggggccatgtacgccgatgacaccgctggctgggacacaagaatcaccgaggatgacctgcacaatgaggaaaagattacacagcagatggatccggagcatcggcagctcgccaacgctatctttaaactgacctatcaaaataaggtcgtgaaagtgcagcgccctacacccaagggaaccgttatggacatcattagcagaaaggatcagcggggctccggacaggtgggaacgtacggccttaacacattcaccaatatggaagcccaactggtccgccagatggagggggaaggagtgctcagcaaagcggacctggagaacccccatctgctcgagaagaaaatcacccagtggctggaaacaaagggcgttgagagacttaaacggatggccatttctggggatgactgcgtggtcaagcctatcgatgaccgctttgctaatgccctgctcgctctgaacgatatgggcaaggtgagaaaagacattccgcagtggcaaccctccaagggatggcacgattggcagcaggtccctttctgtagccatcacttccatgaacttatcatgaaagacggccggaagctggtggttccctgccgccctcaggacgagctcatcgggagagcccggatttctcaaggagcgggctggtccctgaaagaaaccgcctgtctggggaaggcttatgcccagatgtggagcctcatgtactttcaccgcagagatctgcggcttgcttctaacgccatctgctccgctgtgcccgtccactggattcctacaagcagaacgacctggtccatccatgcccaccatcagtggatgacaaccgaggacatgctgacagtgtggaatcgcgtttggattgaggataacccctggatggaagacaagaccccggtgacgacctgggaggatgtcccttacctcggaaaacgggaagaccaatggtgtggcagcctgatcgggcttacatctagagcgacctgggcccagaatattctgacagctatccaacaggtgcgcagcctcatcggcgatgaggagttcctggactatatgccctccatgaagcggtttagaaaagaagaggaatctgagggagccatttggtga

SEQ ID NO: 20834 - RNA, 9873 nt, synthetic construct
  misc_feature 1..9873: note = derived and/or modified CDS sequence (opt5) from DENV-3__EU482457__SS-prME
  source 1..9873: mol_type = other RNA
accagcttctgcctgatgatgatgctccccgccacactggcttttcaccttacgtccagagacggcgagcctcggatgatcgtggggaagaacgaacgcggaaaatctctgctcttcaagaccgccagcggcattaatatgtgtacactgatcgcgatggatcttggggagatgtgcgacgataccgtcacatacaaatgtccgctgattgctgaagttgagcccgaagacatcgattgctggtgtaacctcacctccacatgggtgacctatggaacgtgcaatcaggccggcgagcatagacgggacaagcgctctgtggccctggctcctcacgtcgggatgggactggataccagaacacaaacctggatgagcgccgagggcgcttggcggcaggtggaaaaagttgagacatgggccctccgccatcccggctttaccattctggcgcttttcctggcccactacatcgggacgtccctcacacagaaggtggtcatctttattctgcttatgctggtgaccccttctatgacaatgagatgtgttggagtgggcaaccgggacttcgtcgaagggctcagcggagctacctgggtggatgtggtcctggagcatggcgggtgcgttaccacaatggccaagaataaacccacgctggacatcgagctccagaagaccgaagctacacaactggccacccttcgcaaactgtgtattgagggaaagatcacaaacattaccacggattccagatgccctacacagggcgaagcgaccctcccggaggaacaggaccagaattatgtgtgtaaacacacctacgtggatcggggctgggggaacggatgcggcctgtttgggaagggaagccttgtcacatgcgccaagttccaatgtctggagcccatcgagggcaaagtggttcagtatgaaaatctcaagtacaccgtgattatcacagtccacacgggggaccagcatcaggtgggaaacgacacccaaggcgttacagtggagatcacccctcaggcttctacagtcgaagccgtgctgcccgagtatggcattctggggctcgaatgctcccctcgcaccggactggattttaatgagatgatccttctgacgatgaaaaacaaggcttggatggtccacagacagtggttctttgacctccccctgccgtggaccagcggcgccacaaccgagacacctacctggaatcggaaagaacttctggtgacgttcaagaacgcccatgctaaaaagcaagaggttgtggtcctcgggtctcaggaaggagcgatgcacacagccctgaccggcgctacagagattcagaattccgggggcaccagcatctttgccggacacctgaagtgtcgcctcaaaatggatagactggaacttaagggcatgtcttacgccatgtgcctgaacaccttcgtgctcaaaaaggaggtttccgagacacagcatgggacgattctgatcaaagtggaatacaagggagaggacgctccctgtaagatccctttcagcaccgaagatggccaagggaaagcccacaacggacggctgattacagcgaatcccgtcgtgaccaagaaagaggagcccgtgaacatcgaagctgagcctccgtttggcgaatccaatattgttatcgggattggcgacaaggcccttaaaatcaactggtataagaagggatctagcatcggcaaaatgttcgaggccacagctagaggggcccgccggatggctattctcggagataccgcctgggactttggctccgtcgggggagtgctgaatagcctgggcaagatggtgcatcagatcttcgggtctgcgtacacggccctcttttccggcgtcagctggattatgaaaatcggaattggcgtgctgcttacatggatcgggctgaactctaagaataccagcatgtccttctcttgcattgttatcggaatcattaccctctatctgggcgctgtggtccaggccgatatggggtgtgtgatcaactggaaaggaaaggaactgaagtgcggcagcgggatttttgttacaaatgaggtgcacacctggacagagcagtacaaattccaagctgactcccccaagagacttgccacggcgatcgccggcgcttgggaaaacggagtctgtggcattcgcagcaccacacggatggagaatctcctgtggaaacagatcgccaacgaactgaattatatcctctgggagaacaatattaagctgaccgtggttgtgggggatacaatcggagtccttgaacagggcaaaagaaccctgacgcctcagcccatggagctcaagtactcttggaaaacctgggggaaggctaagattgtgacagccgagacccaaaactccagctttatcattgacggacctaacacacccgaatgcccgtctgcctcccgcgcttggaatgtgtgggaggtcgaagactatggcttcggcgtttttaccacaaacatctggctgaaactgcgggaggtgtacacccagagctgtgatcatagacttatgtccgcggccatcaaggacgaacgcgctgtgcacgccgatatggggtactggattgagtctcagaaaaatggaagctggaagctcgagaaagcctccttcatcgaagtcaagacgtgcacatggcctaagtctcacaccctgtggagcaacggcgtgctggagtccgacatgattatccccaaaagcctcgctgggcctatttctcagcataatcaccggcccggatatcatacccaaacagccggcccttggcacctggggaagcttgaactggattttaactactgcgagggaaccacggttgtgatcacagagaattgtggcaccagaggcccctccctccgcacaaccacagtcagcgggaaactgatccacgaatggtgctgtcggtcttgcaccctgccgcctcttagatatatgggagaggacggctgttggtacgggatggaaattcggcccatcaacgagaaggaagagaatatggtgaaatccctcgttagcgcgggatctggcaaggtggataacttcacgatgggggtcctgtgcctggctattctcttcgaggaagtgatgcgcggaaagtttggcaaaaagcatatgatcgccggcgttctgttcacctttgtgcttctgctcagcgggcagattacatggagagacatggcccacaccctgatcatgattggatccaatgctagcgatcggatgggcatgggggtcacatatctggcccttatcgcgaccttcaaaatccagccctttctggctctcggattctttctgagaaagctcacgtctcgcgagaacctgcttctgggcgtggggctcgccatggccacaaccctgcaactgcctgaagacattgagcagatggctaatggaatcgcccttggcctgatgacactcaaactgattacccagttcgaaacctaccagctctggacagctctggtgtcccttacgtgtagcaacaccatctttacactgaccgtcgcctggcggacagcgaccctcattctggccggcgtttccctgcttccgctgtgccaatctagctccatgagaaagacggattggctccccatgacagtggctgccatgggggtgcctcccctgcctctcttcatcttttctctgaaggacacccccaaacgcagaagctggcctcttaatgagggagtcatggctgtgggcctggtttccatcctggcctctagcctcctgcggaacgatgtgcccatggccgggccgcttgtcgctggaggcctgctcattgcgtgttatgtgatcaccgggacatccgccgacctgaccgttgagaaggctgccgacgtgacatgggaagaggaagccgagcagacgggagtcagccataacctcatggtgaccgtcgatgacgatggcacaatgcgcattaaagacgatgaaaccgagaatatcctgacagtgcttctgaagaccgctctgctcattgtttctggcatcttcccttactccatccccgccacgctgcttgtgtggcacacctggcagaaacagacacaaagaagcggggtcctgtgggacgtgccttctcccccggagacccagaaggcggaactcgaggaaggagtttaccggattaaacagcagggcatctttgggaagacacaagtgggagtcggcgtgcagaaggagggggtgttccataccatgtggcacgttacacgcggagctgtcctgacgcacaacggcaaaagactcgagcctaattgggcctccgtgaagaaagatctgattagctatggcgggggatggcggctttctgcccagtggcaaaagggcgaagaggtgcaggtcatcgctgtggaacccgggaaaaaccctaagaatttccagaccatgcccggaatttttcagacaaccaccggcgagatcggggccattgcgctggacttcaagcccggaacatccggcagccctatcatcaaccgcgaaggcaaagttgtggggctgtacggaaatggcgtcgtgacgaagaacgggggatatgtttccggcattgctcaaaccaatgccgagccggatgggcccacacctgagctcgaagaggaaatgtttaaaaagagaaacctgaccatcatggaccttcatcccggcagcggaaaaacacggaagtacctgcctgccattgtgcgcgaggctatcaagagacggctcagaaccctgattctcgcccccacgcgcgtcgtggctgccgaaatggaggaggcgctgaaaggccttcctatccggtatcagacaaccgccaccaagtctgaacacacagggagagagatcgttgatctgatgtgccatgctaccttcacaatgcgcctgctcagcccggtgcgggtccccaattacaacctgattatcatggacgaagcccactttaccgatcctgcttccattgccgccagaggatatatctctacgcgcgtgggcatgggggaggctgcggccattttcatgacagctaccccccctggaacagccgaagcctttccccagagcaatgctccgatccaggacgaggagcgggacatccctgaaagatcctggaactctggcaatgagtggattaccgatttcgtggggaaaacggtctggtttgttcccagcatcaaggccggcaacgacattgcgaactgtcttcgcaaaaatggaaagaaggtgatccaactgtcccggaaaaccttcgatacagaataccagaagaccagactcaacgactgggattttgtggtcacaaccgacatttctgagatgggcgctaatttcaaagccgatcgggtgatcgacccccgcagatgcctgaagcctgttattctgacagatgggcccgagcgggtgatcctcgccggacctatgccggtcaccgctgccagcgcggcccagcgcagaggccgggtggggagaaacccccagaaagaaaatgaccaatacatcttcacgggacagcctcttaacaatgatgaggaccatgctcactggacagaagccaagatgctgctggacaacattaatacccccgagggcatcattcctgctctctttgggcccgaacgcgagaagtccgccgctatcgatggcgagtatcggctgaaaggagaaagcagaaagaccttcgttgagcttatgcgccggggcgacctgccggtgtggctcgcctacaaagtcgcgtctgaagggattaagtatacagatagaaaatggtgctttgacggagagcgcaacaatcagatcctggaagagaacatggatgtggagatctggaccaaggaaggcgagcggaaaaagctgagacctcgctggctcgacgccagaacatactccgatccccttgctctgaaggaattcaaagactttgccgctgggcggaagagcattgccctggatctcgtcacggagatcggacgcgtgccttctcacctggcccatagaacccggaatgctcttgacaacctggttatgctccacacatccgaacatggcggccgcgcgtatagacacgccgtggaggagctgcccgaaaccatggagacactgctccttctggggctgatgattctcctgaccggaggcgctatgcttttcctgatcagcgggaaaggaattggcaagacgtccatcgggctcatctgtgtgattgtctctagcggaatgctgtggatggccgatgttcctctgcagtggatcgcctccgctattgtgctcgaatttttcatgatggtgcttctgatccccgagccggagaaacaacggacccctcaggacaatcagctggcctacgtcgtgattggcatcctcacactggcggccattgttgctgccaacgaaatgggccttctggagaccacaaagagagatctcgggatgagcaaggaacccggagtggtctctcccacctcctatctggacgtggacctgcaccctgctagcgcctggacgctctacgcggtcgccacaaccgtgatcacaccgatgcttcgccataccatcgagaattctaccgctaacgttagcctggccgctattgccaaccaagctgtggtcctgatgggcctcgataaagggtggcccatctccaagatggacctgggagtgcctcttctggccctcggctgctactctcaggttaatcccctgacactgacggcggccgtgctccttctggtcacccactatgctattatcgggcctggactgcaggccaaagctacacgggaagcccagaagagaaccgccgcgggcattatgaaaaaccccacagtggatggcatcatgaccatcgacctcgatcctgtgatttacgacagcaagtttgagaagcaactggggcaggttatgcttctggtcctctgtgctgtgcagctgctgctcatgcgcacgtcctgggccctttgcgaggctctgacactggccaccggaccgatcaccacactctgggaaggctctcccgggaaattctggaataccacaattgccgtgagcatggctaacatctttcggggatcctatctggccggcgcggggcttgccttcagcattatgaagtctgtcggaacgggcagacggggcaccgggtcccagggagagacactgggcgaaaaatggaagaaaaagctcaatcaactgagccgcaaggagtttgatctgtacaaaaagtccgggatcaccgaagttgacagaacagaggctaaagagggactcaagcggggcgaaaccacgcatcacgccgtgtctcgcgggagcgctaaacttcagtggttcgtggagagaaacatggtcatccctgaaggacgggtgattgatctgggctgtggccgcgggggatggtcctattactgcgccggcctgaagaaagttaccgaggtgagagggtatacaaagggaggccccgggcatgaagagcctgtccccatgtctacctacggatggaatatcgtgaagctcatgagcggcaaagacgttttctacctgccgcctgagaagtgtgatacacttctgtgcgacattggcgaatccagcccctctcccaccgtggaggaatcccggacaatccgcgtcctcaaaatggtggagccttggctgaagaacaatcagttttgtattaaagtgctgaacccctatatgcctaccgtcatcgagcacctcgaaagacttcagcggaagtacgggggaatgctggttagaaatccgctgagccgcaactctacgcacgagatgtattggatttccaatggcacagggaacatcgtgagctctgtgaatatggtcagccggctcctgcttaacagattcaccatgacccatcgccggcccacaatcgaaaaggatgtggacctgggagcgggcacgagacacgttaacgccgagcctgaaacccccaatatggacgtgattggggagcgcatcaaacggattaaggaggaacattcctctacatggcactacgatgacgagaacccttataaaacctgggcttaccacggaagctatgaagtcaaggccacaggctccgctagctccatgatcaatggcgtggttaaactcctgaccaagccctgggatgtggtcccgatggtgacacaaatggccatgaccgacacgaccccttttgggcagcagagagttttcaaggagaaagtggatacacgcaccccccggcctatgcccggaacaagaaaggtcatggaaattaccgctgagtggctgtggcgcacgctcggccggaacaaaaagcctagactgtgcacacgcgaggaatttaccaaaaaggtgagaacaaatgccgcgatgggggccgtcttcaccgaggaaaaccaatgggacaatgctcgggccgctgtggaggatgaagagttttggaagcttgttgaccgcgagagagaactgcataaactcggaaagtgtggctcttgcgtgtacaacatgatggggaaacgggagaagaaactgggcgaattcggaaaggccaaaggcagcagagccatctggtacatgtggcttggggcgcggtatctggagtttgaggctctcggattcctgaatgaagatcactggttttcccgcgagaactcttacagcggcgtcgaaggggagggactgcataagctcggctatatcctgagagacatttccaagatccccgggggcgccatgtacgccgatgacacggctggatgggacacccggattacagaagatgaccttcacaatgaggagaaaatcacccagcagatggatccggaacatcgccagctggccaacgctattttcaagctcacatatcaaaataaagtggtgaaggttcagagacctacccccaaaggcacagtgatggacatcatctctcggaaggatcagcgcgggagcggacaggtcggcacctacgggctgaacacgtttacaaatatggaggcccaacttgtgagacagatggaaggagagggcgttctgtccaaggcggacctcgaaaacccccacctgctggagaaaaagattacccagtggctcgagaccaaaggggtggaacggctgaagcgcatggccatcagcggcgatgactgcgtcgtgaaacctattgatgacagattcgctaacgcccttctggctctcaatgatatgggaaaggtccggaaggacatcccgcagtggcaaccctctaaaggctggcacgattggcagcaggtgcctttctgttcccatcactttcatgagctgattatgaaggacgggcgcaaacttgttgtgccctgcagacctcaggacgaactgatcggacgggcccgcatcagccaaggcgcggggtggtctctcaaggagacagcctgtctgggaaaagcttatgcccagatgtggtccctgatgtacttccacagacgggatctcagactggctagcaacgccatttgctctgctgtccccgtgcactggatccctacctcccgcacaacgtggagcattcatgcccaccatcagtggatgaccacagaagacatgcttaccgtttggaatcgggtgtggatcgaggataacccctggatggaggacaagacaccggtcaccacgtgggaagatgtgccttacctgggcaagagagaggaccaatggtgtgggtccctcattggcctgaccagccgcgcgacatgggcccagaatatccttaccgctattcagcaggtgcggtctctgatcggagatgaagagtttctcgactatatgcccagcatgaaaagattccgcaaggaggaagagtccgaaggcgccatctggtga

SEQ ID NO: 20835 - RNA, 9873 nt, synthetic construct
  misc_feature 1..9873: note = derived and/or modified CDS sequence (opt5) from DENV-3__EU482458__SS-prME
  source 1..9873: mol_type = other RNA
acaagcctgtgcctcatgatgatgctgcccgccacacttgctttccacctgacgtcccgggacggcgaacctcggatgatcgtggggaagaacgaacgcggaaagtctctcctgtttaagaccgccagcggcattaatatgtgtacacttatcgcgatggatctgggggaaatgtgcgacgataccgtcacatacaaatgtccgctcattgctgaagttgagcccgaagacatcgattgctggtgtaacctgacctccacatgggtgacctatggaacgtgcaatcaggccggcgagcatcggcgggacaagcgctctgtggccctggctcctcacgtcgggatgggactcgataccagaacacagacctggatgagcgccgagggcgcttggagacaggtggaaaaagttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagaataaacccacgctcgacatcgagctgcagaagaccgaagctacacaacttgccaccctgcgcaaactctgtattgagggaaagatcacaaacattaccacggattccagatgccctacacagggcgaagcgatcctgccggaggaacaggaccagaattatgtgtgtaaacacacctacgtggatcggggctgggggaacggatgcggccttttcgggaagggaagcctggtcacatgcgccaagtttcaatgtctcgagcccattgagggcaaagtggttcagtatgaaaatctgaagtacacagtgatcatcaccgtccacacaggggaccagcatcaggtgggaaacgacacgcaaggcgttaccgtggagattacacctcaggcttctaccgtcgaagccgtgctgcccgagtatggcacactcgggctggaatgctcccctcgcaccggacttgatttcaatgagatgatcctgctcacgatgaaaaacaaggcttggatggtccacagacagtggtttttcgacctgccccttccgtggaccagcggcgccacaaccgagacacctacctggaatcggaaagaactgctcacgacatttaagaacgcccatgctaaaaagcaagaggtggttgtgctggggtctcaggaaggagcgatgcacaccgccctgacaggcgctaccgagattcaaaattccgggggcaccagcatcttcgccggacacctcaagtgtcgcctgaaaatggataaacttgaactgaaaggcatgtcttacgccatgtgcctcaacacatttgtcctgaagaaagaggtgtccgagacgcagcatgggaccattctgatcaaggttgaatacaagggagaggacgctccctgtaaaatccctttcagcacagaagatggccaagggaaggcccacaacggaagacttattaccgcgaatcccgtggtcaccaagaaggaggagcccgtgaacatcgaagctgagcctccgttcggcgaatccaatattgtgatcgggattggcgacaaagccctcaagatcaactggtataagaaaggatctagcatcggcaagatgtttgaggccaccgctagaggggccagacgcatggctattctgggagatacggcctgggacttcggctccgttgggggagtcctgaatagcctcggcaaaatggtgcatcagatctttgggtctgcgtacacagccctgttctccggcgtgagctggattatgaagatcggaattggcgtccttctgacctggatcgggctcaactctaaaaataccagcatgtccttttcttgcattgtgatcggaatcattacactgtatctgggcgctgttgtgcaggccgatatggggtgtgctatcaactggaagggaaaggaacttaaatgcggcagcgggattttcgtcaccaatgaggtgcacacatggacggagcagtacaagtttcaagccgactcccccaaacggctcgcgaccgccatcgctggcgcctgggaaaacggagtttgtggcattagaagcacaacccgcatggagaatctgctgtggaagcagatcgctaacgaactcaattatatcctgtgggagaacaatattaaacttacagtggtcgtgggggatatcattggagttctggaacagggcaagcggaccctcacgcctcagcccatggagctgaaatactcttggaagacctgggggaaggccaaaatcgtgacagccgagacccaaaactccagcttcattatcgacggacctaacacacccgaatgcccgtctgcttccagagcgtggaatgtctgggaggtggaagactatggctttggcgtgttcaccacaaacatctggctgaaacttcgcgaggtctacacccagagctgtgatcatcggctcatgtccgccgctattaaagacgaaagagccgttcacgccgatatggggtactggatcgagtctcagaagaatggaagctggaaactggagaaggcttcctttattgaagtgaagacgtgcacatggcctaaatctcacaccctgtggagcaacggcgtgctcgagtccgacatgatcattcccaagagcctggccgggcctatctctcagcataatcaccgccccggatatcatacccaaacagcgggcccttggcaccttgggaaactggaactcgatttcaactactgcgagggaaccacggtcgtgatcacagagaattgtggcatgcggggcccctccctgagaaccacaaccgttagcgggaagctgattcacgaatggtgctgtcgctcttgcacacttccgcctctccggtatatgggagaggacggctgttggtacgggatggaaatcagacccattaacgagaaagaagagaatatggtgaagtccctggtcagcgctggatctggcaaggtggataactttaccatgggggttctgtgcctcgccatcctgttcgaggaagtgatgcggggaaaattcggcaagaaacatatgattgccggcgtcctttttacgttcgtgctgctcctgagcgggcagatcacctggcgcgacatggctcacacactgattatgatcggatccaatgccagcgatagaatgggcatgggggttacctatcttgcgctgatcgctacatttaagattcagcccttcctcgccctgggatttttcctccggaaactgacctctagagagaaccttctgctcggcgtggggctggccatggctacgacactgcaacttcctgaagacatcgagcagatggccaatggaattgctctgggcctcatgaccctgaagctcatcacacagtttgaaacctaccagctgtggaccgcccttgtctccctgacatgtagcaacacgattttcaccctcacagtggcgtggcgcaccgccacactgatcctggctggcgtgtcccttctgccgctctgccaatctagctccatgcggaagaccgattggctgcccatgacggtcgccgctatgggggttcctcccctccctctgtttatcttctctcttaaagacacacccaagagacgcagctggcctctgaatgagggagtgatggccgtgggcctggtctccattctcgcctctagcctgcttagaaacgatgtgcccatggctgggccgctggttgcgggaggcctcctgatcgcctgttatgtgattaccgggacctccgctgacctcacagtcgagaaagccgccgacgtgacctgggaagaggaagctgagcagacaggagttagccataacctgatgatcacggtggatgacgatggcaccatgcggattaaggacgatgaaacagagaatatccttaccgtcctgctgaaaacagccctcctgatcgtgtctggcatttttccttactccatccccgcgacccttctggtctggcacacgtggcagaagcagacccaacgcagcggggtgctctgggacgttccttctcccccggagacacagaaagctgaactggaggaaggagtgtacagaattaagcagcagggcatcttcgggaagacccaagtcggagtgggcgttcagaaagagggggtgtttcatacaatgtggcacgtcacccggggagccgtgctcacacacaacggcaagcgcctggagcctaattgggcctccgtgaaaaaggatcttattagctatggcgggggatggagactgtctgctcagtggcaaaaaggcgaagaggttcaggtcatcgccgtggaacccgggaagaaccctaagaatttccagacgatgcccggaattttccagaccacaaccggcgagatcggggcgatcgctctggactttaaacccggaacctccggcagccctattatcaaccgggaaggcaaggtggtcgggctctacggaaatggcgtggttaccaagaacgggggatatgtgtccggcattgcccaaacgaatgccgagccggatgggcccacccctgagctggaagaggaaatgttcaagaaacgcaaccttacaatcatggacctgcatcccggcagcggaaagaccagaaagtacctccctgctattgtccgggaggccatcaaacgcagactgcggacactcatcctggctcccaccagagtggttgccgcggaaatggaggaggcccttaagggcctgcctattcgctatcagacgacagctaccaaatctgaacacaccgggcgggagatcgtggatctgatgtgccatgccacatttaccatgagactcctgagcccggtccgcgtgcccaattacaaccttattatcatggacgaagctcacttcacagatcctgcctccattgccgctcggggatatatctctaccagagttggcatgggggaggcggccgctatctttatgacggccacaccccctggaaccgccgaggctttcccccagagcaatgccccgattcaggacgaggagcgcgacatccctgaacggtcctggaactctggcaatgagtggattacagattttgtggggaagaccgtctggttcgtgcccagcatcaaagcgggcaacgacattgctaactgtctgagaaagaatggaaagaaagtgatccaactctcccgcaagacgtttgataccgaataccagaaaacacggctgaacgactgggatttcgtcgttaccacagacatttctgagatgggcgccaattttaaggccgatagagtgatcgacccccggcgctgcctgaaacctgtgatcctcaccgatgggcccgagagagtcattcttgctggacctatgccggtgacagccgcgagcgccgctcagcggcgcggcagagttgggcggaacccccagaaggaaaatgaccaatacatcttcaccggacagcctctgaacaatgatgaggaccatgcccactggacggaagctaagatgctgctcgacaacattaatacacccgagggcatcattcctgccctgttcgaacccgagagagagaaatccgctgccatcgatggggaatatcgccttaagggcgagagccggaaaacctttgtggaactgatgagacgcggagacctcccggtctggctggcgcacaaggtggcctctgagggcatcaaatacaccgatcggaagtggtgcttcgacggggaaagaaacaatcagattctggaggagaacatggatgttgaaatctggacaaaagagggagaacgcaagaagctccggcctagatggcttgacgctcgcacctattccgatcccctggccctgaaagagtttaaggacttcgctgccggcagaaaaagcattgccctcgatctggtgacagaaatcgggcgggtcccttctcatcttgcttaccgcacgagaaatgcgctggacaacctcgtgatgctgcacacctccgagcatggaggccgggcctatcgccacgctgtcgaggaactgcccgagacaatggaaaccctccttctgctgggcctcatgattctgcttacagggggagccatgctgtttctcatcagcggcaaggggatcggaaaaacctccattggcctgatctgtgtgattgtttctagcgggatgctgtggatggccgatgtgcctctccagtggatcgcttccgccattgtgcttgagttctttatgatggtcctgctgatccccgagccggaaaagcaaagaacgcctcaggacaatcagctcgcgtacgttgtgattggaatcctgacccttgccgctatcgtggccgctaacgagatgggcctgctcgaaacaaccaagcgggatctgggcatgagcaaagagcccggggtcgtgtctcccacatcctatctggacgttgacctccaccctgccagcgcgtggaccctttacgccgtggctacgacagtcattaccccgatgctgagacatacaatcgaaaattctaccgccaacgtgagcctggctgccattgctaaccaagccgtcgtgctcatgggactggataagggctggcccatctccaaaatggaccttggggttcctctgctcgcgctgggatgctactctcaggtgaatcccctgaccctcacagccgctgtccttctgctggtgacgcactatgccattatcggccctgggctccaggctaaggccacccgcgaggcccagaaacggacagcggctggaatcatgaagaaccccaccgttgatggcattatgacaatcgacctggatcctgtgatttacgacagcaagttcgagaaacaacttggccaggtcatgctgctcgtgctgtgtgccgtgcagctgctccttatgagaacctcctgggctctgtgcgaagccctgacgctcgccacagggccgatcaccaccctgtgggagggatctcccggcaagttttggaatacaaccattgctgttagcatggccaacatcttccgcgggtcctatcttgcgggagccggcctggcttttagcatcatgaaatctgtcgggacaggacggagaggcacgggctcccagggggaaaccctcggagagaagtggaaaaagaagctgaatcaactgagccggaaagagttcgatctctacaagaaatccggcattacagaggtggaccgcaccgaggccaaggaagggcttaaaagaggagagacaacccatcacgctgtgtctcggggcagcgccaagctgcagtggtttgtcgaacgcaacatggttatccctgaggggagagtgattgatctgggatgtggccggggcgggtggtcctattactgcgcgggactcaaaaaggtgacggaagtccgcggctataccaaaggcgggcccgggcatgaggagcctgtgcccatgtctacatacgggtggaatatcgttaaactgatgagcggaaaggacgtgttctaccttccgcctgaaaaatgtgataccctgctctgcgacattggcgagtccagcccctctcccacagtcgaagagtccagaaccatccgggtgctgaagatggttgagccttggctgaaaaacaatcagttctgtattaaggtgctcaacccctatatgcctacagtcatcgaacaccttgagcgcctgcagagaaagtacggcgggatgctggtgcggaatccgctcagcagaaactctacccacgaaatgtattggatctccaatggaacgggcaacattgtgagctctgtcaatatggttagccgcctgcttctgaaccggtttacaatgacccatagacgccccaccatcgagaaagatgtggacctcggggccggaacacggcacgtgaacgctgaacctgagacgcccaatatggacgtcattggcgagagaatcaagcgcattaaagaagaacactcctctacctggcactacgatgacgaaaacccttataagacatgggcctaccacgggagctatgaggtgaaagctaccggatccgccagctccatgatcaatggcgttgtgaagctgctgacaaagccctgggatgtcgtgccgatggttacccaaatggctatgacagacaccacgcctttcggccagcagcgggtgtttaaagaaaaggtcgataccagaacaccccgccctatgcccgggacccggaaagtgatggagatcacagccgagtggctctggagaaccctgggacgcaacaagaaacctcggctttgcacgagagaagagttcacaaagaaggttcgcaccaatgcggccatgggcgctgtgtttacagaagagaaccaatgggactctgccagagctgccgtcgaagatgaggagttctggaaactggtggaccgggaacgcgagctccataagctggggaaatgtggaagctgcgtctacaatatgatgggcaagagagagaagaaacttggggagtttggcaaagccaagggatcccgggcgatttggtacatgtggctgggcgctagatatctcgagttcgaagccctggggtttctgaacgaggatcactggttctctcgggaaaatagctactccggagtggagggcgaagggctccataagctgggatatatccttcgcgacatttctaaaatccccggcggggccatgtacgctgatgacaccgccggctgggacacgagaattaccgaggatgacctgcacaacgaggaaaagatcacacagcagatggatccggagcatcggcagctcgctaatgccatctttaaactgacctatcaaaacaaggttgtgaaagtccagcgccctacacccaagggaaccgtgatggacattatcagcagaaaggatcagcggggctccggacaggtgggaacatacggccttaataccttcacgaacatggaagcgcaactggttcgccagatggagggggaaggagtgctcagcaaagccgacctggagaatccccatctgctcgagaagaaaattacacagtggctggaaaccaagggcgtcgagagacttaaacggatggctatctctggggatgactgcgtggttaagcctattgatgaccgctttgccaacgctctgctcgccctgaacgatatgggcaaggtgagaaaagacatcccgcagtggcaaccctccaagggatggcacgattggcagcaggtccctttctgtagccatcacttccatgaacttatcatgaaagacggccggaagctggtggtcccctgccgccctcaggacgagctcattgggagagcgcggatctctcaaggagccggctggtccctgaaagaaaccgcttgtctggggaaggcctatgctcagatgtggagcctcatgtactttcaccgcagagatctgcggcttgcctctaatgctatttgctccgccgtgcccgttcactggatccctacaagcagaaccacatggtccattcatgcgcaccatcagtggatgacgaccgaggacatgctgacagtgtggaaccgcgtctggatcgaggataatccctggatggaagacaagaccccgattacaacctgggaggatgtgccttacctcggaaaacgggaagaccaatggtgtggcagcctgatcgggcttacgtctagagccacctgggctcagaacatcctgacagccattcagcaggttcgcagcctcatcggcgatgaggagttcctggactatatgccctccatgaagcggtttagaaaagaagaggaatctgagggagccatttggtga

SEQ ID NO: 20836 - RNA, 9873 nt, synthetic construct
  misc_feature 1..9873: note = derived and/or modified CDS sequence (opt5) from DENV-3__EU482459__SS-prME
  source 1..9873: mol_type = other RNA
accagcctgtgcctcatgatgatgctgcccgccacacttgctttccacctgacgtccagagacggcgagcctcggatgatcgtggggaagaacgaacgcggaaaatctctcctgtttaagaccgccagcggcattaatatgtgtacacttatcgcgatggatctgggggagatgtgcgacgataccgtcacatacaaatgtccgctcattgctgaagttgagcccgaagacatcgattgctggtgtaacctgacctccacatgggtgacctatggaacgtgcaatcaggccggcgagcatagacgggacaagcgctctgtggccctggctcctcacgtcgggatgggactcgataccagaacacaaacctggatgagcgccgagggcgcttggcggcaggtggaaaaagttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagaataaacccacgctcgacatcgagctgcagaagaccgaagctacacaacttgccaccctgcgcaaactctgtattgagggaaagatcacaaacattaccacggattccagatgccctacacagggcgaagcgatcctgccggaggaacaggaccagaattatgtgtgtaaacacacctacgtggatcggggctgggggaacggatgcggccttttcgggaagggaagcctggtcacctgcgccaagtttcaatgtctcgagcccattgagggcaaagtggttcagtatgaaaatctgaagtacacagtgatcatcaccgtccacacaggggaccagcatcaggtgggaaacgacacgcaaggcgttaccgtggagattacacctcaggcttctaccgtcgaagccgtgctgcccgagtatggcacactcgggctggaatgctcccctcgcaccggacttgatttcaatgagatgatcctgctcacgatgaaaaacaaggcttggatggtccacagacagtggtttttcgacctgccccttccgtggaccagcggcgccacaaccgagacacctacctggaatcggaaagaactgctcgtgacgtttaagaacgcccatgctaaaaagcaagaggttgtggtcctggggtctcaggaaggagcgatgcacacagccctgaccggcgctacagagattcagaattccgggggcaccagcatcttcgccggacacctcaagtgtcgcctgaaaatggataagcttgaactgaaaggcatgtcttacgccatgtgcctcaacacctttgtgctgaagaaagaggtttccgagacacagcatgggacgattctgatcaaggtggaatacaagggagaggacgctccctgtaaaatccctttcagcaccgaagatggccaagggaaggcccacaacggaagacttattacagcgaatcccgtcgtgaccaaaaaggaggagcccgtgaacatcgaagctgagcctccgttcggcgaatccaatattgttatcgggattggcgacaaagccctcaagatcaactggtataagaaaggatctagcatcggcaagatgtttgaggccacagctcggggggccagacgcatggctattctgggagataccgcctgggacttcggctccgtcgggggagtgctgaatagcctcggcaaaatggtgcatcagatctttgggtctgcgtacacggccctgttctccggcgtcagctggattatgaagatcggaattggcgtgcttctgacatggatcgggctcaactctaaaaataccagcatgtccttttcttgcattgttatcggaatcattaccctgtatctgggcgctgtggtccaggccgatatggggtgtgctatcaactggaagggaaaggaacttaaatgcggcagcgggattttcgtgacaaatgaggttcacacctggacagagcagtacaagtttcaagccgactcccccaaacggctcgcgacggccatcgctggcgcctgggaaaacggagtgtgtggcattagaagcaccacacgcatggagaatctgctgtggaagcagatcgctaacgaactcaattatatcctgtgggagaacaatattaaacttaccgtcgtggttggggatatcattggagtgctggaacagggcaagcggacactcacccctcagcccatggagctgaaatactcttggaagacgtgggggaaggccaaaatcgtcaccgccgagacacaaaactccagcttcattatcgacggacctaacacccccgaatgcccgtctgcttccagagcgtggaatgtgtgggaggtggaagactatggctttggcgtcttcacaaccaacatctggctgaagcttcgcgaggtttacacacagagctgtgatcatcggctcatgtccgccgctattaaagacgaaagagccgtgcacgccgatatggggtactggatcgagtctcagaagaatggaagctggaaactggagaaggcttcctttattgaagtgaagacctgcacgtggcctaaatctcacacactgtggagcaacggcgtcctcgagtccgacatgatcattcccaagagcctggccgggcctatctctcagcataatcaccgccccggatatcatacccaaaccgcgggcccttggcaccttgggaaactggaactcgatttcaactactgcgagggaacaaccgtggttatcacggagaattgtggcacacggggcccctccctgagaaccacaaccgtgagcgggaagctgattcacgaatggtgctgtcgctcttgcacacttccgcctctccggtatatgggagaggacggctgttggtacgggatggaaatcagacccattaacgagaaagaagagaatatggtcaagtccctggtgagcgctggatctggcaaggttgataactttaccatgggggtgctgtgcctcgccatcctgttcgaggaagtcatgcggggaaaattcggcaagaaacatatgattgccggcgtgctttttacgttcgttctgctcctgagcgggcagatcacctggcgcgacatggctcacacactgattatgatcggatccaatgccagcgatagaatgggcatgggggtgacctatcttgcgctgatcgctacatttaagattcagcccttcctcgccctgggatttttcctccggaaactgacctctagagagaaccttctgctcggcgtcgggctggccatggctacgacactgcaacttcctgaagacatcgagcagatggccaatggaattgctctgggcctcatgaccctgaagctcatcacacagtttgaaacctaccagctgtggaccgcccttgtgtccctgacatgtagcaacacgattttcaccctcacagtggcgtggcgcaccgccacactgatcctggctggcgtctcccttctgccgctctgccaatctagctccatgcggaagaccgattggctgcccatgacggttgccgctatgggggtgcctcccctccctctgtttatcttctctcttaaagacacacccaagagacgcagctggcctctgaatgagggagtgatggccgtcggcctggtgtccattctcgcctctagcctgcttagaaacgatgttcccatggctgggccgctggtggcgggaggcctcctgatcgcctgttatgtcattaccgggacctccgctgacctcacagtggagaaagccgccgacgttacctgggaagaggaagctgagcagacaggagtgagccataacctgatgatcacggtcgatgacgatggcaccatgcggattaaggacgatgaaacagagaatatccttaccgtgctgctgaaaacagccctcctgatcgtctctggcatttttccttactccatccccgcgacccttctggtgtggcacacgtggcagaagcagacccaacgcagcggggttctctgggacgtgccttctcccccggagacacagaaagctgaactggaggaaggagtctacagaattaagcagcagggcatcttcgggaagacccaagtgggagttggcgtgcagaaagagggggtctttcatacaatgtggcacgtgacccggggagccgtgctcacacacaacggcaagcgcctggagcctaattgggcctccgttaaaaaggatcttattagctatggcgggggatggagactgtctgctcagtggcaaaaaggcgaagaggtccaggtgatcgccgtggaacccgggaagaaccctaagaatttccagacgatgcccggaattttccagaccacaaccggcgagatcggggcgatcgctctggactttaaacccggaacctccggcagccctattatcaaccgggaaggcaaggtcgtggggctctacggaaatggcgttgtgacaaaaaacgggggatatgtctccggcattgcccaaacgaatgccgagccggatgggcccacccctgagctggaagaggaaatgttcaagaaacgcaaccttacaatcatggacctgcatcccggcagcggaaagaccagaaagtacctccctgctattgtgcgggaggccatcaaacgcagactgcggacactcatcctggctcccaccagagttgtggccgcggaaatggaggaggcccttaagggcctgcctattcgctatcagacgacagctaccaaatctgaacacaccgggcgggagatcgtcgatctgatgtgccatgccacatttaccatgagactcctgagcccggtgcgcgttcccaattacaaccttattatcatggacgaagctcacttcacagatcctgcctccattgccgctcggggatatatctctaccagagtgggcatgggggaggcggccgctatctttatgacggccacaccccctggaaccgccgaagctttcccccagagcaatgccccgattcaggacgaggagcgcgacatccctgaacggtcctggaactctggcaatgagtggattacagattttgtcgggaagaccgtgtggttcgtgcccagcatcaaagcgggcaacgacattgctaactgtctgagaaagaatggaaagaaagtcatccaactctcccgcaagacgtttgataccgaataccagaaaacacggctgaacgactgggatttcgttgtgaccacagacatttctgagatgggcgccaattttaaggccgatagagtgatcgacccccggcgctgcctgaaacctgtcatcctcaccgatgggcccgagagagtgattcttgctggacctatgccggttacagccgcgagcgccgctcagcggcgcggcagagtggggcggaacccccagaaggaaaatgaccaatacatcttcaccggacagcctctgaacaatgatgaggaccatgcccactggacggaagctaagatgctgctcgacaacattaatacacccgagggcatcattcctgccctgttcgaacccgagagagagaaatccgctgccatcgatggggaatatcgccttaagggcgagagccggaaaacctttgtcgaactgatgagacgcggagacctcccggtgtggctggcgcacaaggttgcctctgagggcatcaaatacaccgatcggaagtggtgcttcgacggggaaagaaacaatcagattctggaggagaacatggatgtggaaatctggacaaaagagggagaacgcaagaagctccggcctagatggcttgacgctcgcacctattccgatcccctggccctgaaagagtttaaggacttcgctgccggcagaaaaagcattgccctcgatctggtcacagaaatcgggcgggtgccttctcatcttgcttaccgcacgagaaatgcgctggacaacctcgtcatgctgcacacctccgagcatggaggccgggcctatcgccacgctgtggaggaactgcccgagacaatggaaaccctccttctgctgggcctcatgattctgcttacagggggagccatgctgtttctcatcagcggcaaggggatcggaaaaacctccattggcctgatctgtgttattgtgtctagcgggatgctgtggatggccgatgtgcctctccagtggatcgcttccgccattgtccttgagttctttatgatggttctgctgatccccgagccggaaaagcaaagaacgcctcaggacaatcagctcgcgtacgtggtgattggaatcctgacccttgccgctatcgtcgccgctaacgagatgggcctgctcgaaacaaccaagcgggatctgggcatgagcaaagagcccggggtggtttctcccacatcctatctggacgtggacctccaccctgccagcgcgtggaccctttacgccgtcgctacgacagtgattaccccgatgctgagacatacaatcgaaaattctaccgccaacgtcagcctggctgccattgctaaccaagccgtggttctcatgggactggataagggctggcccatctccaaaatggaccttggggtgcctctgctcgcgctgggatgctactctcaggtcaatcccctgaccctcacagccgctgtgcttctgctggttacgcactatgccattatcggccctgggctccaggctaaggccacccgcgaggcccagaaacggacagcggctggaatcatgaagaaccccaccgtggatggcattatgacaatcgacctggatcctgtcatttacgacagcaagttcgagaaacaacttggccaggtgatgctgctcgtgctgtgtgccgttcagctgctccttatgagaacctcctgggctctgtgcgaagccctgacgctcgccacagggccgatcaccaccctgtgggagggatctcccggcaagttttggaatacaaccattgctgtcagcatggccaacatcttccgcgggtcctatcttgcgggagccggcctggcttttagcatcatgaaatctgtggggacaggacggagaggcacgggctcccagggggaaaccctcggagagaagtggaaaaagaagctgaatcaactgagccggaaagaattcgatctctacaagaaatccggcattacagaggtggaccgcaccgaggccaaggaagggcttaaaagaggagagacaacccatcacgctgtctctcggggcagcgccaagctgcagtggtttgttgaacgcaacatggtgatccctgaggggagagtgattgatctgggatgtggccggggcgggtggtcctattactgcgcgggactcaaaaaggtcacggaagtgcgcggctataccaaggggggacccggccatgaggagcctgttcccatgtctacatacgggtggaatctggtgaaacttatgagcggaaaggacgtcttctacctgccgcctgaaaaatgtgataccctcctgtgcgacatcggcgagtccagcccctctcccacagtggaagagtccagaaccattcgggttctgaagatggtggagccttggctcaaaaacaatcagttctgtatcaaggtccttaacccctatatgcctacagtgattgaacacctggagcgcctgcagagaaagtacggcgggatgctcgtgcggaatccgctgagcagaaactctacccacgaaatgtattggatctccaatggaacgggcaacatcgtcagctctgttaatatggtgagccgccttctgctcaaccggtttacaatgacccatagacgccccaccattgagaaagatgtggacctgggggccggaacacggcacgtcaacgctgaacctgagacgcccaatatggacgtgatcggcgagagaattaagcgcatcaaagaagagcattcctctacctggcactacgatgacgaaaacccttataagacatgggcctaccacgggagctatgaggttaaagctaccggatccgccagctccatgattaatggcgtggtcaagctgctcacaaagccctgggatgtggttccgatggtgacccaaatggctatgacagacaccacgcctttcggccagcagcgggtctttaaagaaaaggtggataccagaacaccccgccctatgcccgggacccggaaagttatggagatcacagccgagtggctgtggagaacccttggacgcaacaagaaacctcggctgtgcacgagagaagagttcacaaagaaggtgcgcaccaatgcggccatgggcgctgtctttacagaagagaaccaatgggactctgccagagctgccgtggaagatgaggagttctggaaactcgtcgaccgggaacgcgagctgcataagcttgggaaatgtggaagctgcgtgtacaatatgatgggcaagagagaaaaaaagctgggggagtttggcaaagccaagggatcccgggcgatctggtacatgtggctcggcgctagatatctggagttcgaagccctggggtttctcaacgaggatcactggttctctcgggaaaatagctactccggagttgagggcgaagggctgcataagcttggatatattctgcgcgacatctctaaaattcccggcggggccatgtacgctgatgacaccgccggctgggacacgagaatcaccgaggatgacctccacaacgaggaaaagattacacagcagatggatccggagcatcggcagctggctaatgccatctttaaacttacctatcaaaacaaggtggtcaaagtgcagcgccctacacccaagggaaccgtgatggacatcattagcagaaaggatcagcggggctccgggcaggttggaacatacggcctgaataccttcacgaacatggaagcgcaactcgtgcgccagatggagggggaaggagtcctgagcaaagccgacctggagaatccccacctcctggagaagaaaatcacacagtggcttgaaaccaagggcgtggagagactgaaacggatggctatttctggggatgactgcgttgtgaagcctatcgatgaccgctttgccaacgctctcctggcccttaacgatatgggcaaggtcagaaaagacattccgcagtggcaaccctccaagggatggcacgattggcagcaggtgcctttctgtagccatcacttccatgaactgatcatgaaagacggccggaagctcgtcgtgccctgccgccctcaggacgagctgatcgggagagcgcggatttctcaaggagccggctggtccctgaaagaaaccgcttgtctcgggaaggcctatgctcagatgtggagcctgatgtactttcaccgcagagatcttcggctggcctctaatgctatctgctccgccgttcccgtgcactggattcctacaagcagaaccacatggtccatccatgcgcaccatcagtggatgacgaccgaggacatgctcacagtctggaaccgcgtgtggattgaggataatccctggatggaagacaagaccccggttacaacctgggaggatgtgccttacctgggaaaacgggaagaccaatggtgtggcagccttatcgggctgacgtctagagccacctgggctcagaacattctcacagccatccagcaggtccgcagcctgatcggcgatgaggagttcctggactatatgccctccatgaagcggtttagaaaagaagaggaatctgagggagccatttggtga

SEQ ID NO: 20837 - RNA, 9873 nt, synthetic construct
  misc_feature 1..9873: note = derived and/or modified CDS sequence (opt5) from DENV-3__EU482460__SS-prME
  source 1..9873: mol_type = other RNA
accagcctgtgcctcatgatgatgctgcccgccacattcgcttttcaccttacgtccagagacggcgagcctcggatgatcgtggggaagaacgaacgcggaaaatctctgctcttcaagaccgccagcggcattaatatgtgtacactgatcgcgatggatcttggggagatgtgcgacgataccgtcacatacaaatgtccgctgattgctgaagttgagcccgaagacatcgattgctggtgtaacctcacctccacatgggtgacctatggaacgtgcaatcaggccggcgagcatagacgggacaagcgctctgtggccctggctcctcacgtcgggatgggactggataccagaacacaaacctggatgagcgccgagggcgcttggcggcaggtggaaaaagttgagacatgggccctccgccatcccggctttaccattctggcgcttttcctggcccactacatcgggacgtccctcacacagaaggtggtcatctttattctgcttatgctggtgaccccttctatgacaatgagatgtgttggagtgggcaaccgggacttcgtcgaagggctcagcggagctacctgggtggatgtggtcctggagcatggcgggtgcgttaccacaatggccaagaataaacccacgctggacatcgagctccagaagaccgaagctacacaactggccacccttcgcaaactgtgtattgagggaaagatcacaaacattaccacggattccagatgccctacacagggcgaagcgatcctcccggaggaacaggaccagaattatgtgtgtaaacacacctacgtggatcggggctgggggaacggatgcggcctgtttgggaagggaagccttgtcacctgcgccaagttccaatgtctggagcccattgagggcaaagtggttcagtatgaaaatctcaagtacacagtgatcatcaccgtccacacaggggaccagcatcaggtgggaaacgacacgcaaggcgttaccgtggagattacacctcaggcttctaccgtcgaagccgtgctgcccgagtatggcacactggggctcgaatgctcccctcgcaccggactggattttaatgagatgatccttctgacgatgaaaaacaaggcttggatggtccacagacagtggttctttgacctccccctgccgtggaccagcggcacaaccacagagacccctacgtggaatcggaaagaacttctggtgacattcaagaacgcccatgccaaaaagcaagaggttgtggtcctcgggtctcaggaaggagctatgcacaccgcgctgacaggcgccaccgagattcagaattccgggggcaccagcatctttgctggacacctgaagtgtcgcctcaaaatggataagctggaacttaaaggcatgtcttacgccatgtgcctgaacacattcgtgctcaagaaagaggtttccgagacgcagcatgggaccattctgatcaaggtggaatacaagggagaggacgccccctgtaaaatccctttcagcacagaagatggccaagggaaggctcacaacggaagactgattaccgccaatcccgtcgtgacaaaaaaggaggagcccgtgaacatcgaagcggagcctccgtttggcgaatccaatattgttatcgggattggcgacaaagctcttaagatcaactggtataagaaaggatctagcatcggcaagatgttcgaggccaccgcccggggggctagacgcatggccattctcggagatacggcttgggactttggctccgtcgggggagtgctgaatagcctgggcaaaatggtgcatcagatcttcgggtctgcctacacagcgctcttttccggcgtcagctggattatgaagatcggaattggcgtgctgcttacctggatcgggctgaactctaaaaataccagcatgtccttctcttgcattgttatcggaatcattacactctatctgggcgccgtggtccaggctgatatggggtgtgccatcaactggaagggaaaggaactgaaatgcggcagcgggatttttgtgaccaatgaggttcacacatggacggagcagtaccggttccaagctgactcccccaagagacttgccaccgcgatcgccggcgcttgggaaaacggagtgtgtggcattcgcagcacaacccggatggagaatctcctgtggaaacagatcgccaacgaactgaattatatcctctgggagaacaatattaagctgacagtcgtggttggggatatcattggagtgcttgaacagggcaaaagagctctggcccctcagcccatggagctcaagtactcttggaaaacctgggggaaggccaagatcgtcacggctgagacccaaaactccagctttattatcgacggacctaacacacccgaatgcccgtctgcgtcccgcgcctggaatgtgtgggaggtggaagactatggcttcggcgtctttaccacaaacatctggctgaaactgcgggaggtttacacccagagctgtgatcatagacttatgtccgctgccattaaggacgaacgcgccgtgcacgctgatatggggtactggatcgagtctcagaaaaatggaagctggaagctcgagaaagcctccttcattgaagtgaagacatgcacctggcctaagtctcacacgctgtggagcaacggcgtcctggagtccgacatgatcattcccaaaagcctcgcggggcctatctctcagcataatcaccggcccggatatcatacacaaaccgctggcccttggcacctggggaagcttgaactggattttaactactgcgagggaaccacagtggttatcaccgagaattgtggcacgagaggcccctccctccgcacaaccacagtgagcgggaaactgattcacgaatggtgctgtcggtcttgcaccctgccgcctcttagatatatgggagaggacggctgttggtacgggatggaaatccggcccattaacgagaaggaagagaatatggtcaaatccctcgtgagcgccggatctggcaaggttgataacttcacaatgggggtgctgtgcctggccatcctcttcgaggaagtcatgcgcggaaagtttggcaaaaagcatatgattgctggcgtgctgttcacctttgttcttctgctcagcgggcagatcacgtggagagacatggcccacaccctgattatgatcggatccaatgcgagcgatcggatgggcatgggggtgacatatctggctcttatcgccaccttcaaaattcagccctttctggccctcggattctttctgagaaagctcacatctcgcgagaacctgcttctgggcgtcgggctcgctatggccaccacgctgcaactgcctgaagacatcgagcagatggctaatggaattgcccttggcctgatgacactcaaactgatcacccagttcgaaacataccagctctggaccgcgctggtgtcccttacctgtagcaacacaatttttacgctgaccgtggcctggcggacagctaccctcatcctggccggcgtctccctgcttccgctgtgccaatctagctccatgagaaagacagattggctccccatgaccgttgctgccatgggggtgcctcccctgcctctcttcatcttttctctgaaggacacgcccaaacgcagaagctggcctcttaatgagggagtgatggccgtcggcctggtgtccattctggcttctagcctcctgcggaacgatgttcccatggcggggccgcttgtggccggaggcctgctcatcgcttgttatgtcattacagggacctccgccgacctgaccgtggagaaggccgctgacgttacatgggaagaggaagccgagcagaccggagtgagccataacctcatgatcacagtcgatgacgatggcacgatgcgcattaaagacgatgaaaccgagaatatcctgacagtgcttctgaagaccgcgctgctcatcgtctctggcattttcccttactccatccccgctacactgcttgtgtggcacacctggcagaaacagacgcaaagaagcggggttctgtgggacgtgccttctcccccggagacccagaaggccgaactcgaggaaggagtctaccggattaaacagcagggcatctttgggaagacacaagtgggagttggcgtgcagaaggagggggtcttccataccatgtggcacgtgacacgcggagccgtgctgacccacaacggcaaaagactcgagcctaattgggcttccgttaagaaagatctgattagctatggcgggggatggcggctttctgcccagtggcaaaagggcgaagaggtccaggtgatcgcggtggaacccgggaaaaaccctaagaatttccagacaatgcccggaatttttcagacgaccatgggcgagatcggggctatcgccctggacttcaagcccggaacatccggcagccctattatcaaccgcgaaggcaaagtcgtggggctgtacggaaatggcgttgtgaccaagaacgggggatatgtctccggcattgcccaaaccaatgctgagccggatgggcccacacctgagctcgaagaggaaatgtttaaaaagagaaacctgacgatcatggaccttcatcccggcagcggaaaaacccggaagtacctgcctgccattgtgcgcgaggctatcaagagacggctcagaacactgatcctcgcccccacccgcgttgtggcggccgaaatggaggaggctctgaaaggccttcctattcggtatcagacaaccgccacgaagtctgaacacacagggagagagatcgtcgatctgatgtgccatgctaccttcaccatgcgcctgctcagcccggtgcgggttcccaattacaacctgattatcatggacgaagcccactttacagatcctgcctccattgctgcgagaggatatatctctacccgcgtgggcatgggggaggccgctgccatcttcatgacagccaccccccctggaacggctgaagcctttccccagagcaatgcgccgattcaggacgaggagcgggacatccctgaaagatcctggaactctggcaatgagtggattacagatttcgtcgggaaaaccgtgtggtttgtgcccagcatcaaggctggcaacgacattgccaactgtcttcgcaaaaatggaaagaaggtcatccaactgtcccggaaaacattcgataccgaataccagaagacgagactcaacgactgggattttgttgtgaccacagacatttctgagatgggcgccaatttcaaagctgatcgggtgatcgacccccgcagatgcctgaagcctgtcatcctgaccgatgggcccgagcgggtgattctcgccggacctatgccggttacagcggccagcgctgcccagcgcagaggccgggtggggagaaacccccagaaagaaaatgaccaatacatcttcaccggacagcctcttaacaatgatgaggaccatgctcactggacagaagccaagatgctgctggacaacattaatacccccgagggcatcattcctgctctctttgaacccgagcgcgagaagtccgccgcgatcgatggggaatatcggctgaaaggcgagagcagaaagacgttcgtcgaacttatgcgccggggagacctgccggtgtggctcgcccacaaagttgcttctgagggcatcaagtacacagatagaaaatggtgctttgacggggaacgcaacaatcagattctggaggagaacatggatgtggaaatctggaccaaggagggagaacggaaaaagctgagacctcgctggctcgacgccagaacctattccgatccccttgctctgaaggagttcaaagactttgccgccggccggaagagcattgctctggatctcgtcacagaaatcgggcgcgtgccttctcatctggcgtacagaacccggaatgcccttgacaacctggtcatgctccacacatccgagcatggaggccgcgcttatagacacgccgtggaggaactgcccgagacgatggaaaccctgctccttctgggcctgatgattctcctgacagggggagccatgcttttcctgatcagcggcaaagggatcggaaagacctccattggcctcatctgtgttattgtgtctagcgggatgctgtggatggctgatgtgcctctgcagtggatcgcctccgcgattgtcctcgagtttttcatgatggttcttctgatccccgagccggaaaaacaacggacacctcaggacaatcagctggcctacgtggtgattggaatcctcaccctggctgccatcgtcgctgccaacgagatgggccttctggaaacgaccaagagagatctcggcatgagcaaggagcccggggtggtttctcccacatcctatctggacgtggacctgcaccctgcgagcgcctggaccctctacgctgtcgccacaaccgtgattacgccgatgcttcgccatacaatcgaaaattctaccgctaacgtcagcctggccgctattgccaaccaagcggtggttctgatgggactcgataaaggctggcccatctccaagatggacctgggggtgcctcttctggccctcggatgctactctcaggtcaatcccctgacactgaccgctgccgtgctccttctggttacccactatgctattatcggccctgggctgcaggccaaagccacacgggaggcgcagaagagaacggctgccggaatcatgaaaaaccccaccgtggatggcattatgacaatcgacctcgatcctgtcatttacgacccgaagtttgagaagcaactgggccaggtgatgcttctggtgctctgtgctgttcagctgctgctcatgcgcaccagctgggccctttgcgaagccctgacactggctaccgggcccatcacgacactctgggagggatcccctggcaaattctggaataccaccattgccgtctctatggcgaacatctttcgggggagctatctggccggagctggccttgccttctccatcatgaagagcgtggggacaggaagacggggcaccggctctcagggggaaacactgggagagaaatggaagaaaaagctcaatcaactgtcccgcaaggaatttgatctgtacaaaaagagcggcattacggaggtggacagaaccgaggctaaagaagggctcaagcggggagagacaacccatcacgccgtctcccgcggctctgcgaaacttcagtggttcgttgaaagaaacatggtgatccccgaggggcgggtgattgatctgggatgtggccgcggcgggtggagctattactgcgccggactgaagaaagtcacagaagtgagaggctataccaaggggggacctggccatgaggagcccgttccgatgtccacgtacgggtggaatatcgtgaagctcatgtctggaaaagacgtcttctacctgcctcccgaaaagtgtgatacccttctgtgcgacattggcgagagctcccccagccctacagtggaagagtctcggaccatccgcgttctcaaaatggtggagccctggctgaagaacaatcagttttgtattaaagtcctgaacccttatatgccgacagtgatcgaacacctcgagagacttcagcggaagtacggcgggatgctggtgagaaatcccctgtcccgcaacagcacccacgaaatgtattggatctctaatggaacaggcaacattgtctccagcgttaatatggtgtctcggctcctgcttaacagattcaccatgacgcatcgccggcctacaatcgagaaggatgtggacctgggggctggaaccagacacgtcaacgccgaacccgagacccctaatatggacgtgattggcgagcgcatcaaacggattaaggaagagcatagctccacatggcactacgatgacgaaaacccctataaaacgtgggcttaccacgggtcttatgaggttaaggccaccggaagcgcttccagcatgatcaatggcgtggtcaaactcctgacaaagccgtgggatgtggttcctatggtgacccaaatggccatgacagacaccacaccctttggccagcagagagtcttcaaggaaaaagtggatacccgcacgcctcggcccatgcctgggaccagaaaggttatggagatcacagcggagtggctgtggcgcaccctcggacggaacaaaaagcccagactgtgcacacgcgaagagtttaccaaaaaggtgagaacgaatgccgctatgggcgccgtcttcacagaagagaaccaatgggactccgctcgggccgccgtggaagatgaggagttttggaagcttgtcgaccgcgaaagagagctgcataaactcgggaagtgtggatcttgcgtgtacaatatgatgggcaaacgggaaaagaaactgggggagttcggcaaggcgaaaggaagcagagctatttggtacatgtggcttggcgcccggtatctggagtttgaagccctcgggttcctgaacgaggatcactggttttcccgcgaaaattcttacagcggagttgagggcgaagggctgcataagctcggatatatcctgagagacatttccaagatcccgggcggggctatgtacgccgatgacaccgctggctgggacacacggattaccgaggatgaccttcacaacgaggaaaaaatcacgcagcagatggatcctgagcatcgccagctggccaatgcgatcttcaagctcacctatcaaaacaaagtggtcaaggtgcagagacccacacccaaaggaaccgtgatggacattatctctcggaaggatcagcgcggcagcgggcaggttggaacatacggcctgaatacctttacaaacatggaagcccaacttgtgagacagatggagggggaaggagtcctgtccaaggctgacctcgagaatcctcacctgctggagaaaaagattacccagtggctcgaaacgaaaggcgtggagcggctgaagcgcatggccatcagcggggatgactgcgttgtgaaaccgattgatgacagattcgctaacgcccttctggcgctcaacgatatgggcaaggtccggaaggacatcccccagtggcaaccttctaaaggatggcacgattggcagcaggtgcccttctgttcccatcactttcatgaactgatcatgaaggacggccgcaaacttgtcgtgccttgcagaccccaggacgagctgattgggcgggcccgcatcagccaaggagctggctggtctctcaaggaaacagcctgtctggggaaagcttatgcccagatgtggtccctgatgtacttccacagacgggatctcagactggctagcaatgccatttgctctgcggttcctgtgcactggatccccacctcccgcaccacatggagcattcatgcccaccatcagtggatgaccacagaggacatgcttacggtctggaaccgggtgtggatcgaggataatccgtggatggaagacaagacccctgttacaacctgggaggatgtgccctacctgggaaagagagaagaccaatggtgtggctccctcattgggctgacaagccgcgctacctgggcccagaacatccttacggccatccagcaggtccggtctctgattggcgatgaggagtttctcgactatatgcctagcatgaaaagattccgcaaggaagaggaatccgagggagctatctggtga

SEQ ID NO: 20838 - RNA, 9873 nt, synthetic construct
  misc_feature 1..9873: note = derived and/or modified CDS sequence (opt5) from DENV-3__EU482461__SS-prME
  source 1..9873: mol_type = other RNA
accagcctgtgcctcatgatgatgctgcccgccacacttgctttccacctgacgtcccgggacggagaacctcggatgatcgtggggaagaacgaacgcggaaagtctctcctgtttaagaccgccagcggcattaatatgtgtacacttatcgcgatggatctgggggaaatgtgcgacgataccgtcacatacaagtgtccgctcattgctgaagttgagcccgaagacatcgattgctggtgtaacctgacctccacatgggtgacctatggaacgtgcaatcaggccggcgagcatcggcgggacaagcgctctgtggccctggctcctcacgtcgggatgggactcgataccagaacacagacctggatgagcgccgagggcgcttggagacaggtggaaaaggttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagaataaacccacgctcgacatcgagctgcagaagaccgaagctacacagcttgccaccctgcgcaaactctgtattgagggaaagatcacaaacattaccacggattccagatgccctacacagggcgaagcgatcctgccggaggaacaggaccagaattatgtgtgtaaacacacctacgtggatcggggctgggggaacggatgcggccttttcgggaagggaagcctggtcacatgcgccaagtttcaatgtctcgagcccattgagggcaaagtggttcagtatgaaaatctgaagtacacagtgatcatcaccgtccacacaggggaccagcatcaggtgggaaacgacacgcaaggcgttaccgtggagattacacctcaggcttctaccgtcgaagccgtgctgcccgagtatggcacactcgggctggaatgctcccctcgcaccggacttgatttcaatgagatgatcctgctcacgatgaaaaacaaggcttggatggtccacagacagtggtttttcgacctgccccttccgtggaccagcggcgccacaaccgagacacctacctggaatcggaaagaactgctcgtgacgtttaagaacgcccatgctaaaaagcaagaggttgtggtcctggggtctcaggaaggagcgatgcacacagccctgaccggcgctacagagattcaaaattccgggggcaccagcatcttcgccggacacctcaagtgtcgcctgaaaatggataaacttgaactgaaaggcatgtcttacgccatgtgcctcaacacctttgtgctgaagaaagaggtttccgagacacagcatgggacgattctgatcaaggtggaatacaagggagaggacgctccctgtaaaatccctttcagcaccgaagatggccaagggaaggcccacaacggaagacttattacagcgaatcccgtcgtgaccaaaaaggaggagcccgtgaacatcgaagctgagcctccgttcggcgaatccaatattgttatcgggattggcgacaaagccctcaagatcaactggtataagaaaggatctagcatcggcaagatgtttgaggccacagctagaggggccagacgcatggctattctgggagataccgcctgggacttcggctccgtcgggggagtgctgaatagcctcggcaaaatggtgcatcagatctttgggtctgcgtacacggccctgttctccggcgtcagctggattatgaagatcggaattggcgtgcttctgacatggatcgggctcaactctaaaaataccagcatgtccttttcttgcattgttatcggaatcattaccctgtatctgggcgctgtggtccaggccgatatggggtgtgctatcaactggaagggaaaggaacttaaatgcggcagcgggattttcgtgacaaatgaggttcacacctggacagagcagtacaagtttcaagccgactcccccaaacggctcgcgacggccatcgctggcgcctgggaaaacggagtgtgtggcattagaagcaccacacgcatggagaatctgctgtggaagcagatcgctaacgaactcaattatatcctgtgggagaacaatattaaacttaccgtcgtggttggggatatcattggagtgctggaacagggcaagcggacactcacccctcagcccatggagctgaaatactcttggaagacgtgggggaaggccaaaatcgtcaccgccgagacacaaaactccagcttcattatcgacggacctaacacccccgaatgcccgtctgcttccagagcgtggaatgtgtgggaggtggaagactatggctttggcgtcttcacaaccaacatctggctgaaacttcgcgaggtttacacacagagctgtgatcatcggctcatgtccgccgctattaaagacgaaagagccgtgcacgccgatatggggtactggatcgagtctcagaagaatggaagctggaaactggagaaggcttcctttattgaagtgaagacctgcacgtggcctaaatctcacacactgtggagcaacggcgtcctcgagtccgacatgatcattcccaagagcctggccgggcctatctctcagcataatcaccgccccggatatcatacccaaaccgcgggcccttggcaccttgggaaactggaactcgatttcaactactgcgagggaacaaccgtggttatcacggagaattgtggcacacggggcccctccctgagaaccacaaccgtgagcgggaagctgattcacgaatggtgctgtcgctcttgcacacttccgcctctccggtatatgggagaggacggctgttggtacgggatggaaatcagacccattaacgagaaagaagagaatatggtcaagtccctggtgagcgctggatctggcaaggttgataactttaccatgggggtgctgtgcctcgccatcctgttcgaggaagtcatgcggggaaaattcggcaagaaacatatgattgccggcgtgctttttacgttcgttctgctcctgagcgggcagatcacctggcgcgacatggctcacacactgattatgatcggatccaatgccagcgatagaatgggcatgggggtgacctatcttgcgctgatcgctacatttaagattcagcccttcctcgccctgggatttttcctccggaaactgacctctagagagaaccttctgctcggcgtcgggctggccatggctacgacactgcaacttcctgaagacatcgagcagatggccaatggaattgctctgggcctcatgaccctgaagctcatcacacagtttgaaacctaccagctgtggaccgcccttgtgtccctgacatgtagcaacacgattttcaccctcacagtggcgtggcgcaccgccacactgatcctggctggcgtctcccttctgccgctctgccaatctagctccatgcggaagaccgattggctgcccatgacggttgccgctatgggggtgcctcccctccctctgtttatcttctctcttaaagacacacccaagagacgcagctggcctctgaatgagggagtgatggccgtcggcctggtgtccattctcgcctctagcctgcttagaaacgatgttcccatggctgggccgctggtggcgggaggcctcctgatcgcctgttatgtcattaccgggacctccgctgacctcacagtggagaaagccgccgacgttacctgggaagaggaagctgagcagacaggagtgagccataacctgatgatcacggtcgatgacgatggcaccatgcggattaaggacgatgaaacagagaatatccttaccgtgctgctgaaaacagccctcctgatcgtctctggcatttttccttactccatccccgcgacccttctggtgtggcacacgtggcagaagcagacccaacgcagcggggttctctgggacgtgccttctcccccggagacacagaaagctgaactggaggaaggagtctacagaattaagcagcagggcatcttcgggaagacccaagtgggagttggcgtgcagaaagagggggtctttcatacaatgtggcacgtgacccggggagccgtgctcacacacaacggcaagcgcctggagcctaattgggcctccgttaaaaaggatcttattagctatggcgggggatggagactgtctgctcagtggcaaaaaggcgaagaggtccaggtgatcgccgtggaacccgggaagaaccctaagaatttccagacgatgcccggaattttccagaccacaaccggcgagatcggggcgatcgctctggactttaaacccggaacctccggcagccctattatcaaccgggaaggcaaggtcgtggggctctacggaaatggcgttgtgaccaagaacgggggatatgtctccggcattgcccaaacgaatgccgagccggatgggcccacccctgagctggaagaggaaatgttcaagaaacgcaaccttacaatcatggacctgcatcccggcagcggaaagaccagaaagtacctccctgctattgtgcgggaggccatcaaacgcagactgcggacactcatcctggctcccaccagagttgtggccgcggaaatggaggaggcccttaagggcctgcctattcgctatcagacgacagctaccaaatctgaacacaccgggcgggagatcgtcgatctgatgtgccatgccacatttaccatgagactcctgagcccggtgcgcgttcccaattacaaccttgtgattatggacgaagctcacttcacagatcctgcctccatcgccgctcggggatatatttctaccagagtcggcatgggggaggcggccgctatctttatgacggccacaccccctggaaccgccgaggctttcccccagagcaatgccccgatccaggacgaggagcgcgacattcctgaacggtcctggaactctggcaatgagtggatcacagattttgtggggaagaccgtgtggttcgtccccagcattaaagcgggcaacgacatcgctaactgtctgagaaagaatggaaagaaagttattcaactctcccgcaagacgtttgataccgaataccagaaaacacggctgaacgactgggatttcgtggtgaccacagacatctctgagatgggcgccaattttaaggccgatagagtcattgacccccggcgctgcctgaaacctgtgatcctcaccgatgggcccgagagagttatccttgctggacctatgccggtgacagccgcgagcgccgctcagcggcgcggcagagtcgggcggaacccccagaaggaaaatgaccaatacattttcaccggacagcctctgaacaatgatgaggaccatgcccactggacggaagctaagatgctgctcgacaacatcaatacacccgagggcattatccctgccctgttcgaacccgagagagagaaatccgctgccattgatggggaatatcgccttaagggcgagagccggaaaacctttgtggaactgatgagacgcggagacctcccggtttggctggcgcacaaggtggcctctgagggcatcaaatacaccgatcggaagtggtgcttcgacggggaaagaaacaatcagatcctggaggagaacatggatgtcgaaatttggacaaaagagggagaacgcaagaagctccggcctagatggcttgacgctcgcacctattccgatcccctggccctgaaagagtttaaggacttcgctgccggcagaaaaagcatcgccctcgatctggtgacagaaattgggcgggtcccttctcatcttgcttaccgcacgagaaatgcgctggacaacctcgtgatgctgcacacctccgagcatggaggccgggcctatcgccacgctgttgaggaactgcccgagacaatggaaaccctccttctgctgggcctcatgatcctgcttacagggggagccatgctgtttctcattagcggcaaggggatcggaaaaacctccatcggcctgatttgtgtgatcgtgtctagcgggatgctgtggatggccgatgtccctctccagtggattgcttccgccatcgttcttgagttctttatgatggtgctgctgattcccgagccggaaaagcaaagaacgcctcaggacaatcagctcgcgtacgtggtcatcggcattctgacccttgccgctatcgtggccgctaacgagatgggcctgctcgaaacaaccaagcgggatctgggcatgagcaaagagcccggggttgtgtctcccacatcctatctggacgtcgacctccaccctgccagcgcgtggaccctttacgccgtggctacgacagtcatcaccccgatgctgagacatacaattgaaaattctaccgccaacgtgagcctggctgccatcgctaaccaagccgttgtgctcatgggactggataagggctggcccatttccaaaatggaccttggggtccctctgctcgcgctgggatgctactctcaggtgaatcccctgaccctcacagccgctgttcttctgctggtgacgcactatgccatcattggccctgggctccaggctaaggccacccgcgaggcccagaaacggacagcggctggaatcatgaagaaccccaccgtcgatggcatcatgacaattgacctggatcctgtgatctacgacagcaagttcgagaaacaacttggccaggtgatgctgctcgttctgtgtgccgtccagctgctccttatgagaacctcctgggctctgtgcgaagccctgacgctcgccacagggccgattaccaccctgtgggagggatctcccggcaagttttggaatacaaccatcgctgtgagcatggccaacattttccgcgggtcctatcttgcgggagccggcctggcttttagcatcatgaaatctgtggggacaggacggagaggcacgggctcccagggggaaaccctcggagagaagtggaaaaagaagctgaatcaactgagccggaaagagttcgatctctacaagaaatccggcatcacagaggtcgaccgcaccgaggccaaggaagggcttaaaagaggagagacaacccatcacgctgtttctcggggcagcgccaagctgcagtggtttgtggaacgcaacatggtgattcctgaggggagagtcatcgatctgggatgtggccggggcgggtggtcctattactgcgcgggactcaaaaaggtgacggaagttcgcggctataccaaaggcgggcccgggcatgaggagcctgtgcccatgtctacatacgggtggaatctggtcaaacttatgagcggaaaggacgtgttctacctgccgcctgaaaaatgtgataccctcctgtgcgacattggcgagtccagcccctctcccacagttgaagagtccagaaccatccgggtgctgaagatggtcgagccttggctcaaaaacaatcagttctgtattaaggtgcttaacccctatatgcctacagtgatcgaacacctggagcgcctgcagagaaagtacggcgggatgctcgtccggaatccgctgagcagaaactctacccacgaaatgtattggatttccaatggaacgggcaacatcgttagctctgtgaatatggtgagccgccttctgctcaaccggtttacaatgacccatagacgccccaccatcgagaaagatgtcgacctgggggccggaacacggcacgtgaacgctgaacctgagacgcccaatatggacgttattggcgagagaatcaagcgcattaaagaagaacattcctctacctggcactacgatgacgaaaacccttataagacatgggcctaccacgggagctatgaggtgaaagctaccggatccgccagctccatgatcaatggcgtcgtgaagctgctcacaaagccctgggatgttgtgccgatggtcacccaaatggctatgacagacaccacgcctttcggccagcagcgggtgtttaaagaaaaggttgataccagaacaccccgccctatgcccgggacccggaaagtgatggagattacagccgagtggctgtggagaacccttggacgcaacaagaaacctcggctgtgcacgagagaagagttcacaaagaaggtccgcaccaatgcggccatgggcgctgtgtttacagaagagaaccaatgggactctgccagagctgccgtcgaagatgaggagttctggaaactcgtggaccgggaacgcgagctgcataaacttgggaaatgtggaagctgcgtttacaatatgatgggcaagagagagaagaagctgggggagtttggcaaagccaagggatcccgggcgatctggtacatgtggctcggcgctagatatctggagttcgaagccctggggtttctcaacgaggatcactggttctctcgggaaaatagctactccggagtggagggcgaagggctgcataaacttggatatatcctgcgcgacatttctaaaatccccggcggggccatgtacgctgatgacaccgccggctgggacacgagaattaccgaggatgacctccacaacgaggaaaagatcacacagcagatggatccggagcatcggcagctggctaatgccatttttaaacttacctatcaaaacaaggtcgtgaaagtgcagcgccctacacccaagggaaccgttatggacatcatcagcagaaaggatcagcggggctccggacaggtgggaacatacggcctgaataccttcacgaacatggaagcgcaactcgtccgccagatggagggggaaggagtgctgagcaaagccgacctggagaatccccacctcctggagaagaaaattacacagtggcttgaaaccaagggcgttgagagactgaaacggatggctatctctggggatgactgcgtggtcaagcctattgatgaccgctttgccaacgctctcctggcccttaacgatatgggcaaggtgagaaaagacatcccgcagtggcaaccctccaagggatggcacgattggcagcaggtccctttctgtagccatcacttccatgaactgattatgaaagacggccggaagctcgtggttccctgccgccctcaggacgagctgatcgggagagcgcggatctctcaaggagccggctggtccctgaaagaaaccgcttgtctcgggaaggcctatgctcagatgtggagcctgatgtactttcaccgcagagatcttcggctggcctctaatgctatttgctccgccgtgcccgtccactggatccctacaagcagaaccacatggtccattcatgcgcaccatcagtggatgacgaccgaggacatgctcacagtgtggaaccgcgtttggatcgaggataatccctggatggaagacaagaccccggtgacaacctgggaggatgtcccttacctgggaaaacgggaagaccaatggtgtggcagccttattgggctgacgtctagagccacctgggctcagaacatcctcacagccattcaacaggtgcgcagcctgatcggcgatgaggagttcctggactatatgccctccatgaagcggtttagaaaagaagaggaatctgagggagccatctggtga

SEQ ID NO: 20839 - RNA, 9873 nt, synthetic construct
  misc_feature 1..9873: note = derived and/or modified CDS sequence (opt5) from DENV-3__EU482462__SS-prME
  source 1..9873: mol_type = other RNA
acctccctgtgcctcatgatgatgctgcccgctacacttgctttccacctgacgtcccgggacggagagcctcggatgatcgtggggaagaacgaacgcggaaagtctctcctgtttaagaccgccagcggcattaatatgtgtacacttatcgcgatggatctgggggagatgtgcgacgataccgtcacatacaagtgtccgctcattgctgaagttgagcccgaagacatcgattgctggtgtaacctgacctccacatgggtgacctatggaacgtgcaatcaggccggcgagcacagacgggacaagcgctctgtggccctggctcctcacgtcgggatgggactcgataccagaacacagacctggatgagcgccgagggcgcttggagacaggtggaaaaagttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggcccgcaataagcccacgctcgacatcgagctgcagaaaaccgaagctacacagcttgccaccctgagaaagctctgtattgagggaaaaatcacaaacattaccacggattcccggtgccctacacagggcgaagcgatcctgccggaggaacaggaccagaattatgtgtgtaagcacacctacgtggatcgcggctgggggaacggatgcggccttttcgggaaaggaagcctggtgacatgcgccaagtttcaatgtctcgagcccattgagggcaaggtggttcagtatgaaaatctgaaatacacagtgatcatcaccgtccacacaggggaccagcatcaggtgggaaacgacacgcaaggcgttaccgtggagattacacctcaggcttctaccgtcgaagccgtgctgcccgagtatggcacactcgggctggaatgctcccctagaaccggacttgatttcaatgagatgatcctgctcacgatgaagaacaaggcttggatggtccaccggcagtggtttttcgacctgccccttccgtggaccagcggcgccacaaccgagacacctacctggaatcgcaaggaactgctcgtgacgtttaaaaacgcccatgctaagaaacaagaggttgtggtcctggggtctcaggaaggagcgatgcacacagccctgaccggcgctacagagattcaaaattccgggggcaccagcatcttcgccggacacctcaagtgtagactgaagatggataaacttgaactgaagggcatgtcttacgccatgtgcctcaacacctttgtgctgaaaaaggaggtttccgagacacagcatgggacgattctgatcaaagtggaatacaagggagaggacgctccctgtaagatccctttcagcaccgaagatggccaagggaaagcccacaacggacggcttattacagcgaatcccgtcgtgaccaagaaagaggagcccgtgaacatcgaagctgagcctccgttcggcgaatccaatattgttatcgggattggcgacaaggccctcaaaatcaactggtataagaagggatctagcatcggcaaaatgtttgaggccacagctagaggggcccgccggatggctattctgggagataccgcctgggacttcggctccgtcgggggagtgctgaatagcctcggcaagatggtgcatcagatctttgggtctgcgtacacggccctgttctccggcgtcagctggattatgaaaatcggaattggcgtgcttctgacatggatcgggctcaactctaagaataccagcatgtccttttcttgcattgttatcggaatcattaccctgtatctgggcgctgtggtccaggccgatatggggtgtgctatcaactggaaaggaaaggaacttaagtgcggcagcgggattttcgtgacaaatgaggttcacacctggacagagcagtacaaatttcaagccgactcccccaagagactcgcgacggccatcgctggcgcctgggaaaacggagtgtgtggcattcgcagcaccacacggatggagaatctgctgtggaaacagatcgctaacgaactcaattatatcctgtgggagaacaatattaaacttaccgtcgtggttggggatatcattggagtgctggaacagggcaaaagaacactcacccctcagcccatggacctgaagtactcttggaaaacgtgggggaaggccaagatcgtcaccgccgagacacaaaactccagcttcattatcgacggacctaacacccccgagtgcccgtctgcttcccgcgcgtggaatgtgtgggaagtggaggattatggctttggcgtcttcacaaccaacatctggctgaaacttcgggaagtttacacacagagctgtgaccatagactcatgtccgccgctattaaggatgagcgcgccgtgcacgccgacatggggtactggatcgaatctcagaaaaatggaagctggaagctggagaaagctagctttattgaggtgaagacctgcacgtggcctaagtctcacacactgtggagcaacggcgtcctcgaatccgatatgatcattcccaaaagcctggccgggcctatctctcagcataatcaccggcccggatatcatacccaaaccgcgggcccttggcaccttgggaagctggagctcgacttcaactactgcgaaggaacaaccgtggttatcacggagaattgtggcacaagaggcccctccctgcgcaccacaaccgtgagcgggaaactgattcacgagtggtgctgtcggtcttgcacacttccgcctctcagatatatgggagaagatggctgttggtacgggatggagatccggcccattaacgaaaaggaggaaaatatggtcaaatccctggtgagcgctggatctggcaaggttgacaactttaccatgggggtgctgtgcctcgccatcctgttcgaggaggtcatgcgcggaaagttcggcaaaaagcatatgattgccggcgtgctttttacgttcgttctgctcctgagcgggcagatcacctggaaagatatggctcacacatttattatgatcggatccaatgccagcgacagaatgggcatgggggtgacctatctggcgcttatcgctacattcaagattcagccctttctggccctcggattctttctgcggaaactcacctctagagaaaacctgcttctgggcgtcgggctcgccatggctacgacactgcaactgcctgaggatatcgaacagatggccaatggaattgctcttggcctgatgaccctcaagctgatcacacagttcgagacctaccagctctggaccgccctggtgtcccttacatgtagcaacacgatttttaccctgacagtggcgtggcgcaccgccacactcgtcctggctggcgtttccctgcttccgctgtgccaatctagctccatgcggaagaccgactggctccccatgacggtggccgctatgggggtgcctcccctgcctctcttcatcttttctctgaaagatacacccaagagacgcagctggcctcttaatgaaggagtcatggccgtgggcctggtttccatcctggcctctagcctcctgagaaacgacgtgcccatggctgggccgcttgtcgcgggaggcctgctcattgcctgttatgtgatcaccgggacctccgctgacctgacagttgagaaagccgccgatgtgacctgggaggaagaggctgaacagacaggagtcagccataacctcatgattacggtggacgatgacggcaccatgcggatcaaggatgacgagacagaaaatattctgaccgtccttctgaaaacagccctgctcatcgtgtctggcatcttcccttactccattcccgcgaccctgcttgtttggcacacgtggcagaagcagacccaacgcagcggggtgctgtgggatgtcccttctcccccggagacacagaaagctgagctcgaagagggagtgtacagaatcaagcagcagggcatttttgggaagacccaagttggagtgggcgtccagaaagaaggggtgttccatacaatgtggcacgtgacccggggagccgttctgacacacaacggcaagcgcctcgagcctaattgggcctccgtcaaaaaggacctgatcagctatggcgggggatggagactttctgctcagtggcaaaaaggcgaggaagtccaggtgattgccgtcgagcccgggaagaaccctaagaatttccagacgatgcccggaatctttcagaccacaaccggcgaaattggggcgatcgctctggatttcaaacccggaacctccggcagccctatcattaaccgggagggcaaggtggttgggctgtacggaaatggcgtggtcaccaagaacgggggatatgtgtccggcatcgcccaaacgaatgccgaaccggacgggcccacccctgagctcgaggaagagatgtttaagaaacgcaacctgacaattatggatcttcatcccggcagcggaaagaccagaaagtacctgcctgctatcgttcgggaagccattaaacgcagactccggacactgatcctcgctcccaccagagtggtcgccgcggagatggaagaggccctgaagggccttcctatccgctatcagacgacagctaccaaatctgagcacaccgggcgggaaattgtggacctgatgtgccatgccacattcaccatgagactgctcagcccggttcgcgtgcccaattacaacctgatcattatggatgaggctcactttacagaccctgcctccatcgccgctcggggatatatttctaccagagtcggcatgggggaagcggccgctatcttcatgacggccacaccccctggaaccgccgaggcttttccccagagcaatgccccgatccaggacgaggaacgcgatattcctgagcggtcctggaactctggcaatgaatggatcacagacttcgtggggaagaccgtgtggtttgtccccagcattaaagcgggcaacgatatcgctaactgtcttagaaagaatggaaagaaagttattcaactgtcccgcaagacgttcgacaccgagtaccagaaaacacggctcaacgattgggactttgtggtgaccacagatatctctgaaatgggcgccaatttcaaggccgacagagtcattgatccccggcgctgcctgaaacctgtgatcctgaccgacgggcccgagagagttatcctcgctggacctatgccggtgacagccgcgagcgccgctcagcggcgcggcagagtcgggcggaacccccagaaggagaatgatcaatacattttcaccggacagcctcttaacaatgacgaagaccatgcccactggacggaggctaagatgctgctggataacatcaatacacccgaaggcattatccctgccctctttgagcccgaaagagagaaatccgctgccattgacggggagtatcgcctgaagggcgaaagccggaaaaccttcgtggagcttatgagacgcggagatctgccggtttggctcgcgcacaaggtggcctctgaaggcatcaaatacaccgaccggaagtggtgctttgatggggagagaaacaatcagatcctggaagagaacatggacgtcgagatttggacaaaagaaggagagcgcaagaagctgcggcctagatggctcgatgctcgcacctattccgacccccttgccctgaaagagttcaaggattttgctgccggcagaaaaagcatcgccctggacctcgtgacagagattgggcgggtcccttctcatctggcttaccgcacgagaaatgcgcttgataacctggtgatgctccacacctccgaacatggaggccgggcctatcgccacgctgttgaggagctgcccgaaacaatggagaccctgctccttctgggcctgatgatcctcctgacagggggagccatgcttttcctgattagcggcaaggggatcggaaaaacctccatcggcctcatttgtgtgatcgtgtctagcgggatgctgtggatggccgacgtccctctgcagtggattgcttccgccatcgttctcgaatttttcatgatggtgcttctgattcccgagccggagaagcaaagaacgcctcaggataatcagctggcgtacgtggtcatcggcattctcaccctggccgctatcgtggccgctaacgaaatgggccttctggagacaaccaagcgggacctcggcatgagcaaagaacccggggttgtgtctcccacatcctatctggacgtcgatctgcaccctgccagcgcgtggaccctctacgccgtggctacgacagtcatcaccccgatgcttagacatacaattgaaaattctaccgccaacgtgagcctggctgccatcgctaaccaagccgttgtgctgatgggactcgacaagggctggcccatttccaaaatggatctgggggtccctcttctggcgctcggatgctactctcaggtgaatcccctgaccctgacagccgctgttctccttctggtgacgcactatgccatcattggccctgggctgcaggctaaggccacccgcgaagcccagaaacggacagcggctggaatcatgaagaaccccaccgtcgacggcatcatgacaattgatctcgaccctgtgatctacgatagcaagtttgagaaacaactgggccaggtgatgcttctggttctctgtgccgtccagctgctgctcatgagaacctcctgggctctttgcgaggccctgacgctggccacagggccgattaccaccctctgggaaggatctcccggcaagttctggaatacaaccatcgctgtgagcatggccaacatttttcgcgggtcctatctggcgggagccggccttgctttcagcatcatgaaatctgtggggacaggacggagaggcacgggctcccagggggagaccctgggagaaaagtggaaaaagaagctcaatcaactgagccggaaagagtttgacctgtacaagaaatccggcatcacagaagtcgatcgcaccgaggccaaggaggggctcaaaagaggagaaacaacccatcacgctgtttctcggggcagcgccaaacttcagtggttcgtggagcgcaacatggtgattcctgaagggagagtcatcgacctgggatgtggccggggcgggtggtcctattactgcgcgggactgaaaaaggtgacggaggttcgcggctataccaaaggcgggcccgggcatgaagaacctgtgcccatgtctacatacgggtggaatattgtcaaactcatgagcggaaaggatgtgttctacctgccgcctgagaaatgtgacacccttctgtgcgatatcggcgaatccagcccctctcccacagttgaggaatccagaaccattcgggtgctcaagatggtcgagccttggctgaaaaacaatcagttttgtatcaaggtgctgaacccctatatgcctacagtgattgagcacctcgaacgccttcagagaaagtacggcgggatgctggtccggaatccgctgagcagaaactctacccacgagatgtattggatctccaatggaacgggcaacatcgttagctctgtgaatatggtgagccgcctcctgcttaaccggttcacaatgacccatagacgccccaccattgaaaaagacgtcgacctgggggccggaacacggcacgtgaacgctgagcctgaaacgcccaatatggatgttatcggcgagagaattaagcgcatcaaagaggaacattcctctacctggcactacgacgatgagaacccttataagacatgggcctaccacgggagctatgaagtgaaagctaccggatccgccagctccatgattaatggcgtcgtgaagctcctgacaaagccctgggacgttgtgccgatggtcacccaaatggctatgacagataccacgccttttggccagcagcgggtgttcaaagagaaggttgacaccagaacaccccgccctatgcccgggacccggaaagtgatggaaatcacagccgagtggctgtggagaaccctcggacgcaacaagaaacctcggctgtgcacgagagaggaatttacaaagaaggtccgcaccaatgcggccatgggcgctgtgttcacagaggaaaaccaatgggattctgccagagctgccgtcgaggacgaagagttttggaaacttgtggatcgggagcgcgaactgcataagctcgggaaatgtggaagctgcgtttacaatatgatgggcaagagagagaaaaagctgggggagttcggcaaagccaagggatcccgggcgatctggtacatgtggcttggcgctagatatctggagtttgaggccctcgggttcctgaacgaagaccactggttttctcgggagaatagctactccggagtggaaggcgaggggctgcataagctcggatatattctgcgcgatatctctaaaattcccggcggggccatgtacgctgacgacaccgccggctgggatacgagaatcaccgaagacgatcttcacaacgaggagaagattacacagcagatggacccggaacatcggcagctggctaatgccatcttcaaactcacctatcaaaacaaggtcgtgaaagtgcagcgccctacacccaagggaaccgttatggatatcattagcagaaaggaccagcggggctccggacaggtgggaacatacggcctgaatacctttacgaacatggaggcgcaacttgtccgccagatggaaggggagggagtgctgagcaaagccgatctcgaaaatccccatctgctggagaagaaaatcacacagtggctcgagaccaagggcgttgaaagactgaaacggatggctatttctggggacgattgcgtggtcaagcctatcgacgatcgcttcgccaacgcccttctggccctcaacgacatgggcaaggtgagaaaagatattccgcagtggcaaccctccaagggatggcacgactggcagcaggtccctttctgtagccatcactttcatgagctgatcatgaaagacggccggaaacttgtggttccctgccgccctcaggatgaactgatcgggagagcgcggatttctcaaggagccggctggtccctcaaagagaccgcttgtctggggaaggcctatgctcagatgtggagcctgatgtacttccaccgcagagacctccggctggcctctaatgctatctgctccgccgtgcccgtccactggattcctatcagcagaacaacctggtccattcatgcgcaccatcagtggatgacaacggaagatatgcttaccgtgtggaaccgcgtttggatcgaggacaatccctggatggaggataagacaccggtgaccacatgggaagacgtcccttacctgggaaaacgggaggatcaatggtgtggcagcctcattgggctgacctctagagccacgtgggctcagaacatccttaccgccatccaacaggtgcgcagcctgattggcgacgaagagtttctcgattatatgccctccatgaagcggttcagaaaagaggaagagtctgaaggagccatctggtga

SEQ ID NO: 20840 - RNA, 9873 nt, synthetic construct
  misc_feature 1..9873: note = derived and/or modified CDS sequence (opt5) from DENV-3__EU660407__SS-prME
  source 1..9873: mol_type = other RNA
accagcctgtgcctcatgatgatgctgcccgccacacttgctttccacctgacgtcccgggacggcgagcctcggatgatcgtggggaagaatgaacgcggaaagtctctcctgtttaagaccgccagcggcattaatatgtgtacacttatcgcgatggatctgggggagatgtgcgacgataccgtcacatacaagtgtccgctcattgctgaagttgagcccgaagacatcgattgctggtgtaacctgacctccacatgggtgacctatggaacgtgcaatcaggccggcgagcatcggcgggacaagcgctctgtggccctggctcctcacgtcgggatgggactcgataccagaacacagacctggatgagcgccgagggcgcttggagacaggtggaaaaggttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagaataaacccacgctcgacatcgagctgcagaagaccgaagctacacaacttgccaccctgcgcaaactctgtattgagggaaagatcacaaacattaccacggattccagatgccctacacagggcgaagcgatcctgccggaggaacaggaccagaattatgtgtgtaaacacacctacgtggatcggggctgggggaacggatgcggccttttcgggaagggaagcctggtgacatgcgccaagtttcaatgtctcgagcccattgagggcaaagtggttcagtatgaaaatctgaagtacacagtgatcatcaccgtccacacaggggaccagcatcaggtgggaaacgacacgcaaggcgttaccgtggagattacacctcaggcttctaccgtcgaagccgtgctgcccgagtatggcacactcgggctggaatgctcccctcgcaccggacttgatttcaatgagatgatcctgctcacgatgaaaaacaaggcttggatggtccacagacagtggtttttcgacctgccccttccgtggaccagcggcgccacaaccgagacacctacctggaatcggaaagaactgctcgtgacgtttaagaacgcccatgctaaaaagcaagaggttgtggtcctggggtctcaggaaggagcgatgcacacagccctgaccggcgctacagagattcagaatagcgggggcaccagcatcttcgccggacacctcaagtgtcgcctgaaaatggataaacttgaactgaaaggcatgtcttacgccatgtgcctcaacacctttgtgctgaagaaagaggtttccgagacacagcatgggacgattctgatcaaggtggaatacaagggagaggacgctccctgtaaaatccctttcagcaccgaagatggccaagggaaggcccacaacggaagacttattacagcgaatcccgtcgtgaccaaaaaggaggagcccgtgaacatcgaagctgagcctccgttcggcgaatccaatattgttatcgggattggcgacaaagccctcaagatcaactggtataagaaaggatctagcatcggcaagatgtttgaggccacagctagaggggccagacgcatggctattctgggagataccgcctgggacttcggctccgtcgggggagtgctgaatagcctcggcaaaatggtgcatcagatctttgggtctgcgtacacggccctgttctccggcgtcagctggattatgaagatcggaattggcgtgcttctgacatggatcgggctcaactctaaaaataccagcatgtccttttcttgcattgttatcggaatcattaccctgtatctgggcgctgtggtccaggccgatatggggtgtgtgatcaactggaagggaaaggaacttaaatgcggcagcgggattttcgttacaaatgaggtgcacacctggacagagcagtacaagtttcaagctgactcccccaaacggctcgccacggcgatcgccggcgcttgggaaaacggagtctgtggcattagaagcaccacacgcatggagaatctgctgtggaagcagatcgccaacgaactcaattatatcctgtgggagaacaatattaaacttaccgtggttgtgggggatatcattggagtcctggaacagggcaagcggacactcacccctcagcccatggagctgaaatactcttggaagacgtgggggaaggctaaaatcgtgaccgccgagacacaaaactccagcttcattatcgacggacctaacacccccgaatgcccgtctgcctccagagcttggaatgtgtgggaggtcgaagactatggctttggcgttttcacaaccaacatctggctgaaacttcgcgaggtgtacacacagagctgtgatcatcggctcatgtccgcggccattaaagacgaaagagctgtgcacgccgatatggggtactggatcgagtctcagaagaatggaagctggaaactggagaaggcctcctttattgaagtcaagacctgcacgtggcctaaatctcacacactgtggagcaacggcgtgctcgagaatgacatgatcattcccaagtccctggctgggcctatcagccagcataaccaccgccccggatatcatacccaaaccgccggcccttggcaccttgggaaactggaactcgatttcaattactgcgagggaacaaccgttgtgatcacggagaactgtggcacacggggcccctctctgagaaccacaaccgtctccgggaagctgattcacgaatggtgctgtcgcagctgcacacttccgcctctccggtatatgggagaggacggctgttggtacgggatggaaatcagacccattaatgagaaagaagagaacatggtgaagtctctggtttccgcgggaagcggcaaggtggataattttaccatgggggtcctgtgcctcgctatcctgttcgaggaagtgatgcggggaaaattcggcaagaaacatatgattgccggcgttctttttacgttcgtgctgctcctgtctgggcagatcacctggcgcgacatggcccacacactgattatgatcggaagcaacgcttccgatagaatgggcatgggggtcacctatcttgccctgatcgcgacatttaagattcagcccttcctcgctctgggatttttcctccggaaactgaccagcagagagaatcttctgctcggcgtggggctggccatggccacgacactgcaacttcctgaagacatcgagcagatggctaacggaattgccctgggcctcatgaccctgaagctcatcacacagtttgaaacctaccagctgtggaccgctcttgtgtctctgacatgttccaatacgattttcaccctcacagtcgcctggcgcaccgcgacactgatcctggccggcgttagccttctgccgctctgccaatcctctagcatgcggaagaccgattggctgcccatgacggtggctgccatgggggtgcctcccctccctctgtttatcttctcccttaaagacacacccaagagacgctcttggcctctgaacgagggagtcatggctgtgggcctggttagcattctcgcctcctctctgcttagaaacgatgtgcccatggccgggccgctggtcgctggaggcctcctgatcgcgtgttatgtgattaccgggaccagcgccgacctcacagttgagaaagctgccgacgtgacctgggaagaggaagccgagcagacaggagtctcccataatctgatgatcacggtggatgacgatggcaccatgcggattaaggacgatgaaacagagaacatccttaccgtcctgctgaaaacagctctcctgatcgtgagcggcatttttccttactctatccccgccacccttctggtttggcacacgtggcagaagcagacccaacgctccggggtgctctgggacgtcccttctcccccggagacacagaaagcggaactggaggaaggagtgtacagaattaagcagcagggcatcttcgggaagacccaagttggagtgggcgtccagaaagagggggtgtttcatacaatgtggcacgtgacccggggagctgttctcacacacaatggcaagcgcctggagcctaactgggcctccgtcaaaaaggatcttatttcctatggcgggggatggagactgagcgcccagtggcaaaaaggcgaagaggtccaggtgatcgctgtcgaacccgggaagaatcctaagaacttccagacgatgcccggaattttccagaccacaaccggcgagatcggggccatcgcgctggactttaaacccggaacctctggctcccctattatcaatcgggaaggcaaggtggttgggctctacggaaacggcgtggtcaccaagaatgggggatatgtgagcggcattgctcaaacgaacgccgagccggatgggcccacccctgagctggaagaggaaatgttcaagaaacgcaatcttacaatcatggacctgcatcccggctccggaaagaccagaaagtacctccctgccattgttcgggaggctatcaaacgcagactgcggacactcatcctggcccccaccagagtggtcgctgccgaaatggaggaggcgcttaagggcctgcctattcgctatcagacgacagccaccaaaagcgaacacaccgggcgggagatcgtggatctgatgtgccatgctacatttaccatgagactcctgtctccggttcgcgtgcccaactacaatcttattatcatggacgaagcccacttcacagatcctgctagcattgccgcccggggatatatctccaccagagtcggcatgggggaggctgcggccatctttatgacggctacaccccctggaaccgccgaagccttcccccagtctaacgctccgattcaggacgaggagcgcgacatccctgaacggagctggaactccggcaacgagtggattacagattttgtggggaagaccgtgtggttcgtcccctctatcaaagccggcaacgacattgcgaattgtctgagaaagaacggaaagaaagttatccaactcagccgcaagacgtttgataccgaataccagaaaacaaagctgaatgactgggatttcgtggtgaccacagacatttccgagatgggcgctaactttaaagccgatcgggtcatcgaccccagacggtgcctgaagcctgtgatcctcaccgatgggcccgagcgcgttattcttgccggacctatgccggtgacagctgcctctgcggcccagagacggggccgcgtcgggagaaatccccagaaggaaaacgaccaatacatcttcaccggacagcctctgaataacgatgaggaccatgctcactggacggaagccaaaatgctgctcgacaatattaacacacccgagggcatcattcctgctctgttcgaacccgagcgggaaaagagcgccgctatcgatggggaatatagacttaaaggcgagtcccgcaagacctttgtggaactgatgcggagaggagacctcccggtttggctggcccacaaagtggcgagcgagggcatcaagtacaccgatcgcaaatggtgcttcgacggggaacggaataaccagattctggaggagaatatggatgtcgaaatctggacaaaggagggagaaagaaagaaactccgccctcggtggcttgacgccagaacctattctgatcccctggctctgaaggagtttaaagacttcgccgctggccgcaagtccattgccctcgatctggtgacagaaatcgggagagtccctagccatcttgcctaccggacgcgcaacgctctggacaatctcgtgatgctgcacacctctgagcatggaggcagagcgtatcggcacgccgttgaggaactgcccgagacaatggaaaccctccttctgctgggcctcatgattctgcttacagggggagctatgctgtttctcatctccggcaaagggatcggaaagaccagcattggcctgatctgtgtgattgtgtcctctgggatgctgtggatggccgatgtccctctccagtggatcgccagcgctattgttcttgagttctttatgatggtgctgctgatccccgagccggaaaagcaacgcacgcctcaggacaaccagctcgcctacgtggtcattggaatcctgacccttgcggccatcgtggctgccaatgagatgggcctgctcgaaacaaccaaaagagatctgggcatgtccaaggagcccggggttgtgagccccacatcttatctggacgtcgacctccaccctgcttccgcctggaccctttacgcggtggccacgacagtcattaccccgatgctgcggcatacaatcgaaaacagcaccgctaacgtgtctctggccgctattgccaatcaagctgttgtgctcatgggactggataaaggctggcccatcagcaagatggaccttggggtccctctgctcgccctgggatgctactcccaggtgaaccccctgaccctcacagcggccgttcttctgctggtgacgcactatgctattatcggccctgggctccaggccaaagctaccagagaggcccagaagcgcacagccgcgggaatcatgaagaatcccaccgtcgatggcattatgacaatcgacctggatcctgtgatttacgactctaaattcgagaagcaacttggccaggtgatgctgctcgttctgtgtgctgtccagctgctccttatgcggaccagctgggccctgtgcgaagctctgacgctcgccacagggccgatcaccaccctgtgggagggatcccccggcaaattttggaacacaaccattgccgtgtctatggctaatatcttcagagggagctatcttgccggagcgggcctggccttttccatcatgaaaagcgtggggacaggacgccggggcacgggctctcagggggaaaccctcggagagaaatggaagaagaaactgaaccaactgtccagaaaggagttcgatctctacaaaaagagcggcattacagaggtcgaccggaccgaggctaaagaagggcttaagcgcggagagacaacccatcacgccgtttccagaggctctgctaaactgcagtggtttgtggaacggaatatggtgatccctgaggggcgcgtcattgatctgggatgtggcagaggcgggtggagctattactgcgccggactcaagcgggtgacggaagttcgcggctataccaaaggcgggcccgggcatgaggagcctgtgcccatgtccacatacgggtggaacatcgtcaaactgatgtctggaaaggacgtgttctaccttccgcctgaaaaatgtgataccctgctctgcgacattggcgagagctcccccagccccacagttgaagagtctagaaccatccgggtgctgaagatggtcgagccttggctgaaaaataaccagttctgtattaaggtgctcaatccctatatgcctacagtgatcgaacaccttgagcgcctgcagagaaagtacggcgggatgctggtccggaacccgctctccagaaatagcacccacgaaatgtattggatctctaacggaacgggcaatattgtttccagcgtgaacatggtgtctcgcctgcttctgaaccggtttacaatgacccatagacgccccaccatcgagaaagatgtcgacctcggggcgggaacacggcacgtgaatgccgaacctgagacgcccaacatggacgttattggcgagagaatcaagcgcattaaagaagaacacagctccacctggcactacgatgacgaaaatccttataagacatgggcttaccacgggtcttatgaggtgaaagccaccggaagcgcttccagcatgatcaacggcgtcgtgaagctgctgacaaagccctgggatgttgtgccgatggtcacccaaatggccatgacagacaccacgcctttcggccagcagcgggtgtttaaagaaaaggttgataccagaacaccccgccctatgcccgggacccggaaagtgatggagatcacagctgagtggctctggagaaccctgggacgcaataagaaacctcggctttgcacgagagaagagttcacaaagaaggtccgcaccaacgccgcgatgggcgccgtgtttacagaagagaatcaatgggactccgctagagccgctgtcgaagatgaggagttctggaaactggtggaccgggaacgcgagctccataagctggggaaatgtggatcttgcgtttacaacatgatgggcaagagagagaagaaacttggggagtttggcaaagccaagggaagccgggccatttggtacatgtggctgggcgcgagatatctcgagttcgaagctctggggtttctgaatgaggatcactggttctcccgggaaaactcttacagcggagtggagggcgaagggctccataagctgggatatatccttcgcgacatttccaaaatccccggcggggccatgtacgccgatgacaccgctggctgggacacgagaattaccgaggatgacctgcacaatgaggaaaagatcacacagcagatggatccggagcatcggcagctcgccaacgctatctttaaactgacctatcaaaataaggtcgtgaaagtgcagcgccctacacccaagggaaccgttatggacattatctctagaaaggatcagcggggcagcggacaggtgggaacatacggccttaacaccttcacgaatatggaagcccaactggtccgccagatggagggggaaggagtgctctccaaagcggacctggagaacccccatctgctcgagaagaaaattacacagtggctggaaaccaagggcgttgagagacttaaacggatggccatcagcggggatgactgcgtggtcaagcctattgatgaccgctttgctaacgccctgctcgctctgaatgatatgggcaaggtgagaaaagacatcccgcagtggcaaccctctaagggatggcacgattggcagcaggtccctttctgttcccatcacttccatgaacttatcatgaaagacggccggaagctggtggttccctgccgccctcaggacgagctcattgggagagcccggatcagccaaggagcgggctggtctctgaaagaaaccgcctgtctggggaaggcttatgcccagatgtggtccctcatgtactttcaccgcagagatctgcggcttgctagcaacgccatttgctctgctgtgcccgtccactggatccctacatccagaaccacatggagcattcatgcccaccatcagtggatgacgaccgaggacatgctgacagtgtggaatcgcgtttggatcgaggataacccctggatggaagacaagaccccggtgacaacctgggaggatgtcccttacctcggaaaacgggaagaccaatggtgtggctccctgattgggcttacgagcagagcgacctgggcccagaatatcctgacagctatccaacaggtgcgctctctcattggcgatgaggagttcctggactatatgcccagcatgaagcggtttagaaaagaagaggaatccgagggagccatctggtga

SEQ ID NO: 20841 - RNA, 9873 nt, synthetic construct
  misc_feature 1..9873: note = derived and/or modified CDS sequence (opt5) from DENV-3__EU660409__SS-prME
  source 1..9873: mol_type = other RNA
accagcctgtgcctcatgatgatgctgcccgccacacttgctttccacctgacgtccagagacggcgagcctcggatgatcgtggggaagaacgaacgcggaaaatctctcctgtttaagaccgccagcggcattaatatgtgtacacttatcgcgatggatctgggggagatgtgcgacgataccgtcacatacaaatgtccgctcattgctgaagttgagcccgaagacatcgattgctggtgtaacctgacctccacatgggtgacctatggaacgtgcaatcaggccggcgagcatagacgggacaagcgctctgtggccctggctcctcacgtcgggatgggactcgataccagaacacaaacctggatgagcgccgagggcgcttggcggcaggtggaaaaagttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagaataaacccacgctcgacatcgagctgcagaagaccgaagctacacgccttgccaccctgagaaaactctgtattgagggaaagatcacaaacattaccacggattcccggtgccctacacaaggcgaagcgatcctgccggaggaacaggaccagaattatgtgtgtaaacacacctacgtggatcgcggctgggggaacggatgcggccttttcgggaagggaagcctggtcacctgcgccaagtttcagtgtctcgagctgattgagggcaaagtggttcaatatgaaaatctgaagtacacagtgatcatcaccgtccacacaggggaccagcatcaggtgggaaacgacacgcagggcgctaccgttgagattacaccccaagcctctaccgtggaagctgtcctccctgagtatggcacactggggcttgaatgctcccccagaaccggactggatttcaatgagatgatcctcctgacgatgaaaaacaaggcctggatggtgcaccggcagtggtttttcgaccttcctctgccctggaccagcggcgccacaaccgagacaccgacctggaatcgcaaagaactcctggtcacgtttaagaacgctcatgcgaaaaagcaggaggtggttgtgctggggtctcaagaaggagccatgcacacagctctcaccggcgccacagagattcagaattccgggggcaccagcatcttcgccggacacctgaagtgtagacttaaaatggataagctggaactcaaaggcatgtcttacgctatgtgcctgaacacctttgtcctgaagaaagaggtgtccgagacacagcatgggacgattcttatcaaggttgaatacaagggagaggacgccccttgtaaaatccccttcagcaccgaagatggccaggggaaggcgcacaacggacggctcattacagctaatcctgtggtcaccaaaaaggaggagcccgtgaacatcgaagccgagccccctttcggcgaatccaatattgtgatcgggattggcgacaaagccctgaagatcaactggtataagaaaggatctagcatcggcaagatgtttgaggctacagccagaggggctcgccggatggccattctgggagataccgcgtgggacttcggctccgttgggggagtcctcaatagcctgggcaaaatggtgcatcaaatctttgggtctgcctacacggctcttttctccggcgtgagctggattatgaagatcggaattggcgtcctgctcacatggatcgggctgaactctaaaaataccagcatgtccttttcttgcattgccatcggaatcattaccctgtatcttggcgctgtggttcaggccgatatggggtgtgtgatcaactggaagggaaaggaactcaaatgcggcagcgggattttcgtcacaaatgaggtgcacacctggacagagcagtacaagtttcaggcggactccccgaaaagactggccacggctatcgccggcgcttgggaaaacggagtttgtggcattcgcagcaccacacggatggagaatctgctctggaagcaaatcgccaacgaactgaattatatcctttgggagaacaatattaaactgaccgtggtcgtgggggatatcattggagttctcgaacagggcaagagaacactgaccccccagcctatggagctgaaatactcttggaagacgtgggggaaggccaaaatcgtgaccgctgagacacagaactccagcttcattatcgacggacccaacacccctgaatgcccctctgcgtcccgcgcctggaatgtctgggaggtggaagactatggctttggcgtgttcacaaccaacatctggcttaagctccgggaggtctacacacaaagctgtgatcatagactgatgtccgctgccattaaagacgaacgcgccgttcacgctgatatggggtactggatcgagtctcagaagaatggaagctggaaactggagaaggcctcctttattgaagtgaagacctgcacgtggccgaaatctcacacactctggagcaacggcgtgctggagtccgacatgatcattcctaagagccttgcggggcccatctctcagcataatcaccggcctggatatcatacccagaccgctggcccctggcacctggggaaactcgaactggatttcaactactgcgagggaacaaccgtcgtgatcacggagaattgtggcacaagaggcccttccctgcgcaccacaaccgttagcgggaagcttattcacgaatggtgctgtcggtcttgcacactccccccgctgagatatatgggagaggacggctgttggtacgggatggaaatccggcctattaacgagaaagaagagaatatggtgaagtccctggtcagcgccggatctggcaaggtggataactttaccatgggggccctctgcctggctatccttttcgaggaagttatgcgcggaaaattcggcaagaaacatatgattgccggcgtgctgtttacgttcgtcctcctgctgagcgggcaaatcacctggagagacatggcgcacacacttattatgatcggatccaatgctagcgatcggatgggcatgggggtgacctatctggccctcatcgccacatttaagattcagcccttcctggctctcggatttttcctgagaaaacttacctctcgcgagaacctgctcctgggcgttgggctggccatggctacgacacttcagctgcccgaagacatcgagcaaatggccaatggaattgcgctcggcctgatgaccctcaagctgatcacacagtttgaaacctaccagctttggaccgccctggtgtccctcacatgtagcaacacgattttcaccctgacagtcgcttggcggaccgccacactgatccttgctggcgtgtccctgctccctctgtgccagtctagctccatgagaaagaccgattggctcccgatggccgtggccgctatgggggtcccccctctgcccctttttatcttctctctgaaagacacgcctaagcgcagaagctggcccctgaatgagggagttatggcggtgggcctcgtgtccattctggcctctagccttctgcggaacgatgtccctatggctgggcccctcgtggccggaggcctgctcatcgcctgttatgttattacagggacctccgctgacctgaccgtggagaaagtcgccgacgtgacatgggaagaggaagcggagcaaaccggagttagccataaccttatgatcacagtggatgacgatggcacgatgcgcattaaggacgatgaaaccgagaatatcctgacagtcctgctcaaaaccgctctgcttatcgtgtctggcatttttccgtactccatccctgccacactgctcgtctggcacacctggcagaagcagacgcagagaagcggggtgctgtgggacgttccctctcctcccgagacccaaaaagccgaactcgaggaaggagtgtaccggattaagcagcagggcatcttcgggaagacacaggtcggagtgggcgttcaaaaagagggggtgtttcataccatgtggcacgtcacacgcggagctgtgctgacccacaacggcaagagacttgagccgaattgggcctccgtgaaaaaggatctgattagctatggcgggggatggcggctgtctgcgcagtggcagaaaggcgaagaggttcaagtcatcgctgtggaacctgggaagaaccccaagaatttccagacaatgcctggaattttccagacgaccacaggcgagatcggggccatcgccctcgactttaaacccggaacctccggcagccccattatcaaccgcgaaggcaaggtggtcgggctgtacggaaatggcgtggttaccaaaaacgggggatatgtgtccggcattgctcagacaaatgccgagcctgatgggccgacgcccgagcttgaagaggaaatgttcaagaaaagaaacctgaccatcatggacctccatcctggcagcggaaagacacggaagtacctgcccgctattgtccgcgaggccatcaaaagacggctcagaaccctgatccttgcgcctacacgcgtggttgccgctgaaatggaggaggccctgaagggcctgcccattcggtatcaaaccacggctacaaaatctgaacacaccgggagagagatcgtggatctcatgtgccatgccacctttacaatgcgcctgcttagccctgtccgggtgccgaattacaacctgattatcatggacgaagcccacttcaccgatcccgcttccattgcggccagaggatatatctctacacgcgttggcatgggggaggctgccgccatctttatgaccgctacgcctcccggaacagccgaagcgttccctcagagcaatgctcccattcaggacgaggagcgggacatcccggaaagatcctggaactctggcaatgagtggattaccgattttgtggggaagacagtctggttcgtgcctagcatcaaagccggcaacgacattgccaactgtctccgcaagaatggaaagaaagtgatccagctgtcccggaagacctttgatacggaataccaaaaaaccagactgaacgactgggatttcgtcgttacaaccgacatttctgagatgggcgctaattttaaggccgatcgggtgatcgacccccgcagatgcctcaaacccgtgatccttacagatgggcctgagcgggtcattctggcgggacccatgcctgtgaccgccgctagcgccgctcagcgcagaggccgggttgggagaaacccgcagaaggaaaatgaccagtacatcttcacaggacaacccctgaacaatgatgaggaccatgcccactggaccgaagctaagatgctcctggacaacattaatacgcctgagggcatcattcccgcccttttcgaacctgagcgcgagaaatccgcggccatcgatggggaatatcggctgaagggcgagagcagaaaaacatttgtggaactcatgcgccggggagacctgcccgtctggctggctcacaaggtggcctctgagggcatcaaatacaccgatagaaagtggtgcttcgacggggaacgcaacaatcagattctcgaggagaacatggatgttgaaatctggaccaaagagggagaacggaagaagcttagaccgcgctggctggacgctagaacatattccgatcctctggccctcaaagagtttaaggacttcgccgctggccggaaaagcattgcgctggatcttgtgaccgaaatcgggcgcgtcccctctcatctggcctacagaacacggaatgctctcgacaacctggtgatgctgcacacgtccgagcatggaggccgcgcctatagacacgccgtcgaggaactccctgagaccatggaaacacttctgctgctcggcctgatgattcttctgaccgggggagctatgctctttctgatcagcggcaaggggatcggaaaaacatccattggcctgatctgtgtgaccgtttctagcgggatgctctggatggccgatgtgccccttcagtggattgcgtccgccatcgtgctggagttctttatgatggtcctgctcattcctgagcccgaaaagcagcggacgccgcaagacaatcagctggcttacgttgtgatcggaattcttaccctggccgctatcgtggccgcgaacgagatgggcctcctggaaacaaccaagagagatctgggcatgagcaaagagcctggggtcgtgtctcccacatcctatctcgacgttgaccttcaccccgccagcgcttggaccctgtacgccgtggctacgacagtcatcacccctatgctgcgccatacaattgaaaattctaccgccaacgtgagcctcgctgccatcgcgaaccaggccgtcgtgctgatgggacttgataagggctggccgatttccaaaatggacctgggggttcccctcctggctctgggatgctactctcaagtgaatcctctcacccttacagccgctgtcctgctgctcgtgacgcactatgccatcattggccccgggctgcaggccaaggcgacccgggaggctcagaaaagaacagccgctggaatcatgaagaaccctaccgttgatggcatcatgacaattgaccttgatcccgtgatctacgacagcaagttcgagaaacagctgggccaagtcatgctcctggtgctgtgtgccgtgcagctccttctgatgcgcacctcctgggccctgtgcgaagctctcacgctggccacagggcctattaccaccctttgggagggatctccgggcaagttttggaatacaaccatcgcggttagcatggccaacattttccgggggtcctatctggctggagccggcctcgcttttagcatcatgaaatctgtcgggacaggaagacggggcacgggctcccagggggaaaccctgggagagaagtggaaaaagaagctgaatcagctcagccgcaaagaattcgatctttacaagaaatccggcatcacagaggtggacagaaccgaggccaaggaagggctgaaacggggagagacaacccatcacgcggtgtctcgcggcagcgccaagctgcaatggtttgtcgaaagaaacatggttattcccgaggggcgggtgatcgatctcggatgtggccgcggcgggtggtcctattactgcgctggactgaaaaaggtgacggaagtcagaggctataccaaggggggacctggccatgaggagcccgtgcctatgtctacatacgggtggaatattgttaaacttatgagcggaaaggacgtgttctacctgcccccggaaaaatgtgataccctcctgtgcgacatcggcgagtccagcccttctcccacagtcgaagagtcccggaccattcgcgtgctgaagatggttgagccctggctcaaaaacaatcagttctgtatcaaggtgcttaacccttatatgcccacagtcattgaacacctggagagactgcagcggaagtacggcgggatgctcgtgagaaatcctctgagccgcaactctacccacgaaatgtattggatctccaatggaacgggcaacatcgtgagctctgtcaatatggttagccggcttctgctcaacagatttacaatgacccatcgccggccgaccattgagaaagatgtggacctgggggccggaacaagacacgtgaacgctgaacccgagacgcctaatatggacgtcatcggcgagcgcattaagcggatcaaagaagagcattcctctacctggcactacgatgacgaaaacccctataagacatgggcctaccacgggagctatgaggtgaaagctaccggatccgccagctccatgattaatggcgttgtgaagctgctcacaaagccttgggatgtcgtgcccatggttacccagatggcgatgacagacaccacgccgttcggccaacagagagtgtttaaagaaaaggtcgatacccgcacacctcggcccatgcctgggaccagaaaagtgatggagatcacagccgagtggctgtggcgcacccttggacggaacaagaaacccagactgtgcacgcgcgaagagttcacaaagaaggttagaaccaatgctgccatgggcgctgtgtttacagaagagaaccagtgggactctgcccgggccgcggtcgaagatgaggagttctggaaactcgtggaccgcgaaagagagctgcataagcttgggaaatgtggaagctgcgtctacaatatgatgggcaagcgggaaaaaaagctgggggagtttggcaaagctaagggatccagagccatctggtacatgtggctcggcgcccggtatctggagttcgaagctctggggtttctcaacgaggatcactggttctctcgcgaaaatagctactccggagtggagggcgaagggctgcataagcttggatatattctgagagacatctctaaaattcctggcggggccatgtacgctgatgacaccgccggctgggacacgcggatcaccgaggatgacctccacaacgaggaaaagattacacaacagatggatcccgagcatcgccagctggcgaatgccatctttaaacttacctatcagaacaaggttgtgaaagtccaaagaccgacacctaagggaaccgtgatggacatcattagccggaaggatcagcgcggctccgggcaggtgggaacatacggcctgaataccttcacgaacatggaagctcagctcgttagacaaatggagggggaaggagtgctgagcaaagccgacctggagaatccccacctcctggagaagaaaatcacacagtggcttgaaaccaagggcgtcgagcggctgaaacgcatggctatttctggggatgactgcgtggttaagcccatcgatgacagatttgccaacgcgctcctggcccttaacgatatgggcaaggtgcggaaagacattcctcagtggcagccgtccaagggatggcacgattggcaacaggtccccttctgtagccatcacttccatgaactgatcatgaaagacggccgcaagctcgtggtcccttgcagaccccaggacgagctgatcgggcgggctcgcatttctcagggagccggctggtccctgaaagaaaccgcttgtctcgggaaggcctatgctcaaatgtggagcctgatgtactttcacagacgggatcttagactggcctctaatgcgatctgctccgccgtgcctgttcactggattcccacaagccgcaccacatggtccatccatgctcaccatcagtggatgacgaccgaggacatgctcacagtgtggaaccgggtctggattgaggataatccttggatggaagacaagacccccgtgacaacctgggaggatgttccgtacctgggaaaaagagaagaccagtggtgtggcagccttatcgggctgacgtctcgcgccacctgggcccaaaacattctcacagctatccagcaggtgcggagcctgatcggcgatgaggagttcctggactatatgccttccatgaagagatttcgcaaagaagaggaatctgagggagccatttggtga

SEQ ID NO: 20842 - RNA, 9873 nt, synthetic construct
  misc_feature 1..9873: note = derived and/or modified CDS sequence (opt5) from DENV-3__EU660410__SS-prME
  source 1..9873: mol_type = other RNA
accagcctgtgcctcatgatgatgctgcccgccacacttgctttccacctgacgtccagagacggcgagcctcggatgatcgtggggaagaacgaacgcggaaaatctctcctgtttaagaccgccagcggcattaatatgtgtacacttatcgcgatggatctgggggagatgtgcgacgataccgtcacatacaaatgtccgctcattgctgaagttgagcccgaagacatcgattgctggtgtaacctgacctccacatgggtgacctatggaacgtgcaatcaggccggcgagcatagacgggacaagcgctctgtggccctggctcctcacgtcgggatgggactcgataccagaacacaaacctggatgagcgccgagggcgcttggcggcaggtggaaaaagttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggcccgcaataagcccacgctcgacatcgagctgcagaaaaccgaagctacacaacttgccaccctgagaaagctctgtattgagggaaaaatcacaaacattaccacggattcccggtgccctacacagggcgaagcgatcctgccggaggaacaggaccagaattatgtgtgtaagcacacctacgtggatcgcggctgggggaacggatgcggccttttcgggaaaggaagcctggtcacctgcgccaagtttcaatgtctcgagcccattgagggcaaggtggttcagtatgaaaatctgaaatacacagtgatcatcaccgtccacacaggggaccagcatcaggtgggaaacgacacgcaaggcgttaccgtggagattacacctcaggcttctaccgtcgaagccgtgctgcccgagtatggcacactcgggctggaatgctcccctagaaccggacttgatttcaatgagatgatcctgctcacgatgaagaacaaagcttggatggtccaccggcagtggtttttcgacctgccccttccgtggaccagcggcgccacaaccgagacacctacctggaatcgcaaggaactgctcgtgacgtttaaaaacgcccatgctaagaaacaagaggttgtggtcctggggtctcaggaaggagcgatgcacacagccctgaccggcgctacagagattcagaattccgggggcaccagcatcttcgccggacacctcaagtgtagactgaagatggataaacttgaactgaagggcatgtcttacgccatgtgcctcaacacctttgtgctgaaaaaggaggtttccgagacacagcatgggacgattctgatcaaagtggaatacaagggagaggacgctccctgtaagatccctttcagcaccgaagatggccaagggaaagcccacaacggacggcttattacagcgaatcccgtcgtgaccaagaaagaggagcccgtgaacatcgaagctgagcctccgttcggcgaatccaatattgttatcgggattggcgacaaggccctcaaaatcaactggtataagaagggatctagcatcggcaaaatgtttgaggccacagctagaggggcccgccggatggctattctgggagataccgcctgggacttcggctccgtcgggggagtgctgaatagcctcggcaagatggtgcatcagatctttgggtctgcgtacacggccctgttctccggcgtcagctggattatgaaaatcggaattggcgtgcttctgacatggatcgggctcaactctaagaataccagcatgtccttttcttgcattgttatcggaatcattaccctgtatctgggcgctgtggtccaggccgatatggggtgtgctatcaactggaaaggaaaggaacttaagtgcggcagcgggattttcgtgacaaatgaggttcacacctggacagagcagtacaaatttcaagccgactcccccaagagactcgcgacggccatcgctggcgcctgggaaaacggagtgtgtggcattcgcagcaccacacggatggagaatctgctgtggaaacagatcgctaacgaactcaattatatcctgtgggagaacaatattaagcttaccgtcgtggttggggatatcattggagtgctggaacagggcaaaagaacactcacccctcagcccatggagctgaagtactcttggaaaacgtgggggaaggccaagatcgtcaccgccgagacacaaaactccagcttcattatcgacggacctaacacccccgaatgcccgtctgcttcccgcgcgtggaatgtgtgggaggtggaagactatggctttggcgtcttcacaaccaacatctggctgaaacttcgggaggtttacacacagagctgtgatcatagactcatgtccgccgctattaaggacgaacgcgccgtgcacgccgatatggggtactggatcgagtctcagaaaaatggaagctggaagctggagaaagcttcctttattgaagtgaagacctgcacgtggcctaagtctcacacactgtggagcaacggcgtcctcgagtccgacatgatcattcccaaaagcctggccgggcctatctctcagcataatcaccggcccggatatcatacccaaaccgcgggcccttggcaccttgggaagctggaactcgatttcaactactgcgagggaacaaccgtggttatcacggagaattgtggcacaagaggcccctccctgcgcaccacaaccgtgagcgggaaactgattcacgaatggtgctgtcggtcttgcacacttccgcctctcagatatatgggagaggacggctgttggtacgggatggaaatccggcccattaacgagaaggaagagaatatggtcaaatccctggtgagcgctggatctggcaaggttgataactttaccatgggggtgctgtgcctcgccatcctgttcgaggaagtcatgcgcggaaagttcggcaaaaagcatatgattgccggcgtgctttttacgttcgttctgctcctgagcgggcagatcacctggagagacatggctcacacatttattatgatcggatccaatgccagcgatcggatgggcatgggggtgacctatctggcgcttatcgctacattcaaaattcagccctttctggccctcggattctttctgagaaagctcacctctcgcgagaacctgcttctgggcgtcgggctcgccatggctacgacactgcaactgcctgaagacatcgagcagatggccaatggaattgctcttggcctgatgaccctcaaactgatcacacagttcgaaacctaccagctctggaccgccctggtgtcccttacatgtagcaacacgatttttaccctgacagtggcgtggcggaccgccacactcgtcctggctggcgtttccctgcttccgctgtgccaatctagctccatgagaaagaccgattggctccccatgacggtggccgctatgggggtgcctcccctgcctctcttcatcttttctctgaaggacacacccaaacgcagaagctggcctcttaatgagggagtcatggccgtgggcctggtttccatcctggcctctagcctcctgcggaacgatgtgcccatggctgggccgcttgtcgcgggaggcctgctcattgcctgttatgtgatcaccgggacctccgctgacctgacagttgagaaggccgccgacgtgacctgggaagaggaagctgagcagacaggagtcagccataacctcatgattacggtggatgacgatggcaccatgcgcatcaaagacgatgaaacagagaatattctgaccgtccttctgaagacagccctgctcatcgtgtctggcatcttcccttactccattcccgcgaccctgcttgtttggcacacgtggcagaaacagacccaaagaagcggggtgctgtgggacgtcccttctcccccggagacacagaaggctgaactcgaggaaggagtgtaccggatcaaacagcagggcatttttgggaagacccaagttggagtgggcgtccagaaggagggggtgttccatacaatgtggcacgtgacccgcggagccgttctgacacacaacggcaaaagactcgagcctaattgggcctccgtcaagaaagatctgatcagctatggcgggggatggcggctttctgctcagtggcaaaagggcgaagaggtgcaggtgattgccgtcgaacccgggaaaaaccctaagaatttccagacgatgcccggaatctttcagaccacaaccggcgagattggggcgatcgctctggacttcaagcccggaacctccggcagccctatcattaaccgcgaaggcaaagtggttgggctgtacggaaatggcgtggtcacaaagaacgggggatatgtgtccggcatcgcccaaacgaatgccgagccggatgggcccacccctgagctcgaagaggaaatgtttaaaaagagaaacctgacaattatggaccttcatcccggcagcggaaaaacccggaagtacctgcctgctatcgttcgcgaggccattaagagacggctcagaacactgatcctcgctcccacccgcgtggtcgccgcggaaatggaggaggccctgaaaggccttcctatccggtatcagacgacagctaccaagtctgaacacaccgggagagagattgtggatctgatgtgccatgccacattcaccatgcgcctgctcagcccggttcgggtgcccaattacaacctgatcattatggacgaagctcactttacagatcctgcctccatcgccgctagaggatatatttctacccgcgtcggcatgggggaggcggccgctatcttcatgacggccacaccccctggaaccgccgaagcttttccccagagcaatgccccgatccaggacgaggagcgggacattcctgaaagatcctggaactctggcaatgagtggatcacagatttcgtggggaaaaccgtgtggtttgtccccagcattaaggcgggcaacgacatcgctaactgtcttcgcaaaaatggaaagaaggttattcaactgtcccggaaaacgttcgataccgaataccagaagacaagactcaacgactgggattttgtggtgaccacagacatctctgagatgggcgccaatttcaaagccgatcgggtcattgacccccgcagatgcctgaagcctgtgatcctgaccgatgggcccgagcgggttatcctcgctggacctatgccggtgacagccgcgagcgccgctcagcgcagaggccgggtcgggagaaacccccagaaagaaaatgaccaatacattttcaccggacagcctcttaacaatgatgaggaccatgcccactggacggaagctaagatgctgctggacaacatcaatacacccgagggcattatccctgccctctttgaacccgagcgcgagaagtccgctgccattgatggggaatatcggctgaaaggcgagagcagaaagaccttcgtggaacttatgcgccggggagacctgccggtttggctcgcgcacaaagtggcctctgagggcatcaagtacaccgatagaaaatggtgctttgacggggaacgcaacaatcagatcctggaggagaacatggatgtcgaaatttggacaaaggagggagaacggaaaaagctgagacctcgctggctcgacgctagaacctattccgatccccttgccctgaaggagttcaaagactttgctgccggccggaagagcatcgccctggatctcgtgacagaaattgggcgcgtcccttctcatctggcttacagaacgcggaatgcgcttgacaacctggtgatgctccacacctccgagcatggaggccgcgcctatagacacgctgttgaggaactgcccgagacaatggaaaccctgctccttctgggcctgatgatcctcctgacagggggagccatgcttttcctgattagcggcaaagggatcggaaagacctccatcggcctcatttgtgtgatcgtgtctagcgggatgctgtggatggccgatgtccctctgcagtggattgcttccgccatcgttctcgagtttttcatgatggtgcttctgattcccgagccggaaaaacaacggacgcctcaggacaatcagctggcgtacgtggtcatcggaattctcaccctggccgctatcgtggccgctaacgagatgggccttctggaaacaaccaagagagatctcggcatgagcaaggagcccggggttgtgtctcccacatcctatctggacgtcgacctgcaccctgccagcgcgtggaccctctacgccgtggctacgacagtcatcaccccgatgcttcgccatacaattgaaaattctaccgccaacgtgagcctggctgccatcgctaaccaagccgttgtgctgatgggactcgataaaggctggcccatttccaagatggacctgggggcgcctcttctggccctcggatgctactctcaggtcaatcccctgaccctgacagctgccgtgctccttctggttacgcactatgctatcattggccctgggctgcaggccaaagccacccgggaggcgcagaagagaacagctgccggaatcatgaaaaaccccaccgtggatggcatcatgacaattgacctcgatcctgtcatctacgacagcaagtttgagaagcaactgggccaggtgatgcttctggtgctctgtgctgttcagctgctgctcatgcgcacctcctgggccctttgcgaagccctgacgctggctacagggccgattaccaccctctgggagggatctcccggcaaattctggaatacaaccatcgccgtcagcatggcgaacatttttcgggggtcctatctggccggagctggccttgccttcagcatcatgaagtctgtggggacaggaagacggggcacgggctcccagggggaaaccctgggagagaaatggaagaaaaagctcaatcaactgagccgcaaggaatttgatctgtacaaaaagtccggcatcacagaggtggacagaaccgaggctaaagaagggctcaagcggggagagacaacccatcacgccgtctctcgcggcagcgcgaaacttcagtggttcgttgaaagaaacatggtgattcctgaggggcgggtgatcgatctgggatgtggccgcggcgggtggtcctattactgcgccggactgaagaaagtcacggaagtgagaggctataccaaggggggacccggccatgaggagcctgttcccatgtctacatacgggtggaatattgtgaagctcatgagcggaaaagacgtcttctacctgccgcctgaaaagtgtgatacccttctgtgcgacatcggcgagtccagcccctctcccacagtggaagagtcccggaccattcgcgttctcaaaatggtggagccttggctgaagaacaatcagttttgtatcaaagtcctgaacccctatatgcctacagtgattgaacacctcgagagacttcagcggaagtacggcgggatgctggtgagaaatccgctgagccgcaactctacccacgaaatgtattggatctccaatggaacgggcaacatcgtcagctctgttaatatggtgagccggctcctgcttaacagattcacaatgacccatcgccggcccaccattgagaaggatgtggacctgggggctggaacaagacacgtcaacgccgaacctgagacgcccaatatggacgtgatcggcgagcgcattaaacggatcaaggaagagcattcctctacctggcactacgatgacgaaaacccttataaaacatgggcttaccacgggagctatgaggttaaggccaccggatccgctagctccatgattaatggcgtggtcaaactcctgacaaagccctgggatgtggttccgatggtgacccaaatggccatgacagacaccacgccttttggccagcagagagtcttcaaggaaaaagtggatacccgcacaccccggcctatgcccgggaccagaaaggttatggagatcacagcggagtggctgtggcgcaccctcggacggaacaaaaagcctagactgtgcacgcgcgaagagtttacaaaaaaggtgagaaccaatgccgctatgggcgccgtcttcacagaagagaaccaatgggactctgctcgggccgccgtggaagatgaggagttttggaagcttgtcgaccgcgaaagagagctgcataaactcgggaagtgtggaagctgcgtgtacaatatgatgggcaaacgggaaaagaaactgggggagttcggcaaggcgaaaggatccagagctatctggtacatgtggcttggcgcccggtatctggagtttgaagccctcgggttcctgaacgaggatcactggttttctcgcgaaaatagctactccggagttgagggcgaagggctgcataagctcggatatattctgagagacatctctaagattcccggcggggctatgtacgccgatgacaccgctggctgggacacgcggatcaccgaggatgaccttcacaacgaggaaaaaattacacagcagatggatccggagcatcgccagctggccaatgcgatcttcaagctcacctatcaaaacaaagtggtcaaggtgcagagacctacacccaaaggaaccgtgatggacatcattagccggaaggatcagcgcggctccgggcaggttggaacatacggcctgaatacctttacgaacatggaagcccaacttgtgagacagatggagggggaaggagtcctgagcaaggctgacctcgagaatccccacctgctggagaaaaagatcacacagtggctcgaaaccaaaggcgtggagcggctgaagcgcatggccatttctggggatgactgcgttgtgaaacctatcgatgacagattcgctaacgcccttctggcgctcaacgatatgggcaaggtccggaaggacattccgcagtggcaaccctccaaaggatggcacgattggcagcaggtgcctttctgtagccatcactttcatgaactgatcatgaaggacggccgcaaacttgtcgtgccctgcagacctcaggacgagctgatcgggcgggcccgcatttctcaaggagctggctggtccctcaaggaaaccgcctgtctggggaaagcttatgcccagatgtggagcctgatgtacttccacagacgggatctcagactggcttctaatgccatctgctccgcggttcccgtgcactggattcctatcagccgcacaacctggtccattcatgcccaccatcagtggatgacaacggaggacatgcttaccgtctggaaccgggtgtggatcgaggataatccctggatggaagacaagacaccggttaccacatgggaggatgtgccttacctgggaaagagagaagaccaatggtgtggcagcctcattgggctgacctctcgcgctacgtgggcccagaacatccttaccgccatccagcaggtccggagcctgattggcgatgaggagtttctcgactatatgccctccatgaaaagattccgcaaggaagaggaatctgagggagctatctggtga

SEQ ID NO: 20843 - RNA, 9873 nt, synthetic construct
  misc_feature 1..9873: note = derived and/or modified CDS sequence (opt5) from DENV-3__EU660411__SS-prME
  source 1..9873: mol_type = other RNA
accagcctgtgcctcatgatgatgctgcccgccacacttgctttccacctgacgtccagagacggcgagcctcggatgatcgtggggaagaacgaacgcggaaaatctctcctgtttaagaccgccagcggcattaatatgtgtacacttatcgcgatggatctgggggagatgtgcgacgataccgtcacatacaaatgtccgctcattgctgaagttgagcccgaagacatcgattgctggtgtaacctgacctccacatgggtgacctatggaacgtgcaatcaggccggcgagcatagacgggacaagcgctctgtggccctggctcctcacgtcgggatgggactcgataccagaacacaaacctggatgagcgccgagggcgcttggcggcaggtggaaaaagttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagaataaacccacgctcgacatcgagctgcagaagaccgaagctacacaacttgccaccctgcgcaaactctgtattgagggaaagatcacaaacattaccacggattccagatgccctacacagggcgaagcgatcctgccggaggaacaggaccagaattatgtgtgtaaacacacctacgtggatcggggctgggggaacggatgcggccttttcgggaagggaagcctggtcacctgcgccaagtttcaatgtctcgagcccattgagggcaaagtggttcagtatgaaaatctgaagtacacagtgatcatcaccgtccacacaggggaccagcatcaggtgggaaacgacacgcaaggcgttaccgtggagattacacctcaggcttctaccgtcgaagccgtgctgcccgagtatggcacactcgggctggaatgctcccctcgcaccggacttgatttcaatgagatgatcctgctcacgatgaaaaacaaggcttggatggtccacagacagtggtttttcgacctgccccttccgtggaccagcggcgccacaaccgagacacctacctggaatcggaaagaactgctcgtgacgtttaagaacgcccatgctaaaaagcaagaggttgtggtcctggggtctcaggaaggagcgatgcacacagccctgaccggcgctacagagattcagaattccgggggcaccagcatcttcgccggacacctcaagtgtcgcctgaaaatggataagcttgaactgaaaggcatgtcttacgccatgtgcctcaacacctttgtgctgaagaaagaggtttccgagacacagcatgggacgattctgatcaaggtggaatacaagggagaggacgctccctgtaaaatccctttcagcaccgaagatggccaagggaaggcccacaacggaagacttattacagcgaatcccgtcgtgaccaaaaaggaggagcccgtgaacatcgaagctgagcctccgttcggcgaatccaatattgttatcgggattggcgacaaagccctcaagatcaactggtataagaaaggatctagcatcggcaagatgtttgaggccacagctcggggggccagacgcatggctattctgggagataccgcctgggacttcggctccgtcgggggagtgctgaatagcctcggcaaaatggtgcatcagatctttgggtctgcgtacacggccctgttctccggcgtcagctggattatgaagatcggaattggcgtgcttctgacatggatcgggctcaactctaaaaataccagcatgtccttttcttgcattgttatcggaatcattaccctgtatctgggcgctgtggtccaggccgatatggggtgtgtgatcaactggaagggaaaggaacttaaatgcggcagcgggattttcgttacaaatgaggtgcacacctggacagagcagtacaagtttcaagctgactcccccaaacggctcgccacggcgatcgccggcgcttgggaaaacggagtctgtggcattagaagcaccacacgcatggagaatctgctgtggaagcagatcgccaacgaactcaattatatcctgtgggagaacaatattaaacttaccgtggttgtgggggatatcattggagtcctggaacagggcaagcggacactcacccctcagcccatggagctgaaatactcttggaagacgtgggggaaggctaaaatcgtgaccgccgagacacaaaactccagcttcattatcgacggacctaacacccccgaatgcccgtctgcctccagagcttggaatgtgtgggaggtcgaagactatggctttggcgttttcacaaccaacatctggctgaagcttcgcgaggtgtacacacagagctgtgatcatcggctcatgtccgcggccattaaagacgaaagagctgtgcacgccgatatggggtactggatcgagtctcagaagaatggaagctggaaactggagaaggcctcctttattgaagtcaagacctgcacgtggcctaaatctcacacactgtggagcaacggcgtgctcgagtccgacatgatcattcccaagagcctggctgggcctatctctcagcataatcaccgccccggatatcatacccaaaccgccggcccttggcaccttgggaaactggaactcgatttcaactactgcgagggaacaaccgttgtgatcacggagaattgtggcacacggggcccctccctgagaaccacaaccgtcagcgggaagctgattcacgaatggtgctgtcgctcttgcacacttccgcctctccggtatatgggagaggacggctgttggtacgggatggaaatcagacccattaacgagaaagaagagaatatggtgaagtccctggttagcgcgggatctggcaaggtggataactttaccatgggggtcctgtgcctcgctatcctgttcgaggaagtgatgcggggaaaattcggcaagaaacatatgattgccggcgttctttttacgttcgtgctgctcctgagcgggcagatcacctggcgcgacatggcccacacactgattatgatcggatccaatgctagcgatagaatgggcatgggggtcacctatcttgccctgatcgcgacatttaagattcagcccttcctcgctctgggatttttcctccggaaactgacctctagagagaaccttctgctcggcgtggggctggccatggccacgacactgcaacttcctgaagacatcgagcagatggctaatggaattgccctgggcctcatgaccctgaagctcatcacacagtttgaaacctaccagctgtggaccgctcttgtgtccctgacatgtagcaacacgattttcaccctcacagtcgcctggcgcaccgcgacactgatcctggccggcgtttcccttctgccgctctgccaatctagctccatgcggaagaccgattggctgcccatgacggtggctgccatgggggtgcctcccctccctctgtttatcttctctcttaaagacacacccaagagacgcagctggcctctgaatgagggagtcatggctgtgggcctggtttccattctcgcctctagcctgcttagaaacgatgtgcccatggccgggccgctggtcgctggaggcctcctgatcgcgtgttatgtgattaccgggacctccgccgacctcacagttgagaaagctgccgacgtgacctgggaagaggaagccgagcagacaggagtcagccataacctgatgatcacggtggatgacgatggcaccatgcggattaaggacgatgaaacagagaatatccttaccgtcctgctgaaaacagctctcctgatcgtgtctggcatttttccttactccatccccgccacccttctggtttggcacacgtggcagaagcagacccaacgcagcggggtgctctgggacgtcccttctcccccggagacacagaaagcggaactggaggaaggagtgtacagaattaagcagcagggcatcttcgggaagacccaagttggagtgggcgtccagaaagagggggtgtttcatacaatgtggcacgtgacccggggagctgttctcacacacaacggcaagcgcctggagcctaattgggcctccgtcaaaaaggatcttattagctatggcgggggatggagactgtctgcccagtggcaaaaaggcgaagaggtgcaggtgatcgctgtcgaacccgggaagaaccctaagaatttccagacgatgcccggaattttccagaccacaaccggcgagatcggggccatcgcgctggactttaaacccggaacctccggcagccctattatcaaccgggaaggcaagattgtggggctctacggaaatggcgttgtgacaaaaaacgggggatatgtctccggcatcgctcaaacgaatgccgagccggatgggcccacccctgagctggaagaggaaatgttcaagaaacgcaaccttacaattatggacctgcatcccggcagcggaaagaccagaaagtacctccctgccatcgtgcgggaggctatcaaacgcagactgcggacactcattctggcccccaccagagttgtggctgccgaaatggaggaggcgcttaagggcctgcctatccgctatcagacgacagccattaaatctgaacacaccgggcgggagatcgtcgatctgatgtgccatgctacctttacaatgagactcctgagcccggtgcgcgttcccaattacaaccttattatcatggacgaagcccacttcaccgatcctgcttccatcgccgcccggggatatatttctacaagagtgggcatgggggaggctgcggccatctttatgaccgctacgccccctggaacagccgaagccttcccccagagcaatgctccgattcaggacgaggagcgcgacatccctgaacggtcctggaactctggcaatgagtggattaccgattttgtcgggaagacagtgtggttcgtgcccagcatcaaagccggcaacgacattgcgaactgtctgagaaagaatggaaagaaagtcatccaactctcccgcaagacctttgatacggaataccagaaaacccggctgaacgactgggatttcgttgtgacaaccgacatctctgagatgggcgctaattttaaggccgatagagtgattgacccccggcgctgcctgaaacctgtcatcctcacagatgggcccgagagagtgattcttgccggacctatgccggttaccgctgccagcgcggcccagcggcgcggcagagtggggcggaacccccagaaggaaaatgaccaatacatcttcacaggacagcctctgaacaatgatgaggaccatgctcactggaccgaagccaagatgctgctcgacaacattaatacgcccgagggcatcatccctgctctgttcgaacccgagagagagaaatccgccgctattgatggggaatatcgccttaagggcgagagccggaaaacatttgtcgaactgatgagacgcggagacctcccggtgtggctggcccacaaggttgcgtctgagggcatcaaatacaccgatcggaagtggtgcttcgacggggaaagaaacaatcagattctggaggagaacatggatgtggaaatctggaccaaagagggagaacgcaagaagctccggcctagatggcttgacgcccgcacatattccgatcccctggctctgaaagagtttaaggacttcgccgctggcagaaaaagcattgccctcgatctggtcaccgaaatcgggcgggtgccttctcatcttgcctaccgcacaagaaatgctctggacaacctcgtcatgctgcacacgtccgagcatggaggccgggcgtatcgccacgccgtggaggaactgcccgagaccatggaaacactccttctgctgggcctcatgatcctgcttaccgggggagctatgctgtttctcattagcggcaaggggatcggaaaaacatccattggcctgatctgtgttattgtgtctagcgggatgctgtggatggccgatgtgcctctccagtggatcgcctccgctattgtccttgagttctttatgatggttctgctgatccccgagccggaaaagcaaagaacccctcaggacaatcagctcgcctacgtggtgatcggaattctgacgcttgcggccatcgtcgctgccaacgagatgggcctgctcgaaaccacaaagcgggatctgggcatgagcaaagagcccggggtggtttctcccacctcctatctggacgtggacctccaccctgctagcgcctggacactttacgcggtcgccaccacggtgattacaccgatgctgagacataccatcgaaaattctacagctaacgtcagcctggccgctattgccaaccaagctgtggttctcatgggactggataagggctggcccatctccaaaatggaccttggggtgcctctgctcgccctgggatgctactctcaggtcaatcccctgaccctcaccgcggccgtgcttctgctggttacacactatgctatcattggccctgggctccaggccaaggctacgcgcgaggcccagaaacggaccgccgcgggaatcatgaagaaccccacagtggatggcattatgaccatcgacctggatcctgtcatttacgacagcaagttcgagaaacaacttggccaggtgatgctgctcgtgctgtgtgctgttcagctgctccttatgagaacatcctgggccctgtgcgaagctctgaccctcgccacggggccgatcacaaccctgtgggagggatctcccggcaagttttggaataccacaatcgccgtcagcatggctaacattttccgcgggtcctatcttgccggagcgggcctggcctttagcatcatgaaatctgtggggaccggacggagaggcacaggctcccagggggaaacgctcggagagaagtggaaaaagaagctgaatcaactgagccggaaagaattcgatctctacaagaaatccggcattaccgaggtggaccgcacagaggctaaggaagggcttaaaagaggagagaccacacatcacgccgtctctcggggcagcgctaagctgcagtggtttgttgaacgcaacatggtgatccctgaggggagagtgattgatctgggatgtggccggggcgggtggtcctattactgcgccggactcaaaaaggtcaccgaagtgcgcggctatacgaaggggggacccggccatgaggagcctgttcccatgtctacctacgggtggaatatcgtgaaactgatgagcggaaaggacgtcttctaccttccgcctgaaaaatgtgatacactgctctgcgacattggcgagtccagcccctctcccaccgtggaagagtccagaacaatccgggttctgaagatggtggagccttggctgaaaaacaatcagttctgtatcaaggtcctcaacccctatatgcctaccgtgattgaacaccttgagcgcctgcagagaaagtacggcgggatgctggtgcggaatccgctcagcagaaactctacacacgaaatgtattggatctccaatggaaccggcaacattgtcagctctgttaatatggtgagccgcctgcttctgaaccggtttacgatgacacatagacgccccaccatcgagaaagatgtggacctcggggcgggaacccggcacgtcaacgccgaacctgagacacccaatatggacgtgattggcgagagaatcaagcgcatcaaagaagagcattcctctacgtggcactacgatgacgaaaacccttataagacctgggcttaccacgggagctatgaggttaaagccacaggatccgctagctccatgattaatggcgtggtcaagctgctgaccaagccctgggatgtggttccgatggtgacacaaatggccatgaccgacacaacccctttcggccagcagcgggtctttaaagaaaaggtggatacgagaaccccccgccctatgcccgggacacggaaagttatggagatcaccgctgagtggctctggagaacactgggacgcaacaagaaacctcggctttgcaccagagaagagttcacgaagaaggtgcgcacaaatgccgcgatgggcgccgtctttaccgaagagaaccaatgggactctgctagagccgctgtggaagatgaggagttctggaaactggtcgaccgggaacgcgagctccataagctggggaaatgtggaagctgcgtgtacaatatgatgggcaagagagaaaaaaagcttggggagtttggcaaagccaagggatcccgggccatttggtacatgtggctgggcgcgagatatctcgagttcgaagctctggggtttctgaacgaggatcactggttctctcgggaaaatagctactccggagttgagggcgaagggctccataagctgggatatatccttcgcgacatttctaaaatccccggcggggccatgtacgccgatgacacagctggctgggacaccagaatcacggaggatgacctgcacaacgaggaaaagattacccagcagatggatccggagcatcggcagctcgccaatgctatctttaaactgacatatcaaaacaaggtggtcaaagtgcagcgccctacccccaagggaacagtgatggacattatcagcagaaaggatcagcggggctccgggcaggttggaacctacggccttaatacattcaccaacatggaagcccaactggtgcgccagatggagggggaaggagtcctcagcaaagcggacctggagaatccccacctgctcgagaagaaaattacgcagtggctggaaacaaagggcgtggagagacttaaacggatggccatctctggggatgactgcgttgtgaagcctatcgatgaccgctttgctaacgccctgctcgctctgaacgatatgggcaaggtcagaaaagacattccgcagtggcaaccctccaagggatggcacgattggcagcaggtgcctttctgtagccatcacttccatgaacttatcatgaaagacggccggaagctggtcgtgccctgccgccctcaggacgagctcattgggagagcccggatctctcaaggagcgggctggtccctgaaagaaaccgcctgtctggggaaggcttatgcccagatgtggagcctcatgtactttcaccgcagagatctgcggcttgcttctaatgccatttgctccgctgttcccgtgcactggatccctaccagcagaacaacctggtccattcatgcccaccatcagtggatgacaacggaggacatgctgaccgtctggaaccgcgtgtggatcgaggataatccctggatggaagacaagacaccggttaccacatgggaggatgtgccttacctcggaaaacgggaagaccaatggtgtggcagcctgatcgggcttacctctagagcgacgtgggcccagaacattctgaccgctatccagcaggtccgcagcctcattggcgatgaggagttcctggactatatgccctccatgaagcggtttagaaaagaagaggaatctgagggagccatctggtga

SEQ ID NO: 20844 - RNA, 9873 nt, synthetic construct
  misc_feature 1..9873: note = derived and/or modified CDS sequence (opt5) from DENV-3__FJ432722__SS-prME
  source 1..9873: mol_type = other RNA
accagcctgtgcctcatgatgatgctgcccgccacacttgctttccacctgacgtccagagacggcgagcctcggatgatcgtggggaagaacgaacgcggaaaatctctcctgtttaagaccgccagcggcattaatatgtgtacacttatcgcgatggatctgggggagatgtgcgacgataccgtcacatacaaatgtccgctcattgctgaagttgagcccgaagacatcgattgctggtgtaacctgacctccacatgggtgacctatggaacgtgcaatcaggccggcgagcatagacgggacaagcgctctgtggccctggctcctcacgtcgggatgggactcgataccagaacacaaacctggatgagcgccgagggcgcttggcggcaggtggaaaaagttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagaataaacccacgctcgacatcgagctgcagaagaccgaagctacacaacttgccaccctgcgcaaactctgtattgagggaaagatcacaaacattaccacggattccagatgccctacacagggcgaagcgatcctgccggaggaacaggaccagaattatgtgtgtaaacacacctacgtggatcggggctgggggaacggatgcggccttttcgggaagggaagcctggtcacctgcgccaagtttcaatgtctcgagcccattgagggcaaagtggttcagtatgaaaatctgaagtacacagtgatcatcaccgtccacacaggggaccagcatcaggtgggaaacgacacgcaaggcgttaccgtggagattacacctcaggcttctaccgtcgaagccgtgctgcccgagtatggcacactcgggctggaatgctcccctcgcaccggacttgatttcaatgagatgatcctgctcacgatgaaaaacaaggcttggatggtccacagacagtggtttttcgacctgccccttccgtggaccagcggcgccacaaccgagacacctacctggaatcggaaagaactgctcgtgacgtttaagaacgcccatgctaaaaagcaagaggttgtggtcctggggtctcaggaaggagcgatgcacacagccctgaccggcgctacagagattcagaattccgggggcaccagcatcttcgccggacacctcaagtgtcgcctgaaaatggataagcttgaactgaaaggcatgtcttacgccatgtgcctcaacacctttgtgctgaagaaagaggtttccgagacacagcatgggacgattctgatcaaggtggaatacaagggagaggacgctccctgtaaaatccctttcagcaccgaagatggccaagggaaggcccacaacggaagacttattacagcgaatcccgtcgtgaccaaaaaggaggagcccgtgaacatcgaagctgagcctccgttcggcgaatccaatattgttatcgggattggcgacaaagccctcaagatcaactggtataagaaaggatctagcatcggcaagatgtttgaggccacagctcggggggccagacgcatggctattctgggagataccgcctgggacttcggctccgtcgggggagtgctgaatagcctcggcaaaatggtgcatcagatctttgggtctgcgtacacggccctgttctccggcgtcagctggattatgaagatcggaattggcgtgcttctgacatggatcgggctcaactctaaaaataccagcatgtccttttcttgcattgttatcggaatcattaccctgtatctgggcgctgtggtccaggccgatatggggtgtgtgatcaactggaagggaaaggaacttaaatgcggcagcgggattttcgttacaaatgaggtgcacacctggacagagcagtacaagtttcaagctgactcccccaaacggctcgccacggcgatcgccggcgcttgggaaaacggagtctgtggcattagaagcaccacacgcatggagaatctgctgtggaagcagatcgccaacgaactcaattatatcctgtgggagaacaatattaaacttaccgtggttgtgggggatatcattggagtcctggaacagggcaagcggacactcacccctcagcccatggagctgaaatactcttggaagacgtgggggaaggctaaaatcgtgaccgccgagacacaaaactccagcttcattatcgacggacctaacacccccgaatgcccgtctgcctccagagcttggaatgtgtgggaggtcgaagactatggctttggcgttttcacaaccaacatctggctgaagcttcgcgaggtgtacacacagagctgtgatcatcggctcatgtccgcggccattaaagacgaaagagctgtgcacgccgatatggggtactggatcgagtctcagaagaatggaagctggaaactggagaaggcctcctttattgaagtcaagacctgcacgtggcctaaatctcacacactgtggagcaacggcgtgctcgagtccgacatgatcattcccaagagcctggctgggcctatctctcagcataatcaccgccccggatatcatacccaaaccgccggcccttggcaccttgggaaactggaactcgatttcaactactgcgagggaacaaccgttgtgatcacggagaattgtggcacacggggcccctccctgagaaccacaaccgtcagcgggaagctgattcacgaatggtgctgtcgctcttgcacacttccgcctctccggtatatgggagaggacggctgttggtacgggatggaaatcagacccattaacgagaaagaagagaatatggtgaagtccctggttagcgcgggatctggcaaggtggataactttaccatgggggtcctgtgcctcgctatcctgttcgaggaagtgatgcggggaaaattcggcaagaaacatatgattgccggcgttctttttacgttcgtgctgctcctgagcgggcagatcacctggcgcgacatggcccacacactgattatgatcggatccaatgctagcgatagaatgggcatgggggtcacctatcttgccctgatcgcgacatttaagattcagcccttcctcgctctgggatttttcctccggaaactgacctctagagagaaccttctgctcggcgtggggctggccatggccacgacactgcaacttcctgaagacatcgagcagatggctaatggaattgccctgggcctcatgaccctgaagctcatcacacagtttgaaacctaccagctgtggaccgctcttgtgtccctgacatgtagcaacacgattttcaccctcacagtcgcctggcgcaccgcgacactgatcctggccggcgtttcccttctgccgctctgccaatctagctccatgcggaagaccgattggctgcccatgacggtggctgccatgggggtgcctcccctccctctgtttatcttctctcttaaagacacacccaagagacgcagctggcctctgaatgagggagtcatggctgtgggcctggtttccattctcgcctctagcctgcttagaaacgatgtgcccatggccgggccgctggtcgctggaggcctcctgatcgcgtgttatgtgattaccgggacctccgccgacctcacagttgagaaagctgccgacgtgacctgggaagaggaagccgagcagacaggagtcagccataacctgatgatcacggtggatgacgatggcaccatgcggattaaggacgatgaaacagagaatatccttaccgtcctgctgaaaacagctctcctgatcgtgtctggcatttttccttactccatccccgccacccttctggtttggcacacgtggcagaagcagacccaacgcagcggggtgctctgggacgtcccttctcccccggagacacagaaagcggaactggaggaaggagtgtacagaattaagcagcagggcatcttcgggaagacccaagttggagtgggcgtccagaaagagggggtgtttcatacaatgtggcacgtgacccggggagctgttctcacacacaacggcaagcgcctggagcctaattgggcctccgtcaaaaaggatcttattagctatggcgggggatggagactgtctgcccagtggcaaaaaggcgaagaggtgcaggtgatcgctgtcgaacccgggaagaaccctaagaatttccagacgatgcccggaattttccagaccacaaccggcgagatcggggccatcgcgctggactttaaacccggaacctccggcagccctattatcaaccgggaaggcaaggtggttgggctctacggaaatggcgtggtcacaaaaaacgggggatatgtgtccggcattgctcaaacgaatgccgagccggatgggcccacccctgagctggaagaggaaatgttcaagaaacgcaaccttacaatcatggacctgcatcccggcagcggaaagaccagaaagtacctccctgccattgttcgggaggctatcaaacgcagactgcggacactcatcctggcccccaccagagtggtcgctgccgaaatggaggaggcgcttaagggcctgcctattcgctatcagacgacagccaccaaatctgaacacaccgggcgggagatcgtggatctgatgtgccatgctacatttaccatgagactcctgagcccggttcgcgtgcccaattacaaccttattatcatggacgaagcccacttcacagatcctgcttccattgccgcccggggatatatctctaccagagtcggcatgggggaggctgcggccatctttatgacggctacaccccctggaaccgccgaagccttcccccagagcaatgctccgattcaggacgaggagcgcgacatccctgaacggtcctggaactctggcaatgagtggattacagattttgtggggaagaccgtgtggttcgtccccagcatcaaagccggcaacgacattgcgaactgtctgagaaagaatggaaagaaagttatccaactctcccgcaagacgtttgataccgaataccagaaaacaaagctgaacgactgggatttcgtggtgaccacagacatttctgagatgggcgctaattttaaagccgatcgggtcatcgaccccagacggtgcctgaagcctgtgatcctcaccgatgggcccgagcgcgttattcttgccggacctatgccggtgacagctgccagcgcggcccagagacggggccgcgtcgggagaaacccccagaaggaaaatgaccaatacatcttcaccggacagcctctgaacaatgatgaggaccatgctcactggacggaagccaaaatgctgctcgacaacattaatacacccgagggcatcattcctgctctgttcgaacccgagcgggagaagtccgccgctatcgatggggaatatagacttaaaggcgagagccgcaagacctttgtggaactgatgcggagaggagacctcccggtttggctggcccacaaagtggcgtctgagggcatcaagtacaccgatcgcaaatggtgcttcgacggggaacggaacaatcagattctggaggagaacatggatgtcgaaatctggacaaaggagggagaaagaaagaaactccgccctcggtggcttgacgccagaacctattccgatcccctggctctgaaggagtttaaagacttcgccgctggccgcaagagcattgccctcgatctggtgacagaaatcgggagagtcccttctcatcttgcctaccggacgcgcaatgctctggacaacctcgtgatgctgcacacctccgagcatggaggcagagcgtatcggcacgccgttgaggaactgcccgagacaatggaaaccctccttctgctgggcctcatgattctgcttacagggggagctatgctgtttctcatcagcggcaaagggatcggaaagacctccattggcctgatctgtgtgattgtgtctagcgggatgctgtggatggccgatgtccctctccagtggatcgcctccgctattgttcttgagttctttatgatggtgctgctgatccccgagccggaaaagcaacgcacgcctcaggacaatcagctcgcctacgtggtcattggaatcctgacccttgcggccatcgtggctgccaacgagatgggcctgctcgaaacaaccaaaagagatctgggcatgagcaaggagcccggggttgtgtctcccacatcctatctggacgtcgacctccaccctgctagcgcctggaccctttacgcggtggccacgacagtcattaccccgatgctgcggcatacaatcgaaaattctaccgctaacgtgagcctggccgctattgccaaccaagctgttgtgctcatgggactggataaaggctggcccatctccaagatggaccttggggtccctctgctcgccctgggatgctactctcaggtgaatcccctgaccctcacagcggccgttcttctgctggtgacgcactatgctattatcggccctgggctccaggccaaagctaccagagaggcccagaagcgcacagccgcgggaatcatgaagaaccccaccgtcgatggcattatgacaatcgacctggatcctgtgatttacgacagcaaattcgagaagcaacttggccaggtgatgctgctcgttctgtgtgctgtccagctgctccttatgcggacctcctgggccctgtgcgaagctctgacgctcgccacagggccgatcaccaccctgtgggagggatctcccggcaaattttggaatacaaccattgccgtgagcatggctaacatcttcagagggtcctatcttgccggagcgggcctggcctttagcatcatgaagtctgtggggacaggacgccggggcacgggctcccagggggaaaccctcggagagaaatggaagaagaaactgaatcaactgagcagaaaggaattcgatctctacaaaaagtccggcattacagaggtcgaccggaccgaggctaaagaagggcttaagcgcggagagacaacccatcacgccgtttctagaggcagcgctaaactgcagtggtttgtggaacggaacatggtgatccctgaggggcgcgtcattgatctgggatgtggcagaggcgggtggtcctattactgcgccggactcaagaaggtgacggaagttcggggctataccaaagggggacccggccatgaggagcctgtgcccatgtctacatacgggtggaatatcgtcaagctgatgagcggaaaagacgtgttctaccttccgcctgaaaagtgtgataccctgctctgcgacattggcgagtccagcccctctcccacagttgaagagtcccgcaccatcagagtgctgaaaatggtcgagccttggctgaagaacaatcagttctgtattaaggtgctcaacccctatatgcctacagtgatcgaacaccttgagcggctgcagcgcaaatacggcgggatgctggtcagaaatccgctcagccggaactctacccacgaaatgtattggatctccaatggaacgggcaacattgttagctctgtgaatatggtgagcagactgcttctgaaccgctttacaatgacccatcggagacccaccatcgagaaggatgtcgacctcggggcgggaacacgccacgtgaacgccgaacctgagacgcccaatatggacgttattggcgagcggatcaaaagaattaaggaagagcattcctctacctggcactacgatgacgaaaacccttataaaacatgggcttaccacgggagctatgaggtgaaggccaccggatccgctagctccatgatcaatggcgtcgtgaagctgctgacaaaaccctgggatgttgtgccgatggtcacccaaatggccatgacagacaccacgcctttcggccagcagcgcgtgtttaaggaaaaagttgatacccggacacccagacctatgcccgggacccgcaaggtgatggagatcacagctgagtggctctggcggaccctgggaagaaacaaaaagcctcgcctttgcacgcgggaagagttcacaaagaaagtcagaaccaatgccgcgatgggcgccgtgtttacagaagagaaccaatgggactctgctcgcgccgctgtcgaagatgaggagttctggaagctggtggacagagaacgggagctccataaactggggaagtgtggaagctgcgtttacaatatgatgggcaaacgcgaaaagaaacttggggagtttggcaaggccaagggatccagagccatttggtacatgtggctgggcgcgcggtatctcgagttcgaagctctggggtttctgaacgaggatcactggttctctagagaaaatagctactccggagtggagggcgaagggctccataaactgggatatatccttcgggacatttctaagatccccggcggggccatgtacgccgatgacaccgctggctgggacacgcgcattaccgaggatgacctgcacaacgaggaaaaaatcacacagcagatggatccggagcatagacagctcgccaatgctatctttaagctgacctatcaaaacaaagtcgtgaaggtgcagcggcctacacccaagggaaccgttatggacattatcagccgcaaagatcagagaggctccgggcaggtgggaacatacggccttaataccttcacgaacatggaagcccaactggtccggcagatggagggggaaggagtgctcagcaaggcggacctggagaatccccacctgctcgagaaaaagattacacagtggctggaaaccaaaggcgttgagcgccttaagagaatggccatctctggggatgactgcgtggtcaagcctattgatgaccggtttgctaacgccctgctcgctctgaacgatatgggcaaagtgcgcaaggacatcccgcagtggcaaccctccaaaggatggcacgattggcagcaggtccctttctgtagccatcacttccatgaacttatcatgaaggacggcagaaaactggtggttccctgccggcctcaggacgagctcattgggcgcgccagaatctctcaaggagcgggctggtccctgaaggaaaccgcctgtctggggaaggcttatgcccagatgtggagcctcatgtactttcaccggcgcgatctgagacttgcttctaatgccatttgctccgctgtgcccgtccactggatccctacaagccggaccacatggtccattcatgcccaccatcagtggatgacgaccgaggacatgctgacagtgtggaacagagtttggatcgaggataatccctggatggaagacaaaaccccggtgacaacctgggaggatgtcccttacctcggaaagcgcgaagaccaatggtgtggcagcctgattgggcttacgtctcgggcgacctgggcccagaacatcctgacagctatccagcaggtgagaagcctcattggcgatgaggagttcctggactatatgccctccatgaaacgctttcggaaggaagaggaatctgagggagtgatctggtga

SEQ ID NO: 20845 - RNA, 9873 nt, synthetic construct
  misc_feature 1..9873: note = derived and/or modified CDS sequence (opt5) from DENV-3__FJ432728__SS-prME
  source 1..9873: mol_type = other RNA
accagcctgtgcctcatgatgatgctgcccgccacacttgctttccacctgacgtccagagacggcgagcctcggatgatcgtggggaagaacgaacgcggaaaatctctcctgtttaagaccgccagcggcattaatatgtgtacacttatcgcgatggatctgggggagatgtgcgacgataccgtcacatacaaatgtccgctcattgctgaagttgagcccgaagacatcgattgctggtgtaacctgacctccacatgggtgacctatggaacgtgcaatcaggccggcgagcatagacgggacaagcgctctgtggccctggctcctcacgtcgggatgggactcgataccagaacacaaacctggatgagcgccgagggcgcttggcggcaggtggaaaaagttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagaataaacccacgctcgacatcgagctgcagaagaccgaagctacacaacttgccaccctgcgcaaactctgtattgagggaaagatcacaaacattaccacggattccagatgccctacacagggcgaagcgatcctgccggaggaacaggaccagaattatgtgtgtaaacacacctacgtggatcggggctgggggaacggatgcggccttttcgggaagggaagcctggtcacctgcgccaagtttcaatgtctcgagcccattgagggcaaagtggttcagtatgaaaatctgaagtacacagtgatcatcaccgtccacacaggggaccagcatcaggtgggaaacgacacgcaaggcgttaccgtggagattacacctcaggcttctaccgtcgaagccgtgctgcccgagtatggcacactcgggctggaatgctcccctcgcaccggacttgatttcaatgagatgatcctgctcacgatgaaaaacaaggcttggatggtccacagacagtggtttttcgacctgccccttccgtggaccagcggcgccacaaccgagacacctacctggaatcggaaagaactgctcgtgacgtttaagaacgcccatgctaaaaagcaagaggttgtggtcctggggtctcaggaaggagcgatgcacacagccctgaccggcgctacagagattcagaattccgggggcaccagcatcttcgccggacacctcaagtgtcgcctgaaaatggataagcttgaactgaaaggcatgtcttacgccatgtgcctcaacacctttgtgctgaagaaagaggtttccgagacacagcatgggacgattctgatcaaggtggaatacaagggagaggacgctccctgtaaaatccctttcagcaccgaagatggccaagggaaggcccacaacggaagacttattacagcgaatcccgtcgtgaccaaaaaggaggagcccgtgaacatcgaagctgagcctccgttcggcgaatccaatattgttatcgggattggcgacaaagccctcaagatcaactggtataagaaaggatctagcatcggcaagatgtttgaggccacagctcggggggccagacgcatggctattctgggagataccgcctgggacttcggctccgtcgggggagtgctgaatagcctcggcaaaatggtgcatcagatctttgggtctgcgtacacggccctgttctccggcgtcagctggattatgaagatcggaattggcgtgcttctgacatggatcgggctcaactctaaaaataccagcatgtccttttcttgcattgttatcggaatcattaccctgtatctgggcgctgtggtccaggccgatatggggtgtgctatcaactggaagggaaaggaacttaaatgcggcagcgggattttcgtgacaaatgaggttcacacctggacagagcagtacaagtttcaagccgactcccccaaacggctcgcgacggccatcgctggcgcctgggaaaacggagtgtgtggcattagaagcaccacacgcatggagaatctgctgtggaagcagatcgctaacgaactcaattatatcctgtgggagaacaatattaaacttaccgtcgtggttggggatatcattggagtgctggaacagggcaagcggacactcacccctcagcccatggagctgaaatactcttggaagacgtgggggaaggccaaaatcgtcaccgccgagacacaaaactccagcttcattatcgacggacctaacacccccgaatgcccgtctgcttccagagcgtggaatgtgtgggaggtggaagactatggctttggcgtcttcacaaccaacatctggctgaagcttcgcgaggtttacacacagagctgtgatcatcggctcatgtccgccgctattaaagacgaaagagccgtgcacgccgatatggggtactggatcgagtctcagaagaatggaagctggaaactggagaaggcttcctttattgaagtgaagacctgcacgtggcctaaatctcacacactgtggagcaacggcgtcctcgagtccgacatgatcattcccaagagcctggccgggcctatctctcagcataatcaccgccccggatatcatacccaaaccgcgggcccttggcaccttgggaaactggaactcgatttcaactactgcgagggaacaaccgtggttatcacggaggactgtggcacacggggcccctccctgagaaccacaaccgtgagcgggaagctgattcacgaatggtgctgtcgctcttgcacacttccgcctctccggtatatgggagaggatggctgttggtacgggatggaaatcagacccattaatgagaaagaagagaacatggtcaagtccctggtgagcgctggatctggcaaggttgacaattttaccatgggggtgctgtgcctcgccatcctgttcgaggaagtcatgcggggaaaattcggcaagaaacatatgattgccggcgtgctttttacgttcgttctgctcctgagcgggcagatcacctggcgcgatatggctcacacactgattatgatcggatccaacgccagcgacagaatgggcatgggggtgacctatcttgcgctgatcgctacatttaagattcagcccttcctcgccctgggatttttcctccggaaactgacctctagagagaatcttctgctcggcgtcgggctggccatggctacgacactgcaacttcctgaagatatcgagcagatggccaacggaattgctctgggcctcatgaccctgaagctcatcacacagtttgaaacctaccagctgtggaccgcccttgtgtccctgacatgtagcaatacgattttcaccctcacagtggcgtggcgcaccgccacactgatcctggctggcgtctcccttctgccgctctgccaatctagctccatgcggaagaccgactggctgcccatgacggttgccgctatgggggtgcctcccctccctctgtttatcttctctcttaaagatacacccaagagacgcagctggcctctgaacgagggagtgatggccgtcggcctggtgtccattctcgcctctagcctgcttagaaatgacgttcccatggctgggccgctggtggcgggaggcctcctgatcgcctgttatgtcattaccgggacctccgctgacctcacagtggagaaagccgccgatgttacctgggaagaggaagctgagcagacaggagtgagccataacctgatgatcacggtcgacgatgacggcaccatgcggattaaggatgacgaaacagagaacatccttaccgtgctgctgaaaacagccctcctgatcgtctctggcatttttccttactccatccccgcgacccttctggtgtggcacacgtggcagaagcagacccaacgcagcggggttctctgggatgtgccttctcccccggagacacagaaagctgaactggaggaaggagtctacagaattaagcagcagggcatcttcgggaagacccaagtgggagttggcgtgcagaaagagggggtctttcatacaatgtggcacgtgacccggggagccgtgctcacacacaatggcaagcgcctggagcctaactgggcctccgttaaaaaggaccttattagctatggcgggggatggagactgtctgctcagtggcaaaaaggcgaagaggtccaggtgatcgccgtggaacccgggaagaatcctaagaacttccagacgatgcccggaattttccagaccacaaccggcgagatcggggcgatcgctctggattttaaacccggaacctccggcagccctattatcaatcgggaaggcaaggtcgtggggctctacggaaacggcgttgtgacaaaaaatgggggatatgtctccggcattgcccaaacgaacgccgagccggacgggcccacccctgagctggaagaggaaatgttcaagaaacgcaatcttacaatcatggatctgcatcccggcagcggaaagaccagaaagtacctccctgctattgtgcgggaggccatcaaacgcagactgcggacactcatcctggctcccaccagagttgtggccgcggaaatggaggaggcccttaagggcctgcctattcgctatcagacgacagctaccaaatctgaacacaccgggcgggagatcgtcgacctgatgtgccatgccacatttaccatgagactcctgagcccggtgcgcgttcccaactacaatcttattatcatggatgaagctcacttcacagaccctgcctccattgccgctcggggatatatctctaccagagtgggcatgggggaggcggccgctatctttatgacggccacaccccctggaaccgccgaagctttcccccagagcaacgccccgattcaggacgaggagcgcgatatccctgaacggtcctggaattctggcaacgagtggattacagactttgtcgggaagaccgtgtggttcgtgcccagcatcaaagcgggcaatgatattgctaactgtctgagaaagaacggaaagaaagtcatccaactctcccgcaagacgtttgacaccgaataccagaaaacacggctgaatgattgggacttcgttgtgaccacagatatttctgagatgggcgccaactttaaggccgacagagtgatcgatccccggcgctgcctgaaacctgtcatcctcaccgacgggcccgagagagtgattcttgctggacctatgccggttacagccgcgagcgccgctcagcggcgcggcagagtggggcggaatccccagaaggaaaacgatcaatacatcttcaccggacagcctctgaataacgacgaggaccatgcccactggacggaagctaagatgctgctcgataatattaacacacccgagggcatcattcctgccctgttcgaacccgagagagagaaatccgctgccatcgacggggaatatcgccttaagggcgagagccggaaaacctttgtcgaactgatgagacgcggagatctcccggtgtggctggcgcacaaggttgcctctgagggcatcaaatacaccgaccggaagtggtgcttcgatggggaaagaaataaccagattctggaggagaatatggacgtggaaatctggacaaaagagggagaacgcaagaagctccggcctagatggcttgatgctcgcacctattccgaccccctggccctgaaagagtttaaggatttcgctgccggcagaaaaagcattgccctcgacctggtcacagaaatcgggcgggtgccttctcatcttgcttaccgcacgagaaacgcgctggataatctcgtcatgctgcacacctccgagcatggaggccgggcctatcgccacgctgtggaggaactgcccgagacaatggaaaccctccttctgctgggcctcatgattctgcttacagggggagccatgctgtttctcatcagcggcaaggggatcggaaaaacctccattggcctgatctgtgttattgtgtctagcgggatgctgtggatggccgacgtgcctctccagtggatcgcttccgccattgtccttgagttctttatgatggttctgctgatccccgagccggaaaagcaaagaacgcctcaggataaccagctcgcgtacgtggtgattggaatcctgacccttgccgctatcgtcgccgctaatgagatgggcctgctcgaaacaaccaagcgggacctgggcatgagcaaagagcccggggtggtttctcccacatcctatctggacgtggatctccaccctgccagcgcgtggaccctttacgccgtcgctacgacagtgattaccccgatgctgagacatacaatcgaaaactctaccgccaatgtcagcctggctgccattgctaaccaagccgtggttctcatgggactggacaagggctggcccatctccaaaatggatcttggggtgcctctgctcgcgctgggatgctactctcaggtcaaccccctgaccctcacagccgctgtgcttctgctggttacgcactatgccattatcggccctgggctccaggctaaggccacccgcgaggcccagaaacggacagcggctggaatcatgaagaatcccaccgtggacggcattatgacaatcgatctggaccctgtcatttacgatagcaagttcgagaaacaacttggccaggtgatgctgctcgtgctgtgtgccgttcagctgctccttatgagaacctcctgggctctgtgcgaagccctgacgctcgccacagggccgatcaccaccctgtgggagggatctcccggcaagttttggaacacaaccattgctgtcagcatggccaatatcttccgcgggtcctatcttgcgggagccggcctggcttttagcatcatgaaatctgtggggacaggacggagaggcacgggctcccagggggaaaccctcggagagaagtggaaaaagaagctgaaccaactgagccggaaagaattcgacctctacaagaaatccggcattacagaggtggatcgcaccgaggccaaggaagggcttaaaagaggagagacaacccatcacgctgtctctcggggcagcgccaagctgcagtggtttgttgaacgcaatatggtgatccctgaggggagagtgattgacctgggatgtggccggggcgggtggtcctattactgcgcgggactcaaaaaggtcacggaagtgcgcggctataccaaggggggacccggccatgaggagcctgttcccatgtctacatacgggtggaacctggtgaaacttatgagcggaaaggatgtcttctacctgccgcctgaaaaatgtgacaccctcctgtgcgatatcggcgagtccagcccctctcccacagtggaagagtccagaaccattcgggttctgaagatggtggagccttggctcaaaaataaccagttctgtatcaaggtccttaatccctatatgcctacagtgattgaacacctggagcgcctgcagagaaagtacggcgggatgctcgtgcggaacccgctgagcagaaattctacccacgaaatgtattggatctccaacggaacgggcaatatcgtcagctctgttaacatggtgagccgccttctgctcaatcggtttacaatgacccatagacgccccaccattgagaaagacgtggacctgggggccggaacacggcacgtcaacgctgaacctgagacgcccaacatggatgtgatcggcgagagaattaagcgcatcaaagaagagcattcctctacctggcactacgacgatgaaaatccttataagacatgggcctaccacgggagctatgaggttaaagctaccggatccgccagctccatgattaacggcgtggtcaagctgctcacaaagccctgggacgtggttccgatggtgacccaaatggctatgacagataccacgcctttcggccagcagcgggtctttaaagaaaaggtggacaccagaacaccccgccctatgcccgggacccggaaagttatggagatcacagccgagtggctgtggagaacccttggacgcaataagaaacctcggctgtgcacgagagaagagttcacaaagaaggtgcgcaccaacgcggccatgggcgctgtctttacagaagagaatcaatgggattctgccagagctgccgtggaagacgaggagttctggaaactcgtcgatcgggaacgcgagctgcataagcttgggaaatgtggaagctgcgtgtacaacatgatgggcaagagagaaaaaaagctgggggagtttggcaaagccaagggatcccgggcgatctggtacatgtggctcggcgctagatatctggagttcgaagccctggggtttctcaatgaggaccactggttctctcgggaaaacagctactccggagttgagggcgaagggctgcataagcttggatatattctgcgcgatatctctaaaattcccggcggggccatgtacgctgacgacaccgccggctgggatacgagaatcaccgaggacgatctccacaatgaggaaaagattacacagcagatggacccggagcatcggcagctggctaacgccatctttaaacttacctatcaaaataaggtggtcaaagtgcagcgccctacacccaagggaaccgtgatggatatcattagcagaaaggaccagcggggctccgggcaggttggaacatacggcctgaacaccttcacgaatatggaagcgcaactcgtgcgccagatggagggggaaggagtcctgagcaaagccgatctggagaacccccacctcctggagaagaaaatcacacagtggcttgaaaccaagggcgtggagagactgaaacggatggctatttctggggacgattgcgttgtgaagcctatcgacgatcgctttgccaatgctctcctggcccttaacgacatgggcaaggtcagaaaagatattccgcagtggcaaccctccaagggatggcacgactggcagcaggtgcctttctgtagccatcacttccatgaactgatcatgaaagacggccggaagctcgtcgtgccctgccgccctcaggatgagctgatcgggagagcgcggatttctcaaggagccggctggtccctgaaagaaaccgcttgtctcgggaaggcctatgctcagatgtggagcctgatgtactttcaccgcagagaccttcggctggcctctaacgctatctgctccgccgttcccgtgcactggattcctacaagcagaaccacatggtccatccatgcgcaccatcagtggatgacgaccgaggatatgctcacagtctggaatcgcgtgtggattgaggacaacccctggatggaagataagaccccggttacaacctgggaggacgtgccttacctgggaaaacgggaagatcaatggtgtggcagccttatcgggctgacgtctagagccacctgggctcagaatattctcacagccatccagcaggtccgcagcctgatcggcgacgaggagttcctggattatatgccctccatgaagcggtttagaaaagaagaggaatctgagggagccatttggtga

SEQ ID NO: 20846 - RNA, 9873 nt, synthetic construct
  misc_feature 1..9873: note = derived and/or modified CDS sequence (opt5) from DENV-3__FJ432731__SS-prME
  source 1..9873: mol_type = other RNA
accagcctgtgcctcatgatgatgctgcccgccacacttgctttccacctgacgtccagagacggcgagcctcggatgatcgtggggaagaacgaacgcggaaaatctctcctgtttaagaccgccagcggcattaatatgtgtacacttatcgcgatggatctgggggagatgtgcgacgataccgtcacatacaaatgtccgctcattgctgaagttgagcccgaagacatcgattgctggtgtaacctgacctccacatgggtgacctatggaacgtgcaatcaggccggcgagcatagacgggacaagcgctctgtggccctggctcctcacgtcgggatgggactcgataccagaacacaaacctggatgagcgccgagggcgcttggcggcaggtggaaaaagttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagaataaacccacgctcgacatcgagctgcagaagaccgaagctacacaacttgccaccctgcgcaaactctgtattgagggaaagatcacaaacattaccacggattccagatgccctacacagggcgaagcgatcctgccggaggaacaggaccagaattatgtgtgtaaacacacctacgtggatcggggctgggggaacggatgcggccttttcgggaagggaagcctggtcacctgcgccaagtttcaatgtctcgagcccattgagggcaaagtggttcagtatgaaaatctgaagtacacagtgatcatcaccgtccacacaggggaccagcatcaggtgggaaacgacacgcaaggcgttaccgtggagattacacctcaggcttctaccgtcgaagccgtgctgcccgagtatggcacactcgggctggaatgctcccctcgcaccggacttgatttcaatgagatgatcctgctcacgatgaaaaacaaggcttggatggtccacagacagtggtttttcgacctgccccttccgtggaccagcggcgccacaaccgagacacctacctggaatcggaaagaactgctcgtgacgtttaagaacgcccatgctaaaaagcaagaggttgtggtcctggggtctcaggaaggagcgatgcacacagccctgaccggcgctacagagattcagaattccgggggcaccagcatcttcgccggacacctcaagtgtcgcctgaaaatggataagcttgaactgaaaggcatgtcttacgccatgtgcctcaacacctttgtgctgaagaaagaggtttccgagacacagcatgggacgattctgatcaaggtggaatacaagggagaggacgctccctgtaaaatccctttcagcaccgaagatggccaagggaaggcccacaacggaagacttattacagcgaatcccgtcgtgaccaaaaaggaggagcccgtgaacatcgaagctgagcctccgttcggcgaatccaatattgttatcgggattggcgacaaagccctcaagatcaactggtataagaaaggatctagcatcggcaagatgtttgaggccacagctcggggggccagacgcatggctattctgggagataccgcctgggacttcggctccgtcgggggagtgctgaatagcctcggcaaaatggtgcatcagatctttgggtctgcgtacacggccctgttctccggcgtcagctggattatgaagatcggaattggcgtgcttctgacatggatcgggctcaactctaaaaataccagcatgtccttttcttgcattgttatcggaatcattaccctgtatctgggcgctgtggtccaggccgatatggggtgtgctatcaactggaagggaaaggaacttaaatgcggcagcgggattttcgtgacaaatgaggttcacacctggacagagcagtacaagtttcaagccgactcccccaaacggctcgcgacggccatcgctggcgcctgggaaaacggagtgtgtggcattagaagcaccacacgcatggagaatctgctgtggaagcagatcgctaacgaactcaattatatcctgtgggagaacaatattaaacttaccgtcgtggttggggatatcattggagtgctggaacagggcaagcggacactcacccctcagcccatggagctgaaatactcttggaagacgtgggggaaggccaaaatcgtcaccgccgagacacaaaactccagcttcattatcgacggacctaacacccccgaatgcccgtctgcttccagagcgtggaatgtgtgggaggtggaagactatggctttggcgtcttcacaaccaacatctggctgaagcttcgcgaggtttacacacagagctgtgatcatcggctcatgtccgccgctattaaagacgaaagagccgtgcacgccgatatggggtactggatcgagtctcagaagaatggaagctggaaactggagaaggcttcctttattgaagtgaagacctgcacgtggcctaaatctcacacactgtggagcaacggcgtcctcgagtccgacatgatcattcccaagagcctggccgggcctatctctcagcataatcaccgccccggatatcatacccaaaccgcgggcccttggcaccttgggaaactggaactcgatttcaactactgcgagggaacaaccgtggttatcacggagaattgtggcacacggggcccctccctgagaaccacaaccgtgagcgggaagctgattcacgaatggtgctgtcgctcttgcacacttccgcctctccggtatatgggagaggacggctgttggtacgggatggaaatcagacccattaacgagaaagaagagaatatggtcaagtccctggtgagcgctggatctggcaaggttgataactttaccatgggggtgctgtgcctcgccatcctgttcgaggaagtcatgcggggaaaattcggcaagaaacatatgattgccggcgtgctttttatgttcgttctgctcctgagcgggcagatcacgtggcgcgacatggctcagaccctgattatgatcggatccaatgccagcgatagaatgggcatgggggtgacatatcttgcgctgatcgctacctttaagattcaacccttcctcgccctgggatttttcctccggaaactgacatctagagagaaccttctgctcggcgtcgggctggccatgaccacgacactgcagcttcctgaagacatcgagcagatggctaatggaattgccctgggcctcatgaccctgaagctcatcacacagtttgaaacctaccaactgtggaccgctcttgtgtccctgacatgtagcaacacgattttcaccctcacagtggcctggcgcaccgcgacactgatcctggccggcgtctcccttctgccgctctgccagtctagctccatgcggaagaccgattggctgcccatgacggttgctgccatgggggtgcctcccctccctctgtttatcttctctcttaaagacacacccaagagacgcagctggcctctgaatgagggagtgatggctgtcggcctggtgtccattctcgcctctagcctgcttagaaacgatgttcccatggccgggccgctggtggctggaggcctcctgatcgcgtgttatgtcattaccgggacctccgccgacctcacagtggagaaagctgccgacgttacctgggaagaggaagccgagcagacaggagtgagccacaacctgatgatcacggtcgatgacgatggcaccatgcggattaaggacgatgaaacagagaatatccttaccgtgctgctgaaaacagctctcctgatcgtctctggcatttttccttactccatccccgccacccttctggtgtggcatacgtggcagaagcaaacccagcgcagcggggttctctgggacgtgccttctcccccggagacacagaaagcggaactggaggaaggagtctacagaattaagcagcaaggcatcttcgggaagacccaggtgggagttggcgtgcagaaagagggggtctttcacacaatgtggcatgtgacccggggagctgtgctcacacacaacggcaagcgcctggagcctaattgggcctccgttaaaaaggatcttattagctatggcgggggatggagactgtctgcccaatggcagaaaggcgaagaggtccaggtgatcgctgtggaacccgggaagaaccctaagaatttccagacgatgcccggaattttccaaaccacaaccggcgagatcggggccatcgcgctggactttaaacccggaacctccggcagccctattatcaaccgggaaggcaaggtcgtggggctctacggaaatggcgttgtgacaaaaaacgggggatatgtctccggcattgctcagacgaatgccgagccggatgggcccacccctgagctggaagaggaaatgttcaagaaacgcaaccttacaatcatggacctgcaccccggcagcggaaagaccagaaagtacctccctgccattgtgcgggaggctatcaaacgcagactgcggacactcatcctggcccccaccagagttgtggctgccgaaatggaggaggcgcttaagggcctgcctattcgctatcagacgacagccaccaaatctgaacataccgggcgggagatcgtcgatctgatgtgccacgctacatttaccatgagactcctgagcccggtgcgcgttcccaattacaaccttattatcatggacgaagcccatttcacagatcctgcttccattgccgcccggggatatatctctaccagagtgggcatgggggaggctgcggccatctttatgacggctacaccccctggaaccgccgaagccttcccccagagcaatgctccgattcaagacgaggagcgcgacatccctgaacggtcctggaactctggcaatgagtggattacagattttgtcgggaagaccgtgtggttcgtgcccagcatcaaagccggcaacgacattgcgaactgtctgagaaagaatggaaagaaagtcatccagctctcccgcaagacgtttgataccgaataccagaaaacacggctgaacgactgggatttcgttgtgaccacagacatttctgagatgggcgctaattttaaggccgatagagtgatcgacccccggcgctgcctgaaacctgtcatcctcaccgatgggcccgagagagtgattcttgccggacctatgccggttacagctgccagcgcggcccagcggcgcggcagagtggggcggaacccccaaaaggaaaatgaccagtacatcttcaccggacagcctctgaacaatgatgaggaccacgctcattggacggaagccaagatgctgctcgacaacattaatacacccgagggcatcattcctgctctgttcgaacccgagagagagaaatccgccgctatcgatggggaatatcgccttaagggcgagagccggaaaacctttgtcgaactgatgagacgcggagacctcccggtgtggctggcccacaaggttgcgtctgagggcatcaaatacaccgatcggaagtggtgcttcgacggggaaagaaacaatcagattctggaggagaacatggatgtggaaatctggacaaaagagggagaacgcaagaagctccggcctagatggcttgacgcccgcacctattccgatcccctggctctgaaagagtttaaggacttcgccgctggcagaaaaagcattgccctcgatctggtcacagaaatcgggcgggtgccttctcaccttgcctaccgcacgagaaatgctctggacaacctcgtcatgctgcatacctccgagcacggaggccgggcgtatcgccatgccgtggaggaactgcccgagacaatggaaaccctccttctgctgggcctcatgattctgcttacagggggagctatgctgtttctcatcagcggcaaggggatcggaaaaacctccattggcctgatctgtgttattgtgtctagcgggatgctgtggatggccgatgtgcctctccaatggatcgcctccgctattatccttgagttctttatgatggtcctgctgattcccgagccggaaaagcagagaacgcctcaggacaatcaactcgcctacgttgtgatcggaatcctgacccttgcggccattgtggctgccaacgagatgggcctgctcgaaacaaccaagcgggatctgggcatgagcaaagagcccggggtcgtgtctcccacatcctatctggacgttgacctccaccctgctagcgcctggaccctttacgcggtggccacgacagtcatcaccccgatgctgagacacacaattgaaaattctaccgctaacgtgagcctggccgctatcgccaaccaggctgtcgtgctcatgggactggataagggctggcccatttccaaaatggaccttggggttcctctgctcgccctgggatgctactctcaggtgaatcccctgaccctcacagcggccgtccttctgctggtgacgcattatgctatcatcggccctgggctccaggccaaggctacccgcgaggcccaaaaacggacagccgcgggaattatgaagaaccccaccgttgatggcatcatgacaattgacctggatcctgtgatctacgacagcaagttcgagaaacagcttggccaggtcatgctgctcgtgctgtgtgctgtgcagctgctccttatgagaacctcctgggccctgtgcgaagctctgacgctcgccacagggccgattaccaccctgtgggagggatctcccggcaagttttggaatacaaccatcgccgttagcatggctaacatcttccgcgggtcctatcttgccggagcgggcctggcctttagcattatgaaatctgtcgggacaggacggagaggcacgggctcccaaggggaaaccctcggagagaagtggaaaaagaagctgaatcagctgagccggaaagaattcgatctctacaagaaatccggcatcacagaggtggaccgcaccgaggctaaggaagggcttaaaagaggagagacaacccaccatgccgtgtctcggggcagcgctaagctgcagtggtttgtcgaacgcaacatggttattcctgaggggagagtgatcgatctgggatgtggccggggcgggtggtcctattactgcgccggactcaaaaaggtgacggaagtccgcggctataccaaggggggacccggccacgaggagcctgtgcccatgtctacatacgggtggaatctggttaaacttatgagcggaaaggacgtgttctacctgccgcctgaaaaatgtgataccctcctgtgcgacattggcgagtccagcccctctcccacagtcgaagagtccagaaccatccgggtgctgaagatggttgagccttggctcaaaaacaatcagttctgtattaaggtgcttaacccctatatgcctacagtcatcgaacatctggagcgcctgcaaagaaagtacggcgggatgctcgtgcggaatccgctgagcagaaactctacccacgaaatgtattggatctccaatggaacgggcaacattgtgagctctgtcaatatggttagccgccttctgctcaaccggtttacaatgacccacagacgccccaccatcgagaaagatgtggacctgggggcgggaacacggcatgtgaacgccgaacctgagacgcccaatatggacgtcattggcgagagaatcaagcgcattaaagaagagcactcctctacctggcattacgatgacgaaaacccttataagacatgggcttaccacgggagctatgaggtgaaagccaccggatccgctagctccatgatcaatggcgttgtgaagctgctcacaaagccctgggatgtcgtgccgatggttacccagatggccatgacagacaccacgcctttcggccagcaacgggtgtttaaagaaaaggtcgataccagaacaccccgccctatgcccgggacccggaaagtgatggagatcacagctgagtggctgtggagaacccttggacgcaacaagaaacctcggctgtgcacgagagaagagttcacaaagaaggttcgcaccaatgccgcgatgggcgccgtgtttacagaagagaaccagtgggactctgctagagccgctgtcgaagatgaggagttctggaaactcgtggaccgggaacgcgagctgcacaagcttgggaaatgtggaagctgcgtctacaatatgatgggcaagagagaaaaaaagctgggggagtttggcaaagccaagggatcccgggccatttggtacatgtggctcggcgcgagatatctggagttcgaagctctggggtttctcaacgaggatcattggttctctcgggaaaatagctactccggagtggagggcgaagggctgcacaagcttggatatatcctgcgcgacatttctaaaatccccggcggggccatgtacgccgatgacaccgctggctgggacacgagaattaccgaggatgacctccataacgaggaaaagatcacacagcagatggatccggagcaccggcaactggccaatgctatctttaaacttacctatcagaacaaggttgtgaaagtccagcgccctacacccaagggaaccgtgatggacattatcagcagaaaggatcagcggggctccgggcaagtgggaacatacggcctgaataccttcacgaacatggaagcccagctcgttcgccagatggagggggaaggagtgctgagcaaagcggacctggagaatccccatctcctggagaagaaaattacacagtggcttgaaaccaagggcgtcgagagactgaaacggatggccatctctggggatgactgcgtggttaagcctattgatgaccgctttgctaacgccctcctggctcttaacgatatgggcaaggtgagaaaagacatcccgcaatggcagccctccaagggatggcacgattggcagcaggtccctttctgtagccaccatttccacgaactgatcatgaaagacggccggaagctcgtggtcccctgccgccctcaagacgagctgattgggagagcccggatctctcagggagcgggctggtccctgaaagaaaccgcctgtctcgggaaggcttatgcccagatgtggagcctgatgtactttcatcgcagagatcttcggctggcttctaatgccatttgctccgctgtgcccgttcactggatccctacaagcagaaccacatggtccattcacgcccatcaccaatggatgacgaccgaggacatgctcacagtgtggaaccgcgtctggatcgaggataatccctggatggaagacaagaccccggtgacaacctgggaggatgttccttacctgggaaaacgggaagaccagtggtgtggcagccttattgggctgacgtctagagcgacctgggcccagaacatcctcacagctatccagcaagtgcgcagcctgattggcgatgaggagttcctggactatatgccctccatgaagcggtttagaaaagaagaggaatctgagggagccatctggtga

SEQ ID NO: 20847 - RNA, 9873 nt, synthetic construct
  misc_feature 1..9873: note = derived and/or modified CDS sequence (opt5) from DENV-3__FJ562097__SS-prME
  source 1..9873: mol_type = other RNA
accagcctgtgcctcatgatgatgctgcccgccacacttgctttccacctgacgtccagagacggcgagcctcggatgatcgtggggaagaacgaacgcggaaaatctctcctgtttaagaccgccagcggcattaatatgtgtacacttatcgcgatggatctgggggagatgtgcgacgataccgtcacatacaaatgtccgctcattgctgaagttgagcccgaagacatcgattgctggtgtaacctgacctccacatgggtgacctatggaacgtgcaatcaggccggcgagcatagacgggacaagcgctctgtggccctggctcctcacgtcgggatgggactcgataccagaacacaaacctggatgagcgccgagggcgcttggcggcaggtggaaaaagttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagaataaacccacgctcgacatcgagctgcagaagaccgaagctacacaacttgccaccctgcgcaaactctgtattgagggaaagatcacaaacattaccacggattccagatgccctacacagggcgaagcgatcctgccggaggaacaggaccagaattatgtgtgtaaacacacctacgtggatcggggctgggggaacggatgcggccttttcgggaagggaagcctggtcacctgcgccaagtttcaatgtctcgagcccattgagggcaaagtggttcagtatgaaaatctgaagtacacagtgatcatcaccgtccacacaggggaccagcatcaggtgggaaacgacacgcaaggcgttaccgtggagattacacctcaggcttctaccgtcgaagccgtgctgcccgagtatggcacactcgggctggaatgctcccctcgcaccggacttgatttcaatgagatgatcctgctcacgatgaaaaacaaggcttggatggtccacagacagtggtttttcgacctgccccttccgtggaccagcggcgccacaaccgagacacctacctggaatcggaaagaactgctcgtgacgtttaagaacgcccatgctaaaaagcaagaggttgtggtcctggggtctcaggaaggagcgatgcacacagccctgaccggcgctacagagattcagaattccgggggcaccagcatcttcgccggacacctcaagtgtcgcctgaaaatggataagcttgaactgaaaggcatgtcttacgccatgtgcctcaacacctttgtgctgaagaaagaggtttccgagacacagcatgggacgattctgatcaaggtggaatacaagggagaggacgctccctgtaaaatccctttcagcaccgaagatggccaagggaaggcccacaacggaagacttattacagcgaatcccgtcgtgaccaaaaaggaggagcccgtgaacatcgaagctgagcctccgttcggcgaatccaatattgttatcgggattggcgacaaagccctcaagatcaactggtataagaaaggatctagcatcggcaagatgtttgaggccacagctcggggggccagacgcatggctattctgggagataccgcctgggacttcggctccgtcgggggagtgctgaatagcctcggcaaaatggtgcatcagatctttgggtctgcgtacacggccctgttctccggcgtcagctggattatgaagatcggaattggcgtgcttctgacatggatcgggctcaactctaaaaataccagcatgtccttttcttgcattgttatcggaatcattaccctgtatctgggcgctgtggtccaggccgatatggggtgtgtgatcaactggaagggaaaggaacttaaatgcggcagcgggattttcgttacaaatgaggtgcacacctggacagagcagtacaagtttcaagctgactcccccaaacggctcgccacggcgatcgccggcgcttgggaaaacggagtctgtggcattagaagcaccacacgcatggagaatctgctgtggaagcagatcgccaacgaactcaattatatcctgtgggagaacaatattaaacttaccgtggttgtgggggatatcattggagtcctggaacagggcaagcggacactcacccctcagcccatggagctgaaatactcttggaagacgtgggggaaggctaaaatcgtgaccgccgagacacaaaactccagcttcattatcgacggacctaacacccccgaatgcccgtctgcctccagagcttggaatgtgtgggaggtcgaagactatggctttggcgttttcacaaccaacatctggctgaagcttcgcgaggtgtacacacagagctgtgatcatcggctcatgtccgcggccattaaagacgaaagagctgtgcacgccgatatggggtactggatcgagtctcagaagaatggaagctggaaactggagaaggcctcctttattgaagtcaagacctgcacgtggcctaaatctcacacactgtggagcaacggcgtgctcgagtccgacatgatcattcccaagagcctggctgggcctatctctcagcataatcaccgccccggatatcatacccaaaccgccggcccttggcaccttgggaaactggaactcgatttcaactactgcgagggaacaaccgttgtgatcacggagaattgtggcacacggggcccctccctgagaaccacaaccgtcagcgggaagctgattcacgaatggtgctgtcgctcttgcacacttccgcctctccggtatatgggagaggacggctgttggtacgggatggaaatcagacccattaacgagaaagaagagaatatggtgaagtccctggttagcgcgggatctggcaaggtggataactttaccatgggggtcctgtgcctcgctatcctgttcgaggaagtgatgcggggaaaattcggcaagaaacatatgattgccggcgttctttttacgttcgtgctgctcctgagcgggcagatcacctggcgcgacatggcccacacactgattatgatcggatccaatgctagcgatagaatgggcatgggggtcacctatcttgccctgatcgcgacatttaagattcagcccttcctcgctctgggatttttcctccggaaactgacctctagagagaaccttctgctcggcgtggggctggccatggccgctacgctgcaacttcctgaagacatcgagcagatggccaatggaattgctctgggcctcatgacactgaagctcatcacccagtttgaaacataccagctgtggaccgcccttgtgtccctgacctgtagcaacacaattttcacgctcaccgtcgcgtggcgcacagccaccctgatcctggctggcgtttcccttctgccgctctgccaatctagctccatgcggaagacagattggctgcccatgaccgtggccgctatgggggtgcctcccctccctctgtttatcttctctcttaaagacacgcccaagagacgcagctggcctctgaatgagggagtcatggccgtgggcctggtttccattctcgcctctagcctgcttagaaacgatgtgcccatggctgggccgctggtcgcgggaggcctcctgatcgcctgttatgtgattacagggacctccgctgacctcaccgttgagaaagccgccgacgtgacatgggaagaggaagctgagcagaccggagtcagccataacctgatgatcacagtggatgacgatggcacgatgcggattaaggacgatgaaaccgagaatatccttacagtcctgctgaaaaccgccctcctgatcgtgtctggcgtttttccttactccattcccgcgacacttctggtgtggcacacctggcagaagcagacgcaacgcagcggggtcctctgggacgtgccttctcccccggagacccagaaagctgaactggaggaaggagtttacagaatcaagcagcagggcattttcgggaagacacaagtgggagtcggcgtgcagaaagagggggtgtttcataccatgtggcacgttacacggggagccgtcctcacccacaacggcaagcgcctggagcctaattgggcctccgtgaaaaaggatcttatcagctatggcgggggatggagactgtctgctcagtggcaaaaaggcgaagaggtgcaggtcattgccgtggaacccgggaagaaccctaagaatttccagacaatgcccggaatcttccagacgaccacaggcgagattggggcgatcgctctggactttaaacccggaacctccggcagccctatcattaaccgggaaggcaaggttgtggggctctacggaaatggcgtcgtgaccaaaaacgggggatatgtttccggcatcgcccaaacaaatgccgagccggatgggcccacgcctgagctggaagaggaaatgttcaagaaacgcaaccttaccattatggacctgcatcccggcagcggaaagacaagaaagtacctccctgctatcgtgcgggaggccattaaacgcagactgcggaccctcatcctggctcccacaagagtcgtggccgcggaaatggaggaggcccttaagggcctgcctatccgctatcagaccacggctacaaaatctgaacacaccgggcgggagattgttgatctgatgtgccatgccacctttacaatgagactcctgagcccggtgcgcgtccccaattacaaccttatcattatggacgaagctcacttcaccgatcctgcctccatcgccgctcggggatatatttctacaagagtgggcatgggggaggcggccgctatctttatgaccgccacgccccctggaacagccgaagctttcccccagagcaatgccccgatccaggacgaggagcgcgacattcctgaacggtcctggaactctggcaatgagtggatcaccgattttgtggggaagacagtctggttcgttcccagcattaaagcgggcaacgacatcgctaactgtctgagaaagaatggaaagaaagtgattcaactctcccgcaagacctttgatacggaataccagaaaaccaagctgaacgactgggatttcgtggtcacaaccgacatctctgagatgggcgccaattttaaagccgatcgggtgattgaccccagacggtgcctgaagcctgttatcctcacagatgggcccgagcgcgtgatccttgctggacctatgccggtcaccgccgcgagcgccgctcagagacggggccgcgtggggagaaacccccagaaggaaaatgaccaatacattttcacaggacagcctctgaacaatgatgaggaccatgcccactggaccgaagctaaaatgctgctcgacaacatcaatacgcccgagggcattatccctgccctgttcgaacccgagcgggagaagtccgctgccattgatggggaatatagacttaaaggcgagagccgcaagacatttgttgaactgatgcggagaggagacctcccggtgtggctggcgcacaaagtcgcctctgagggcatcaagtacaccgatcgcaaatggtgcttcgacggggaacggaacaatcagatcctggaggagaacatggatgtggaaatttggaccaaggagggagaaagaaagaaactccgccctcggtggcttgacgctagaacatattccgatcccctggccctgaaggagtttaaagacttcgctgccggccgcaagagcatcgccctcgatctggtcaccgaaattgggagagtgccttctcatcttgcttaccggacacgcaatgcgctggacaacctcgttatgctgcacacgtccgagcatggaggcagagcctatcggcacgctgtggaggaactgcccgagaccatggaaacactccttctgctgggcctcatgatcctgcttaccgggggagccatgctgtttctcattagcggcaaagggatcggaaagacatccatcggcctgatttgtgtgatcgtctctagcgggatgctgtggatggccgatgttcctctccagtggattgcttccgccatcgtgcttgagttctttatgatggtgctgctgattcccgagccggaaaagcaacgcacccctcaggacaatcagctcgcgtacgtcgtgatcggaattctgacgcttgccgctatcgttgccgctaacgagatgggcctgctcgaaaccacaaaaagagatctgggcatgagcaaggagcccggggtggtctctcccacctcctatctggacgtggacctccaccctgccagcgcgtggacactttacgccgtcgctaccacggtgatcacaccgatgctgcggcataccattgaaaattctacagccaacgttagcctggctgccatcgctaaccaagccgtggtcctcatgggactggataaaggctggcccatttccaagatggaccttggggtgcctctgctcgcgctgggatgctactctcaggttaatcccctgaccctcaccgccgctgtgcttctgctggtcacacactatgccatcattggccctgggctccaggctaaagccacgagagaggcccagaagcgcaccgcggctggaatcatgaagaaccccacagtggatggcatcatgaccattgacctggatcctgtgatctacgacagcaaattcgagaagcaacttggccaggttatgctgctcgtcctgtgtgccgtgcagctgctccttatgcggacatcctgggctctgtgcgaagccctgaccctcgccacggggccgattacaaccctgtgggagggatctcccggcaaattttggaataccacaatcgctgtgagcatggccaacattttcagagggtcctatcttgcgggagccggcctggcttttagcatcatgaagtctgtcgggaccggacgccggggcacaggctcccagggggaaacgctcggagagaaatggaagaagaaactgaatcaactgagcagaaaggaattcgatctctacaaaaagtccggcatcaccgaggttgaccggacagaggccaaagaagggcttaagcgcggagagaccacacatcacgctgtgtctagaggcagcgccaaactgcagtggtttgtggaacggaacatggtcattcctgaggggcgcgtgatcgatctgggatgtggcagaggcgggtggtcctattactgcgcgggactcaagaaggttaccgaagtgcggggctatacgaaagggggacccggccatgaggagcctgtccccatgtctacctacgggtggaatattgtgaagctgatgagcggaaaagacgttttctaccttccgcctgaaaagtgtgatacactgctctgcgacatcggcgagtccagcccctctcccaccgtggaagagtcccgcacaattagagtcctgaaaatggtggagccttggctgaagaacaatcagttctgtatcaaggtgctcaacccctatatgcctaccgtcattgaacaccttgagcggctgcagcgcaaatacggcgggatgctggttagaaatccgctcagccggaactctacacacgaaatgtattggatctccaatggaaccggcaacatcgtgagctctgtgaatatggtcagcagactgcttctgaaccgctttacgatgacacatcggagacccaccattgagaaggatgtggacctcggggccggaacccgccacgttaacgctgaacctgagacacccaatatggacgtgatcggcgagcggattaaaagaatcaaggaagagcattcctctacgtggcactacgatgacgaaaacccttataaaacctgggcctaccacgggagctatgaggtcaaggctacaggatccgccagctccatgattaatggcgtggttaagctgctgaccaaaccctgggatgtggtcccgatggtgacacaaatggctatgaccgacacaacccctttcggccagcagcgcgtttttaaggaaaaagtggatacgcggacccccagacctatgcccgggacacgcaaggtcatggagatcaccgccgagtggctctggcggacactgggaagaaacaaaaagcctcgcctttgcacccgggaagagttcacgaagaaagtgagaacaaatgcggccatgggcgctgtctttaccgaagagaaccaatgggactctgcccgcgctgccgtggaagatgaggagttctggaagctggttgacagagaacgggagctccataaactggggaagtgtggaagctgcgtgtacaatatgatgggcaaacgcgaaaagaaacttggggagtttggcaaggccaagggatccagagcgatctggtacatgtggctgggcgctcggtatctcgagttcgaagccctggggtttctgaacgaggatcactggttctctagagaaaatagctactccggagtcgagggcgaagggctccataaactgggatatattcttcgggacatctctaagattcccggcggggccatgtacgctgatgacacagccggctgggacacccgcatcacggaggatgacctgcacaacgaggaaaaaattacccagcagatggatccggagcatagacagctcgctaatgccatctttaagctgacatatcaaaacaaagtggtgaaggttcagcggcctacccccaagggaacagtgatggacatcattagccgcaaagatcagagaggctccgggcaggtcggaacctacggccttaatacattcaccaacatggaagcgcaactggtgcggcagatggagggggaaggagttctcagcaaggccgacctggagaatccccacctgctcgagaaaaagatcacgcagtggctggaaacaaaaggcgtggagcgccttaagagaatggctatttctggggatgactgcgtcgtgaagcctatcgatgaccggtttgccaacgctctgctcgccctgaacgatatgggcaaagtccgcaaggacattccgcagtggcaaccctccaaaggatggcacgattggcagcaggtgcctttctgtagccatcacttccatgaacttatcatgaaggacggcagaaaactggttgtgccctgccggcctcaggacgagctcatcgggcgcgcgagaatttctcaaggagccggctggtccctgaaggaaaccgcttgtctggggaaggcctatgctcagatgtggagcctcatgtactttcaccggcgcgatctgagacttgcctctaatgctatctgctccgccgtccccgtgcactggattcctaccagccggacaacctggtccatccatgcgcaccatcagtggatgacaacggaggacatgctgaccgtttggaacagagtgtggattgaggataatccctggatggaagacaaaacaccggtcaccacatgggaggatgtgccttacctcggaaagcgcgaagaccaatggtgtggcagcctgatcgggcttacctctcgggccacgtgggctcagaacattctgaccgccatccagcaggtgagaagcctcatcggcgatgaggagttcctggactatatgccctccatgaaacgctttcggaaggaagaggaatctgagggagccatttggtga

SEQ ID NO: 20848 - RNA, 9873 nt, synthetic construct
  misc_feature 1..9873: note = derived and/or modified CDS sequence (opt5) from DENV-3__FJ432741__SS-prME
  source 1..9873: mol_type = other RNA
accagcctgtgcctcatgatgatgctgcccgccacccttgctttccacctgacgtcccgggacggcgagcctcggatgatcgtggggaagaacgaacgcggaaagtctctcctgtttaagaccgccagcggcattaatatgtgtacacttatcgcgatggatctgggggagatgtgcgacgataccgtgacatacaagtgtccgctcattgctgaagttgagcccgaagacatcgattgctggtgtaacctgacctccacatgggtgacctatggaacgtgcaatcaggccggcgagcatagacgggacaagcgctctgtggccctggctcctcacgtcgggatgggactcgataccagaacacagacctggatgagcgccgagggcgcttggcggcaggtcgaaaaggttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagaataagcccacgctcgacatcgagctgcagaagaccgaagctacacagcttgccaccctgcgcaaactctgtattgagggaaagatcacaaacattaccacggattccagatgccctacacagggcgaagcgatcctgccggaggaacaggaccagaattatgtgtgtaaacacacctacgtggatcggggctgggggaacggatgcggccttttcgggaagggaagcctggtgacctgcgccaagtttcaatgtctcgagcccattgagggcaaagtggttcagtatgaaaatctgaagtacacagtgatcatcaccgtccacacaggggaccagcatcaggtgggaaacgacacgcaaggcgttaccgtggagattacacctcaggcttctaccgtcgaagccgtgctgcccgagtatggcacactcgggctggaatgctcccctcgcaccggacttgatttcaatgagatgatcctgctcacgatgaaaaacaaggcttggatggtccacagacagtggtttttcgacctgccccttccgtggaccagcggcgccacaaccgagacacctacctggaatcggaaagaactgctcgtgacgtttaagaacgcccatgctaaaaagcaagaggttgtggtcctggggtctcaggaaggagcgatgcacacagccctgaccggcgctacagagattcaaaattccgggggcaccagcatcttcgccggacacctcaagtgtcgcctgaaaatggataaacttgaactgaaaggcatgtcttacgccatgtgcctcaacacctttgtgctgaagaaagaggtttccgagacacagcatgggacgattctgatcaaggtggaatacaagggagaggacgctccctgtaaaatccctttcagcaccgaagatggccaagggaaggcccacaacggaagacttattacagcgaatcccgtcgtggctaaaaaggaggagcccgtgaacatcgaagccgagcctccgttcggcgaatccaatattgttatcgggattggcgacaaagccctcaagatcaactggtataagaaaggatctagcatcggcaagatgtttgaggctaccgccagaggggctagacgcatggccattctgggagatacagcgtgggacttcggctccgtcgggggagtgctgaatagcctcggcaaaatggtgcatcagatctttgggtctgcctacaccgctctgttctccggcgtcagctggattatgaagatcggaattggcgtgcttctgacgtggatcgggctcaactctaaaaatacaagcatgtccttttcttgcattgttatcggaatcattaccctgtatctgggcgccgtggtccaggctgatatggggtgtgccatcaactggaagggaaaggaacttaaatgcggcagcgggattttcgtgaccaatgaggttcacacatggaccgagcagtacaagtttcaagcggactcccccaaacggctcgccacagctatcgccggcgcttgggaaaacggagtgtgtggcattagaagcacgacccgcatggagaatctgctgtggaagcagatcgccaacgaactcaattatatcctgtgggagaacaatattaaacttacagtcgtggttggggatatcattggagtgctggaacagggcaagcggaccctcacacctcagcccatggagctgaaatactcttggaagacctgggggaaggccaaaatcgtcacggctgagacccaaaactccagcttcattatcgacggacctaacacacccgaatgcccgtctgcgtccagagcctggaatgtgtgggaggtggaagactatggctttggcgtcttcaccacaaacatctggctgaaacttcgcgaggttcatacccagagctgtgatcaccggctcatgtccgctgccattaaagacgaaagagccgtgcacgctgatatggggtactggatcgagtctcagaagaatggaagctggaaactggagaaggcctcctttattgaagtgaagacatgcacctggcctaaatctcatacgctgtggagcaacggcgtcctcgagtccgacatggtgatccccaagagcctggcggggcctatttctcagcacaatcatcgccccggataccacacacaaaccgctggcccttggcaccttgggaaactggaactcgatttcaactattgcgagggaaccacagttgtgatcaccgagaattgtggcacgcggggcccctccctgagaacaaccacagtcagcgggaagctgatccatgaatggtgctgtcgctcttgcacccttccgcctctccggtacatgggagaggacggctgttggtatgggatggaaattagacccatcaacgagaaagaagagaatatggtgaagtccctggttagcgccggatctggcaaggtggataactttacaatgggggtcctgtgcctcgccattctgttcgaggaagtgatgcggggaaaattcggcaagaaacacatgatcgctggcgttctttttaccttcgtgctgctcctgagcgggcagattacgtggcgcgacatggcccataccctgatcatgattggatccaatgcgagcgatagaatgggcatgggggtcacataccttgctctgatcgccacctttaagatccagcccttcctcgccctgggatttttcctccggaaactgacatctagagagaaccttctgctcggcgtggggctggctatggccaccacgctgcaacttcctgaagacattgagcagatggctaatggaatcgccctgggcctcatgacactgaagctcattacccagtttgaaacatatcagctgtggaccgcgcttgtgtccctgacctgtagcaacacaatcttcacgctcaccgtcgcctggcgcacagctaccctgattctggccggcgtttcccttctgccgctctgccaatctagctccatgcggaagacagattggctgcccatgaccgtggctgccatgggggtgcctcccctccctctgtttatcttctctcttaaagacacgcccaagagacgcagctggcctctgaatgagggagtcatggccgtgggcctggtttccatcctcgcttctagcctgcttagaaacgatgtgcccatggcggggccgctggtcgccggaggcctcctgattgcttgttacgtgatcacagggacctccgccgacctcaccgttgagaaagccgctgacgtgacatgggaagaggaagccgagcagaccggagtcagccacaacctgatgattacagtggatgacgatggcacgatgcggatcaaggacgatgaaaccgagaatattcttacagtcctgctgaaaaccgcgctcctgatcgtgtctggcatctttccttattccattcccgctacacttctggtttggcatacctggcagaagcagacgcaacgcagcggggtgctctgggacgtcccttctcccccggagacccagaaagccgaactggaggaaggagtgtacagaatcaagcagcagggcattttcgggaagacacaagttggagtgggcgtccagaaagagggggtgtttcacaccatgtggcacgtgacacggggagccgttctcacccataacggcaagcgcctggagcctaattgggcttccgtcaaaaaggatcttatcagctacggcgggggatggagactgtctgcccagtggcaaaaaggcgaagaggtccaggtgattgcggtcgaacccgggaagaaccctaagaatttccagacaatgcccggaatcttccagacgaccacaggcgagattggggctatcgccctggactttaaacccggaacctccggcagccctatcattaaccgggaaggcaaggtggttgggctctatggaaatggcgtggtcaccaaaaacgggggatacgtgtccggcatcgcccaaacaaatgctgagccggatgggcccacgcctgagctggaagaggaagttttcaagaaacgcaaccttaccattatggacctgcaccccggcagcggaaagacaagaaagtatctccctgccatcgtgcgggaggctattaaacgcagactgcggaccctcatcctggcccccacaagagtcgtggcggccgaaatggaggaggctcttaagggcctgcctatccgctaccagaccacggccacaaaatctgaacataccgggcgggagattgttgatctgatgtgccacgctacctttacaatgagactcctgagcccggtgcgcgtccccaattataaccttatcattatggacgaagcccatttcaccgatcctgcctccatcgctgcgcggggatacatttctacaagagtgggcatgggggaggccgctgccatctttatgaccgccacgccccctggaacagctgaagccttcccccagagcaatgcgccgatccaggacgaggagcgcgacattcctgaacggtcctggaactctggcaatgagtggatcaccgattttgtggggaagacagtctggttcgttcccagcattaaagctggcaacgacatcgccaactgtctgagaaagaatggaaagaaagtgattcaactctcccgcaagacctttgatacggaatatcagaaaacccggctgaacgactgggatttcgtggtcacaaccgacatctctgagatgggcgccaattttaaggctgatagagtgattgacccccggcgctgcctgaaacctgttatcctcacagatgggcccgagagagtgatccttgccggacctatgccggtcaccgcggccagcgctgcccagcggcgcggcagagtggggcggaacccccagaaggaaaatgaccaatacattttcacaggacagcctctgaacaatgatgaggaccacgctcactggaccgaagccaagatgctgctcgacaacatcaatacgcccgagggcattatccctgctctgttcgaacccgagagagagaaatccgccgcgattgatggggaataccgccttaagggcgagagccggaaaacatttgttgaactgatgagacgcggagacctcccggtgtggctggcccataaggtcgcttctgagggcatcaaatataccgatcggaagtggtgcttcgacggggaaagaaacaatcagatcctggaggagaacatggatgtggaaatttggaccaaagagggagaacgcaagaagctccggcctagatggcttgacgcccgcacatactccgatcccctggctctgaaagagtttaaggacttcgccgccggcagaaaaagcatcgctctcgatctggtcaccgaaattgggcgggtgccttctcaccttgcgtatcgcacaagaaatgccctggacaacctcgttatgctgcatacgtccgagcacggaggccgggcttaccgccacgccgtggaggaactgcccgagaccatggaaacactccttctgctgggcctcatgatcctgcttaccgggggagccatgctgtttctcattagcggcaaggggatcggaaaaacatccatcggcctgatttgtgtgatcgtctctagcgggatgctgtggatggctgatgttcctctccagtggattgcctccgcgatcattcttgagttctttatgatggtgctgctgatccccgagccggaaaagcaaagaacccctcaggacaatcagctcgcctatgtggtcattggaatcctgacgcttgctgccatcgtggctgccaacgagatgggcctgctcgaaaccacaaagcgggatctgggcatgagcaaagagcccggggttgtgtctcccacctcctacctggacgtcgacctccatcctgcgagcgcctggacactttatgctgtggccaccacggtcattacaccgatgctgagacacaccatcgaaaattctacagctaacgtgagcctggccgctattgccaaccaagcggttgtgctcatgggactggataagggctggcccatctccaaaatggaccttggggtccctctgctcgccctgggatgctactctcaggtgaatcccctgaccctcaccgctgccgttcttctgctggtgacacattacgctattatcggccctgggctccaggccaaggccacgcgcgaggcgcagaaacggaccgctgccggaatcatgaagaaccccacagtcgatggcattatgaccatcgacctggatcctgtgatttatgacagcaagttcgagaaacaacttggccaggtgatgctgctcgttctgtgtgctgtccagctgctccttatgagaacatcctgggccctgtgcgaagccctgaccctcgctacggggccgatcacaaccctgtgggagggatctcccggcaagttttggaataccacaattgccgtgagcatggcgaacatcttccgcgggtcctaccttgccggagctggcctggcctttagcatcatgaaatctgtggggaccggacggagaggcacaggctcccagggggaaacgctcggagagaagtggaaaaagaagctgaatcaactgagccggaaagagttcgatctctataagaaatccggcattaccgaggtcgaccgcacagaggctaaggaagggcttaaaagaggagagaccacacaccatgccgtttctcggggcagcgcgaagctgcagtggtttgtggaacgcaacatggtgatccctgaggggagagtcattgatctgggatgtggccggggcgggtggtcctactattgcgccggactcaaaaaggtgaccgaagttcgcggctacacgaaaggcgggcccgggcacgaggagcctgtgcccatgtctacctatgggtggaatctggtcaaacttatgagcggaaaggacgtgttctacctgccgcctgaaaaatgtgatacactcctgtgcgacatcggcgagtccagcccctctcccaccgttgaagagtccagaacaattcgggtgctgaagatggtcgagccttggctcaaaaacaatcagttctgtatcaaggtgcttaacccctacatgcctaccgtgattgaacacctggagcgcctgcagagaaagtatggcgggatgctcgtccggaatccgctgagcagaaactctacacatgaaatgtactggatctccaatggaaccggcaacatcgttagctctgtgaatatggtgagccgccttctgctcaaccggtttacgatgacacacagacgccccaccattgagaaagatgtcgacctgggggctggaacccggcatgtgaacgccgaacctgagacacccaatatggacgttatcggcgagagaattaagcgcatcaaagaagaacactcctctacgtggcactatgatgacgaaaacccttacaagacctgggcttatcatgggagctacgaggtgaaagccacaggatccgctagctccatgattaatggcgtcgtgaagctgctcaccaagccctgggatgttgtgccgatggtcacacaaatggccatgaccgacacaacccctttcggccagcagcgggtgtttaaagaaaaggttgatacgagaacaccccgccctatgcccgggacacggaaagtgatggagatcaccgcggagtggctgtggagaacacttggacgcaacaagaaacctcggctgtgcaccagagaagagttcacgaagaaggtccgcacaaatgccgctatgggcgccgtgtttaccgaagagaaccaatgggactctgctagagccgccgtcgaagatgaggagttctggaaactcgtggaccgggaacgcaagctgcacaaacttgggaagtgtggaagctgcgtttataatatgatgggcaaaagagagaagaaactgggggaatttggcaaggcgaagggatcccgggctatctggtacatgtggctcggcgccagatacctggagttcgaggccctggggtttctcaacgaagatcattggttctctcgggagaatagctattccggagtggaaggcgaggggctgcacaaacttggatacattctgcgcgacatctctaagattcccggcggggctatgtatgccgatgacacagctggctgggacaccagaatcacggaagatgacctccataacgaggagaaaattacccagcagatggatccggaacaccggcagctggccaatgcgatctttaaacttacataccaaaacaaagtcgtgaaggtgcagcgccctacccccaagggaacagttatggacatcattagcagaaaagatcagcggggctccggacaggtgggaacctatggcctgaatacattcaccaacatggaggcccaactcgtccgccagatggaaggggagggagtgctgagcaaggctgacctggaaaatccccacctcctggagaaaaagatcacgcagtggcttgagacaaaaggcgttgaaagactgaagcggatggccatttctggggatgactgcgtggtcaagcctatcgatgaccgctttgctaacgccctcctggcgcttaacgatatgggcaaagtgagaaaggacattccgcagtggcaaccctccaaaggatggcatgattggcagcaggtccctttctgtagccaccatttccacgagctgatcatgaaggacggccggaaactcgtggttccctgccgccctcaggacgaactgatcgggagagcccggatttctcaaggagctggctggtccctgaaggagaccgcctgtctcgggaaggcttacgcccagatgtggagcctgatgtattttcaccgcagagatcttcggctggcttctaatgccatctgctccgcggtgcccgtccattggattcctaccagcagaacaacctggtccatccacgcccatcaccagtggatgacaacggaagacatgctcaccgtgtggaaccgcgtttggattgaggataatccctggatggaggacaaaacaccggtgaccacatgggaagatgtcccttacctgggaaagcgggaggaccaatggtgtggcagccttatcgggctgacctctagagctacgtgggcccagaacattctcaccgccatccaacaggtgcgcagcctgatcggcgatgaagagttcctggactacatgccctccatgaaacggtttagaaaggaggaagagtctgaaggagctatttggtga

SEQ ID NO: 20849 - RNA, 9873 nt, synthetic construct
  misc_feature 1..9873: note = derived and/or modified CDS sequence (opt5) from DENV-3__FJ562099__SS-prME
  source 1..9873: mol_type = other RNA
accagcctgtgcctcatgatgatgctgcccgccacacttgctttccacctgacgtccagagacggcgagcctcggatgatcgtggggaagaacgaacgcggaaaatctctcctgtttaagaccgccagcggcattaatatgtgtacacttatcgcgatggatctgggggagatgtgcgacgataccgtcacatacaaatgtccgctcattgctgaagttgagcccgaagacatcgattgctggtgtaacctgacctccacatgggtgacctatggaacgtgcaatcaggccggcgagcatagacgggacaagcgctctgtggccctggctcctcacgtcgggatgggactcgataccagaacacaaacctggatgagcgccgagggcgcttggcggcaggtggaaaaagttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagaataaacccacgctcgacatcgagctgcagaagaccgaagctacacaacttgccaccctgcgcaaactctgtattgagggaaagatcacaaacattaccacggattccagatgccctacacagggcgaagcgatcctgccggaggaacaggaccagaattatgtgtgtaaacacacctacgtggatcggggctgggggaacggatgcggccttttcgggaagggaagcctggtcacctgcgccaagtttcaatgtctcgagcccattgagggcaaagtggttcagtatgaaaatctgaagtacacagtgatcatcaccgtccacacaggggaccagcatcaggtgggaaacgacacgcaaggcgttaccgtggagattacacctcaggcttctaccgtcgaagccgtgctgcccgagtatggcacactcgggctggaatgctcccctcgcaccggacttgatttcaatgagatgatcctgctcacgatgaaaaacaaggcttggatggtccacagacagtggtttttcgacctgccccttccgtggaccagcggcgccacaaccgagacacctacctggaatcggaaagaactgctcgtgacgtttaagaacgcccatgctaaaaagcaagaggttgtggtcctggggtctcaggaaggagcgatgcacacagccctgaccggcgctacagagattcagaattccgggggcaccagcatcttcgccggacacctcaagtgtcgcctgaaaatggataagcttgaactgaaaggcatgtcttacgccatgtgcctcaacacctttgtgctgaagaaagaggtttccgagacacagcatgggacgattctgatcaaggtggaatacaagggagaggacgctccctgtaaaatccctttcagcaccgaagatggccaagggaaggcccacaacggaagacttattacagcgaatcccgtcgtgaccaaaaaggaggagcccgtgaacatcgaagctgagcctccgttcggcgaatccaatattgttatcgggattggcgacaaagccctcaagatcaactggtataagaaaggatctagcatcggcaagatgtttgaggccacagctcggggggccagacgcatggctattctgggagataccgcctgggacttcggctccgtcgggggagtgctgaatagcctcggcaaaatggtgcatcagatctttgggtctgcgtacacggccctgttctccggcgtcagctggattatgaagatcggaattggcgtgcttctgacatggatcgggctcaactctaaaaataccagcatgtccttttcttgcattgttatcggaatcattaccctgtatctgggcgctgtggtccaggccgatatggggtgtgtgatcaactggaagggaaaggaacttaaatgcggcagcgggattttcgttacaaatgaggtgcacacctggacagagcagtacaagtttcaagctgactcccccaaacggctcgccacggcgatcgccggcgcttgggaaaacggagtctgtggcattagaagcaccacacgcatggagaatctgctgtggaagcagatcgccaacgaactcaattatatcctgtgggagaacaatattaaacttaccgtggttgtgggggatatcattggagtcctggaacagggcaagcggacactcacccctcagcccatggagctgaaatactcttggaagacgtgggggaaggctaaaatcgtgaccgccgagacacaaaactccagcttcattatcgacggacctaacacccccgaatgcccgtctgcctccagagcttggaatgtgtgggaggtcgaagactatggctttggcgttttcacaaccaacatctggctgaagcttcgcgaggtgtacacacagagctgtgatcatcggctcatgtccgcggccattaaagacgaaagagctgtgcacgccgatatggggtactggatcgagtctcagaagaatggaagctggaaactggagaaggcctcctttattgaagtcaagacctgcacgtggcctaaatctcacacactgtggagcaacggcgtgctcgagtccgacatgatcattcccaagagcctggctgggcctatctctcagcataatcaccgccccggatatcatacccaaaccgccggcccttggcaccttgggaaactggaactcgatttcaactactgcgagggaacaaccgttgtgatcacggagaattgtggcacacggggcccctccctgagaaccacaaccgtcagcgggaagctgattcacgaatggtgctgtcgctcttgcacacttccgcctctccggtatatgggagaggacggctgttggtacgggatggaaatcagacccattaacgagaaagaagagaatatggtgaagtccctggttagcgcgggatctggcaaggtggataactttaccatgggggtcctgtgcctcgctatcctgttcgaggaagtgatgcggggaaaattcggcaagaaacatatgattgccggcgttctttttacgttcgtgctgctcctgagcgggcagatcacctggcgcgacatggcccacacactgattatgatcggatccaatgctagcgatagaatgggcatgggggtcacctatcttgccctgatcgcgacatttaagattcagcccttcctcgctctgggatttttcctccggaaactgacctctagagagaaccttctgctcggcgtggggctggccatggccacgacactgcaacttcctgaagacatcgagcagatggctaatggaattgccctgggcctcatgaccctgaagctcatcacacagtttgaaacctaccagctgtggaccgctcttgtgtccctgacatgtagcaacacgattttcaccctcacagtcgcctggcgcaccgcgacactgatcctggccggcgtttcccttctgccgctctgccaatctagctccatgcggaagaccgattggctgcccatgacggtggctgccatgggggtgcctcccctccctctgtttatcttctctcttaaagacacacccaagagacgcagctggcctctgaatgagggagtcatggctgtgggcctggtttccattctcgcctctagcctgcttagaaacgatgtgcccatggccgggccgctggtcgctggaggcctcctgatcgcgtgttatgtgattaccgggacctccgccgacctcacagttgagaaagctgccgacgtgacctgggaagaggaagccgagcagacaggagtcagccataacctgatgatcacggtggatgacgatggcaccatgcggattaaggacgatgaaacagagaatatccttaccgtcctgctgaaaacagctctcctgatcgtgtctggcgtttttccttactccattcccgccacccttctggtgtggcacacgtggcagaagcagacccaacgcagcggggtcctctgggacgtgccttctcccccggagacacagaaagcggaactggaggaaggagtttacagaatcaagcagcagggcattttcgggaagacccaagtgggagtcggcgtgcagaaagagggggtgtttcatacaatgtggcacgttacccggggagctgtcctcacacacaacggcaagcgcctggagcctaattgggcctccgtgaaaaaggatcttatcagctatggcgggggatggagactgtctgcccagtggcaaaaaggcgaagaggtgcaggtcattgctgtggaacccgggaagaaccctaagaatttccagacgatgcccggaatcttccagaccacaaccggcgagattggggccatcgcgctggactttaaacccggaacctccggcagccctatcattaaccgggaaggcaaggttgtggggctctacggaaatggcgtcgtgacaaaaaacgggggatatgtttccggcatcgctcaaacgaatgccgagccggatgggcccacccctgagctggaagaggaaatgttcaagaaacgcaaccttacaattatggacctgcatcccggcagcggaaagaccagaaagtacctccctgccatcgtgcgggaggctattaaacgcagactgcggacactcatcctggcccccaccagagtcgtggctgccgaaatggaggaggcgcttaagggcctgcctatccgctatcagacgacagccaccaaatctgaacacaccgggcgggagattgttgatctgatgtgccatgctacatttaccatgagactcctgagcccggtgcgcgtccccaattacaaccttatcattatggacgaagcccacttcacagatcctgcttccatcgccgcccggggatatatttctaccagagtgggcatgggggaggctgcggccatctttatgacggctacaccccctggaaccgccgaagccttcccccagagcaatgctccgatccaggacgaggagcgcgacattcctgaacggtcctggaactctggcaatgagtggatcacagattttgtggggaagaccgtctggttcgttcccagcattaaagccggcaacgacatcgcgaactgtctgagaaagaatggaaagaaagtgattcaactctcccgcaagacgtttgataccgaataccagaaaacaaagctgaacgactgggatttcgtggtcaccacagacatctctgagatgggcgctaattttaaagccgatcgggtgattgaccccagacggtgcctgaagcctgttatcctcaccgatgggcccgagcgcgtgatccttgccggacctatgccggtcacagctgccagcgcggcccagagacggggccgcgtggggagaaacccccagaaggaaaatgaccaatacattttcaccggacagcctctgaacaatgatgaggaccatgctcactggacggaagccaaaatgctgctcgacaacatcaatacacccgagggcattatccctgctctgttcgaacccgagcgggagaagtccgccgctattgatggggaatatagacttaaaggcgagagccgcaagacctttgttgaactgatgcggagaggagacctcccggtgtggctggcccacaaagtcgcgtctgagggcatcaagtacaccgatcgcaaatggtgcttcgacggggaacggaacaatcagatcctggaggagaacatggatgtggaaatttggacaaaggagggagaaagaaagaaactccgccctcggtggcttgacgccagaacctattccgatcccctggctctgaaggagtttaaagacttcgccgctggccgcaagagcatcgccctcgatctggtcacagaaattgggagagtgccttctcatcttgcctaccggacgcgcaatgctctggacaacctcgttatgctgcacacctccgagcatggaggcagagcgtatcggcacgccgtggaggaactgcccgagacaatggaaaccctccttctgctgggcctcatgatcctgcttacagggggagctatgctgtttctcattagcggcaaagggatcggaaagacctccatcggcctgatttgtgtgatcgtctctagcgggatgctgtggatggccgatgttcctctccagtggattgcctccgctatcgtgcttgagttctttatgatggtgctgctgattcccgagccggaaaagcaacgcacgcctcaggacaatcagctcgcctacgtcgtgatcggaattctgacccttgcggccatcgttgctgccaacgagatgggcctgctcgaaacaaccaaaagagatctgggcatgagcaaggagcccggggtggtctctcccacatcctatctggacgtggacctccaccctgctagcgcctggaccctttacgcggtcgccacgacagtgatcaccccgatgctgcggcatacaattgaaaattctaccgctaacgttagcctggccgctatcgccaaccaagctgtggtcctcatgggactggataaaggctggcccatttccaagatggaccttggggtgcctctgctcgccctgggatgctactctcaggttaatcccctgaccctcacagcggccgtgcttctgctggtcacgcactatgctatcattggccctgggctccaggccaaagctaccagagaggcccagaagcgcacagccgcgggaatcatgaagaaccccaccgtggatggcatcatgacaattgacctggatcctgtgatctacgacagcaaattcgagaagcaacttggccaggttatgctgctcgtcctgtgtgctgtgcagctgctccttatgcggacctcctgggccctgtgcgaagctctgacgctcgccacagggccgattaccaccctgtgggagggatctcccggcaaattttggaatacaaccatcgccgtgagcatggctaacattttcagagggtcctatcttgccggagcgggcctggcctttagcatcatgaagtctgtcgggacaggacgccggggcacgggctcccagggggaaaccctcggagagaaatggaagaagaaactgaatcaactgagcagaaaggaattcgatctctacaaaaagtccggcatcacagaggttgaccggaccgaggctaaagaagggcttaagcgcggagagacaacccatcacgccgtgtctagaggcagcgctaaactgcagtggtttgtggaacggaacatggtcattcctgaggggcgcgtgatcgatctgggatgtggcagaggcgggtggtcctattactgcgccggactcaagaaggttacggaagtgcggggctataccaaagggggacccggccatgaggagcctgtccccatgtctacatacgggtggaatattgtgaagctgatgagcggaaaagacgttttctaccttccgcctgaaaagtgtgataccctgctctgcgacatcggcgagtccagcccctctcccacagtggaagagtcccgcaccattagagtcctgaaaatggtggagccttggctgaagaacaatcagttctgtatcaaggtgctcaacccctatatgcctacagtcattgaacaccttgagcggctgcagcgcaaatacggcgggatgctggttagaaatccgctcagccggaactctacccacgaaatgtattggatctccaatggaacgggcaacatcgtgagctctgtgaatatggtcagcagactgcttctgaaccgctttacaatgacccatcggagacccaccattgagaaggatgtggacctcggggcgggaacacgccacgttaacgccgaacctgagacgcccaatatggacgtgatcggcgagcggattaaaagaatcaaggaagagcattcctctacctggcactacgatgacgaaaacccttataaaacatgggcttaccacgggagctatgaggtcaaggccaccggatccgctagctccatgattaatggcgtggttaagctgctgacaaaaccctgggatgtggtcccgatggtgacccaaatggccatgacagacaccacgcctttcggccagcagcgcgtttttaaggaaaaagtggatacccggacacccagacctatgcccgggacccgcaaggtcatggagatcacagctgagtggctctggcggaccctgggaagaaacaaaaagcctcgcctttgcacgcgggaagagttcacaaagaaagtgagaaccaatgccgcgatgggcgccgtctttacagaagagaaccaatgggactctgctcgcgccgctgtggaagatgaggagttctggaagctggttgacagagaacgggagctccataaactggggaagtgtggaagctgcgtgtacaatatgatgggcaaacgcgaaaagaaacttggggagtttggcaaggccaagggatccagagccatctggtacatgtggctgggcgcgcggtatctcgagttcgaagctctggggtttctgaacgaggatcactggttctctagagaaaatagctactccggagtcgagggcgaagggctccataaactgggatatattcttcgggacatctctaagattcccggcggggccatgtacgccgatgacaccgctggctgggacacgcgcatcaccgaggatgacctgcacaacgaggaaaaaattacacagcagatggatccggagcatagacagctcgccaatgctatctttaagctgacctatcaaaacaaagtggtgaaggttcagcggcctacacccaagggaaccgtgatggacatcattagccgcaaagatcagagaggctccgggcaggtcggaacatacggccttaataccttcacgaacatggaagcccaactggtgcggcagatggagggggaaggagttctcagcaaggcggacctggagaatccccacctgctcgagaaaaagatcacacagtggctggaaaccaaaggcgtggagcgccttaagagaatggccatttctggggatgactgcgtcgtgaagcctatcgatgaccggtttgctaacgccctgctcgctctgaacgatatgggcaaagtccgcaaggacattccgcagtggcaaccctccaaaggatggcacgattggcagcaggtgcctttctgtagccatcacttccatgaacttatcatgaaggacggcagaaaactggttgtgccctgccggcctcaggacgagctcatcgggcgcgccagaatttctcaaggagcgggctggtccctgaaggaaaccgcctgtctggggaaggcttatgcccagatgtggagcctcatgtactttcaccggcgcgatctgagacttgcttctaatgccatctgctccgctgtccccgtgcactggattcctacaagccggaccacatggtccatccatgcccaccatcagtggatgacgaccgaggacatgctgacagtttggaacagagtgtggattgaggataatccctggatggaagacaaaaccccggtcacaacctgggaggatgtgccttacctcggaaagcgcgaagaccaatggtgtggcagcctgatcgggcttacgtctcgggcgacctgggcccagaacattctgacagctatccagcaggtgagaagcctcatcggcgatgaggagttcctggactatatgccctccatgaaacgctttcggaaggaagaggaatctgagggagccatttggtga

SEQ ID NO: 20850 - RNA, 9873 nt, synthetic construct
  misc_feature 1..9873: note = derived and/or modified CDS sequence (opt5) from DENV-3__KF955457__SS-prME
  source 1..9873: mol_type = other RNA
accagcctgtgcctcatgatgatgctgcccgccacacttgctttccacctgacgtcccgggacggcgagcctcggatgatcgtggggaagaatgaacgcggaaagtctctcctgtttaagaccgccagcggcattaatatgtgtacacttatcgcgatggatctgggggagatgtgcgacgataccgtcacatacaagtgtccgctcattgctgaagttgagcccgaagacatcgattgctggtgtaacctgacctccacatgggtgacctatggaacgtgcaatcaggccggcgagcatcggcgggacaagcgctctgtggccctggctcctcacgtcgggatgggactcgataccagaacacagacctggatgagcgccgagggcgcttggagacaggtggaaaaggttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagaataagcccacgctcgacatcgagctgcagaagaccgaagctacacaacttgccaccctgcgcaaactctgtattgagggaaagatcacaaacattaccacggattccagatgccctacacagggcgaagcgatcctgccggaggaacaggaccagaattatgtgtgtaaacacacctacgtggatcggggctgggggaacggatgcggccttttcgggaagggaagcctggtcacatgcgccaagtttcaatgtctcgagcccattgagggcaaagtggttcagtatgaaaatctgaagtacacagtgatcatcaccgtccacacaggggaccagcatcaggtgggaaacgacacgcaaggcgctaccgttgagattacacctcaggcctctaccgtggaagctgtcctgcccgagtatggcacactcgggctggaatgctcccctcgcaccggacttgatttcaatgagatgatcctgctcacgatgaaaaacaaggcctggatggtgcacagacagtggtttttcgacctgccccttccgtggaccagcggcgccacaaccgagacacctacctggaatcggaaagaactgctcgtcacgtttaagaacgctcatgcgaaaaagcaagaggtggttgtgctggggtctcaggaaggagccatgcacacagctctgaccggcgccacagagattcagaatagcgggggcaccagcatcttcgccggacacctcaagtgtcgcctgaaaatggataaacttgaactgaaaggcatgtcttacgctatgtgcctcaacacctttgtcctgaagaaagaggtgtccgagacacagcatgggacgattctgatcaaggttgaatacaagggagaggacgccccctgtaaaatccctttcagcaccgaagatggccaagggaaggcgcacaacggaagacttattacagctaatcccgtggtcaccaaaaaggaggagcccgtgaacatcgaagccgagcctccgttcggcgaatccaatattgtgatcgggattggcgacaaagccctcaagatcaactggtataagaaaggatctagcatcggcaagatgtttgaggctacagccagaggggctagacgcatggccattctgggagataccgcgtgggacttcggctccgttgggggagtcctgaatagcctcggcaaaatggtgcatcagatctttgggtctgcctacacggctctgttctccggcgtgagctggattatgaagatcggaattggcgtccttctgacatggatcgggctcaactctaaaaataccagcatgtccttttcttgcattgtgatcggaatcattaccctgtatctgggcgccgttgtgcaggctgatatggggtgtgccatcaactggaagggaaaggaacttaaatgcggcagcgggattttcgtcacaaatgaggtgcacacctggacagagcagtacaagtttcaagcggactcccccaaacggctcgccacggctatcgccggcgcttgggaaaacggagtttgtggcattagaagcaccacacgcatggagaatctgctgtggaagcagatcgccaacgaactcaattatatcctgtgggagaacaatattaaacttaccgtggtcgtgggggatatcattggagttctggaacagggcaagcggacactcacccctcagcccatggagctgaaatactcttggaagacgtgggggaaggccaaaatcgtgaccgctgagacacaaaacttctcctttattatcgacggacctaacacccccgaatgcccgagcgcgtctagagcctggaatgtctgggaggtggaagactatggcttcggcgtgtttacaaccaacatctggctgaaacttcgcgaggtctacacacagtcctgtgatcatcggctcatgagcgctgccattaaagacgaaagagccgttcacgctgatatggggtactggatcgagtcccagaagaatggatcttggaaactggagaaggccagcttcattgaagtgaagacctgcacgtggcctaaatcccacacactgtggtctaacggcgtgctcgagagcgacatgatcattcccaagtccctggcggggcctatcagccagcataatcaccgccccggatatcatacccaaaccgctggcccttggcaccttgggaaactggaactcgattttaactactgcgagggaacaaccgtcgtgatcacggaggactgtggcacacggggcccctctctgagaaccacaaccgtttccgggaagctgattcacgaatggtgctgtcgcagctgcacacttccgcctctccggtatatgggagaggatggctgttggtacgggatggaaatcagacccattaatgagaaagaagagaacatggtgaagtctctggtctccgccggaagcggcaaggtggacaatttcaccatgggggttctgtgcctcgccatcctgttcgaggaagtgatgcggggaaaatttggcaagaaacatatgattgctggcgtccttttcacgtttgtgctgctcctgtctgggcagatcacctggcgcgatatggcccacacactgattatgatcggaagcaacgcgtccgacagaatgggcatgggggttacctatcttgctctgatcgccacattcaagattcagccctttctcgccctgggattctttctccggaaactgaccagcagagagaatcttctgctcggcgtggggctggctatggccacgacactgcaacttcctgaagatatcgagcagatggctaacggaattgccctgggcctcatgaccctgaagctcatcacacagttcgaaacctaccagctgtggaccgcgcttgtctctctgacatgttccaatacgatttttaccctcacagtggcctggcgcaccgctacactgatcctggccggcgtgagccttctgccgctctgccaatcctctagcatgcggaagaccgactggctgcccatgacggtcgctgccatgggggttcctcccctccctctgttcatcttttcccttaaagatacacccaagagacgctcttggcctctgaacgagggagtgatggccgtgggcctggtcagcattctcgcttcctctctgcttagaaatgacgtgcccatggcggggccgctggttgccggaggcctcctgatcgcttgttatgtgattaccgggaccagcgccgacctcacagtcgagaaagccgctgatgtgacctgggaagaggaagccgagcagacaggagtttcccataacctgatgatcacggtggacgatgacggcaccatgcggattaaggatgacgaaacagagaacatccttaccgtcctgctgaaaacagcgctcctgatcgtgagcggcattttcccttactctatccccgctacccttctggtctggcacacgtggcagaagcagacccaacgctccggggtgctctgggatgttccttctcccccggagacacagaaagccgaactggaggaaggagtgtacagaattaagcagcagggcatctttgggaagacccaagtcggagtgggcgttcagaaagagggggtgttccatacaatgtggcacgtcacccggggagccgtgctcacacacaatggcaagcgcctggagcctaactgggcttccgtgaaaaaggaccttatttcctatggcgggggatggagactgagcgcccagtggcaaaaaggcgaagaggttcaggtcatcgcggtggaacccgggaagaatcctaagaacttccagacgatgcccggaatttttcagaccacaaccggcgagatcggggctatcgccctggatttcaaacccggaacctctggctcccctattatcaatcgggaaggcaaggtggtcgggctctacggaaacggcgtggttaccaagaatgggggatatgtgagcggcattgcccaaacgaacgctgagccggacgggcccacccctgagctggaagaggaaatgtttaagaaacgcaatcttacaatcatggatctgcatcccggctccggaaagaccagaaagtacctccctgccattgtccgggaggctatcaaacgcagactgcggacactcatcctggcccccaccagagtggttgcggccgaaatggaggaggctcttaagggcctgcctattcgctatcagacgacagccaccaaaagcgaacacaccgggcgggagatcgtggacctgatgtgccatgctacattcaccatgagactcctgtctccggtccgcgtgcccaactacaatcttattatcatggatgaagcccactttacagaccctgccagcattgctgcgcggggatatatctccaccagagttggcatgggggaggccgctgccatcttcatgacggccacaccccctggaaccgctgaagcctttccccagtctaacgcgccgattcaggacgaggagcgcgatatccctgaacggagctggaactccggcaacgagtggattacagacttcgtggggaagaccgtctggtttgtgccctctatcaaagctggcaatgatattgccaactgtctgagaaagaacggaaagaaagtgatccaactcagccgcaagacgttcgacaccgaataccagaaaacacggctgaatgattgggactttgtcgttaccacagatatttccgagatgggcgccaacttcaaggctgacagagtgatcgatccccggcgctgcctgaaacctgtgatcctcaccgacgggcccgagagagtcattcttgccggacctatgccggtgacagcggcctctgctgcccagcggcgcggcagagttgggcggaatccccagaaggaaaacgatcaatacatcttcaccggacagcctctgaataacgacgaggaccatgctcactggacggaagccaagatgctgctcgataatattaacacacccgagggcatcattcctgctctgtttgaacccgagagagagaaaagcgccgcgatcgacggggaatatcgccttaagggcgagtcccggaaaaccttcgtggaactgatgagacgcggagatctcccggtctggctggcccacaaggtggctagcgagggcatcaaatacaccgaccggaagtggtgctttgatggggaaagaaataaccagattctggaggagaatatggacgttgaaatctggacaaaagagggagaacgcaagaagctccggcctagatggcttgatgcccgcacctattctgaccccctggctctgaaagagttcaaggattttgccgccggcagaaaatccattgctctcgacctggtgacagaaatcgggcgggtccctagccatcttgcgtaccgcacgagaaacgccctggataatctcgtgatgctgcacacctctgagcatggaggccgggcttatcgccacgccgtcgaggaactgcccgagacaatggaaaccctccttctgctgggcctcatgattctgcttacagggggagccatgctgttcctcatctccggcaaggggatcggaaaaaccagcattggcctgatctgtgtgattgtttcctctgggatgctgtggatggctgacgtgcctctccagtggatcgccagcgcgattgtgcttgagtttttcatgatggtcctgctgatccccgagccggaaaagcaaagaacgcctcaggataaccagctcgcctacgttgtgattggaatcctgacccttgctgccatcgtggctgccaatgagatgggcctgctcgaaacaaccaagcgggacctgggcatgtccaaagagcccggggtcgtgagccccacatcttatctggacgttgatctccaccctgcgtccgcctggaccctttacgctgtggccacgacagtcattaccccgatgctgagacatacaatcgaaaacagcaccgctaatgtgtctctggccgctattgccaaccaagcggtcgtgctcatgggactggacaagggctggcccatcagcaaaatggatcttggggttcctctgctcgccctgggatgctactcccaggtgaaccccctgaccctcacagctgccgtccttctgctggtgacgcactatgctattatcggccctgggctccaggccaaggccacccgcgaggcgcagaaacggacagctgccggaatcatgaagaatcccaccgttgacggcattatgacaatcgatctggaccctgtgatttacgattctaagtttgagaaacaacttggccaggtcatgctgctcgtgctgtgtgctgtgcagctgctccttatgagaaccagctgggccctgtgcgaagccctgacgctcgctacagggccgatcaccaccctgtgggagggatcccccggcaagttctggaacacaaccattgccgtttctatggcgaatatctttcgcgggagctatcttgccggagctggcctggccttctccatcatgaaaagcgtcgggacaggacggagaggcacgggctctcagggggaaaccctcggagagaagtggaaaaagaagctgaaccaactgtcccggaaagaatttgacctctacaagaaaagcggcattacagaggtggatcgcaccgaggctaaggaagggcttaaaagaggagagacaacccatcacgccgtgtcccggggctctgcgaagctgcagtggttcgtcgaccgcaatatggttatccctgaagggagagtgattgatctgggatgtggccggggcgggtggagctattactgcgccggactcaaaaaggtgacggaggtccgcggctataccaaaggcgggcccgggcatgaagaacctgtgcccatgtccacatacgggtggaacctggttaaacttatgtctggaaaggacgtgttctacctgccgcctgagaaatgtgataccctcctgtgcgacatcggcgaaagctcccccagccccacagtcgaggaatctagaaccattcgggtgctgaagatggttgagccttggctcaaaaataaccagttttgtatcaaggtgcttaatccctatatgcctacagtcattgagcacctggaacgcctgcagagaaagtacggcgggatgctcgtgcggaacccgctgtccagaaatagcacccacgagatgtattggatctctaacggaacgggcaatatcgtgtccagcgtcaacatggtttctcgccttctgctcaatcggttcacaatgacccatagacgccccaccattgaaaaagacgtggatctgggggctggaacacggcacgtgaacgccgagcctgaaacgcccaacatggacgtcatcggcgagagaattaagcgcatcaaagaggaacatagctccacctggcactacgatgacgagaatccttataagacatgggcttaccacgggtcttatgaagtgaaagccaccggaagcgcttccagcatgattaacggcgttgtgaagctgctcacaaagccctgggatgtcgtgccgatggttacccaaatggccatgacagacaccacgccttttggccagcagcgggtgttcaaagagaaggtcgataccagaacaccccgccctatgcccgggacccggaaagtgatggaaatcacagcggagtggctgtggagaacccttggacgcaataagaaacctcggctgtgcacgagagaggaatttacaaagaaggttcgcaccaacgccgctatgggcgccgtgttcacagaggaaaatcaatgggactccgctagagccgccgtcgaggatgaagagttttggaaactcgtggaccgggagcgcgaactgcataaacttgggaaatgtggatcttgcgtctacaacatgatgggcaagagagagaaaaagctgggggagttcggcaaagcgaagggaagccgggctatctggtacatgtggctcggcgccagatatctggagtttgaggccctggggttcctcaatgaagatcactggttttcccgggagaactcttacagcggagtggaaggcgaggggctgcataaacttggatatattctgcgcgacatctccaaaattcccggcggggctatgtacgccgacgataccgctggctgggacacgagaatcaccgaagatgacctccacaatgaggagaagattacacagcagatggatccggaacatcggcagctggccaacgcgatcttcaaacttacctatcaaaataaggttgtgaaagtccagcgccctacacccaagggaaccgtgatggacatcatttctagaaaggatcagcggggcagcggacaggtgggaacatacggcctgaacacctttacgaatatggaggcccaactcgttcgccagatggaaggggagggagtgctgtccaaagctgacctggaaaacccccacctcctggagaagaaaatcacacagtggcttgagaccaagggcgtcgaaagactgaaacggatggccattagcggggatgactgcgtggttaagcctatcgatgaccgcttcgctaatgccctcctggcgcttaacgatatgggcaaggtgagaaaagacattccgcagtggcaaccctctaagggatggcacgactggcagcaggtccctttctgttcccatcactttcatgagctgatcatgaaagatggccggaagctcgtggtcccctgccgccctcaggacgaactgatcgggagagcccggattagccaaggagctggctggtctctgaaagagaccgcctgtctcgggaaggcttatgcccagatgtggtccctgatgtacttccaccgcagagatcttcggctggctagcaacgccatctgctctgcggtgcccgttcactggattcctacatccagaaccacatggagcatccatgcccaccatcagtggatgacgaccgaagacatgctcacagtgtggaatcgcgtctggattgaggataacccctggatggaggacaagaccccggtgacaacctgggaagatgttccttacctgggaaaacgggaggaccaatggtgtggctcccttatcgggctgacgagcagagctacctgggcccagaatattctcacagccatccaacaggtgcgctctctgatcggcgatgaagagtttctggactatatgcccagcatgaagcggttcagaaaagaggaagagtccgaaggagctatttggtga

SEQ ID NO: 20851 - RNA, 9873 nt, synthetic construct
  misc_feature 1..9873: note = derived and/or modified CDS sequence (opt5) from DENV-3__FJ562100__SS-prME
  source 1..9873: mol_type = other RNA
accagcctgtgcctcatgatgatgctgcccgccacccttgctttccacctgacgtcccgggacggcgaacctcggatgatcgtggggaagaacgaacgcggaaagtctctcctgtttaagaccgccagcggcattaatatgtgtacacttatcgcgatggatctgggggaaatgtgcgacgataccgtcacatacaagtgtccgctcattgctgaagttgagcccgaagacatcgattgctggtgtaacctgacctccacatgggtgacctatggaacgtgcaatcaggccggcgagcatcggcgggacaagcgctctgtggccctggctcctcacgtcgggatgggactcgataccagaacacagacctggatgagcgccgagggcgcttggagacaggtggaaaaggttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagaataaacccacgctcgacatcgagctgcagaagaccgaagctacacagcttgccaccctgcgcaaactctgtattgagggaaagatcacaaacattaccacggattccagatgccctacacagggcgaagcgatcctgccggaggaacaggaccagaattatgtgtgtaaacacacctacgtggatcggggctgggggaacggatgcggccttttcgggaagggaagcctggtcacatgcgccaagtttcaatgtctcgagcccattgagggcaaagtggttcagtatgaaaatctgaagtacacagtgatcatcaccgtccacacaggggaccagcatcaggtgggaaacgacacgcaaggcgttaccgtggagattacacctcaggcttctaccgtcgaagccatcctgcccgagtatggcacactcgggctggaatgctcccctcgcaccggacttgatttcaatgagatgattctgctcacgatgaaaaacaaggcttggatggtgcacagacagtggtttttcgacctgccccttccgtggaccagcggcgccacaaccgagacacctacctggaatcggaaagaactgctcgtcacgtttaagaacgcccatgctaaaaagcaagaggtggttgtgctggggtctcaggaaggagcgatgcacacagccctgaccggcgctacagagatccaaaattccgggggcaccagcattttcgccggacacctcaagtgtcgcctgaaaatggataaacttgaactgaaaggcatgtcttacgccatgtgcctcaacacctttgtcctgaagaaagaggtgtccgagacacagcatgggacgatcctgatcaaggttgaatacaagggagaggacgctccctgtaaaattcctttcagcaccgaagatggccaagggaaggcccacaacggaagacttatcacagcgaatcccgtggtcaccaaaaaggaggagcccgtgaacattgaagctgagcctccgttcggcgaatccaatatcgtgattgggatcggcgacaaagccctcaagatcaactggtataagaaaggatctagcattggcaagatgtttgaggccacagctagaggggccagacgcatggctatcctgggagataccgcctgggacttcggctccgttgggggagtcctgaatagcctcggcaaaatggtgcatcagatttttgggtctgcgtacacggccctgttctccggcgtgagctggatcatgaagattggaatcggcgtccttctgacatggattgggctcaactctaaaaataccagcatgtccttttcttgcatcgtgatcggaattatcaccctgtatctgggcgctgttgtgcaggccgatatggggtgtgctattaactggaagggaaaggaacttaaatgcggcagcgggatcttcgtcacaaatgaggtgcacacctggacagagcagtacaagtttcaagccgactcccccaaacggctcgcgacggccattgctggcgcctgggaaaacggagtttgtggcatcagaagcaccacacgcatggagaatctgctgtggaagcagatcgctaacgaactcaattatattctgtgggagaacaatatcaaacttaccgtggtcgtgggggatattatcggagttctggaacagggcaagcggacactcacccctcagcccatggagctgaaatactcttggaagacgtgggggaaggccaaaattgtgaccgccgagacacaaaactccagcttcatcatcgacggacctaacacccccgaatgcccgtctgcttccagagcgtggaatgtctgggaggtggaagactatggctttggcgtgttcacaaccaacatttggctgaaacttcgcgaggtctacacacagagctgtgatcatcggctcatgtccgccgctatcaaagacgaaagagccgttcacgccgatatggggtactggattgagtctcagaagaatggaagctggaaactggagaaggcttcctttatcgaagtgaagacctgcacgtggcctaaatctcacacactgtggagcaacggcgtgctcgagtccgacatgattatccccaagagcctggccgggcctatctctcagcataatcaccgccccggatatcatacccaaaccgcgggcccttggcaccttgggaaactggaactcgatttcaactactgcgagggaacaaccgtcgtgattacggagaattgtggcacacggggcccctccctgagaaccacaaccgttagcgggaagctgatccacgaatggtgctgtcgctcttgcacacttccgcctctccggtatatgggagaggacggctgttggtacgggatggaaattagacccatcaacgagaaagaagagaatatggtgaagtccctggtcagcgctggatctggcaaggtggataactttaccatgggggttctgtgcctcgccattctgttcgaggaagtgatgcggggaaaattcggcaagaaacatatgatcgccggcgtcctttttacgttcgtgctgctcctgagcgggcagattacctggcgcgacatggctcacacactgatcatgatcggatccaatgccagcgatagaatgggcatgggggttacctatcttgcgctgattgctacatttaagatccagcccttcctcgccctgggatttttcctccggaaactgacctctagagagaaccttctgctcggcgtggggctggccatggctacgacactgcaacttcctgaagacattgagcagatggccaatggaatcgctctgggcctcatgaccctgaagctcattacacagtttgaaacctaccagctgtggaccgcccttgtctccctgacatgtagcaacacgatcttcaccctcacagtggcgtggcgcaccgccacactgatcctggctggcgtgtcccttctgccgctctgccaatctagctccatgcggaagaccgattggctgcccatgacggtcgccgctatgggggttcctcccctccctctgtttattttctctcttaaagacacacccaagagacgcagctggcctctgaatgagggagtgatggccgtgggcctggtctccatcctcgcctctagcctgcttagaaacgatgtgcccatggctgggccgctggttgcgggaggcctcctgattgcctgttatgtgatcaccgggacctccgctgacctcacagtcgagaaagccgccgacgtgacctgggaagaggaagctgagcagacaggagttagccataacctgatgattacggtggatgacgatggcaccatgcggatcaaggacgatgaaacagagaatatccttaccgtcctgctgaaaacagccctcctgattgtgtctggcatctttccttactccattcccgcgacccttctggtctggcacacgtggcagaagcagacccaacgcagcggggtgctctgggacgttccttctcccccggagacacagaaagctgaactggaggaaggagtgtacagaatcaagcagcagggcattttcgggaagacccaagtcggagtgggcgttcagaaagagggggtgtttcatacaatgtggcacgtcacccggggagccgtgctcacacacaacggcaagcgcctggagcctaattgggcctccgtgaaaaaggatcttatcagctatggcgggggatggagactgtctgctcagtggcaaaaaggcgaagaggttcaggtcattgccgtggaacccgggaagaaccctaagaatttccagacgatgcccggaatcttccagaccacaaccggcgagatcggggcgattgctctggactttaaacccggaacctccggcagccctatcattaaccgggaaggcaaggtggtcgggctctacggaaatggcgtggttaccaagaacgggggatatgtgtccggcatcgcccaaacgaatgccgagccggatgggcccacccctgagctggaagaggaaatgttcaagaaacgcaaccttacaattatggacctgcatcccggcagcggaaagaccagaaagtacctccctgctatcgtccgggaggccatcaaacgcagactgcggacactcattctggctcccaccagagtggttgccgcggaaatggaggaggcccttaagggcctgcctatccgctatcagacgacagctaccaaatctgaacacaccgggcgggagattgtggatctgatgtgccatgccacatttaccatgagactcctgagcccggtccgcgtgcccaattacaaccttatcattatggacgaagctcacttcacagatcctgcctccatcgccgctcggggatatatctctaccagagttggcatgggggaggcggccgctatttttatgacggccacaccccctggaaccgccgaggctttcccccagagcaatgccccgatccaggacgaggagcgcgacattcctgaacggtcctggaactctggcaatgagtggatcacagattttgtggggaagaccgtctggttcgtgcccagcattaaagcgggcaacgacatcgctaactgtctgagaaagaatggaaagaaagtgattcaactctcccgcaagacgtttgataccgaataccagaaaacacggctgaacgactgggatttcgtcgttaccacagacatctctgagatgggcgccaattttaaggccgatagagtgatcgacccccggcgctgcctgaaacctgtgattctcaccgatgggcccgagagagtcatccttgctggacctatgccggtgacagccgcgagcgccgctcagcggcgcggcagagttgggcggaacccccagaaggaaaatgaccaatacattttcaccggacagcctctgaacaatgatgaggaccatgcccactggacggaagctaagatgctgctcgacaacatcaatacacccgagggcattatccctgccctgttcgaacccgagagagagaaatccgctgccatcgatggggaatatcgccttaagggcgagagccggaaaacctttgtggaactgatgagacgcggagacctcccggtctggctggcgcacaaggtggcctctgagggcattaaatacaccgatcggaagtggtgcttcgacggggaaagaaacaatcagatcctggaggagaacatggatgttgaaatttggacaaaagagggagaacgcaagaagctccggcctagatggcttgacgctcgcacctattccgatcccctggccctgaaagagtttaaggacttcgctgccggcagaaaaagcatcgccctcgatctggtgacagaaattgggcgggtcccttctcatcttgcttaccgcacgagaaatgcgctggacaacctcgtgatgctgcacacctccgagcatggaggccgggcctatcgccacgctgtcgaggaactgcccgagacaatggaaaccctccttctgctgggcctcatgatcctgcttacagggggagccatgctgtttctcatcagcggcaaggggattggaaaaacctccatcggcctgatttgtgtgacggtttctagcgggatgctgtggatggccgatgtgcctctccagtggatcgcttccgccattgtgcttgagttctttatgatggtcctgctgatccccgagccggaaaagcaaagaacccctcaggacaatcagctcgcgtacgttgtgattggaatcctgacacttgccgctatcgtggccgctaacgagatgggcctgctcgaaaccacaaagcgggatctgggcatgagcaaagagcccggggtcgtgtctcccacctcctatctggacgttgacctccaccctgccagcgcgtggacgctttacgccgtggctacaaccgtcattacaccgatgctgagacataccatcgaaaattctaccgccaacgtgagcctggctgccattgctaaccaagccgtcgtgctcatgggactggataagggctggcccatctccaaaatggaccttggggttcctctgctcgcgctgggatgctactctcaggtgaatcccctgacactcacggccgctgtccttctgctggtgacccactatgccattatcggccctgggctccaggctaaggccacacgcgaggcccagaaacggaccgcggctggaatcatgaagaaccccacagttgatggcattatgaccatcgacctggatcctgtgatttacgacagcaagttcgagaaacaacttggccaggtcatgctgctcgtgctgtgtgccgtgcagctgctccttatgagaacgtcctgggctctgtgcgaagccctgacactcgccaccgggccgatcaccacactgtgggagggatctcccggcaagttttggaataccacaattgctgttagcatggccaacatcttccgcgggtcctatcttgcgggagccggcctggcttttagcatcatgaaatctgtcgggacgggacggagaggcaccggctcccagggggaaacactcggagagaagtggaaaaagaagctgaatcaactgagccggaaagagttcgatctctacaagaaatccggcattaccgaggtggaccgcacagaggccaaggaagggcttaaaagaggagagaccacgcatcacgctgtgtctcggggcagcgccaagctgcagtggtttgtcgaacgcaacatggttatccctgaggggagagtgattgatctgggatgtggccggggcgggtggtcctattactgcgcgggactcaaaaaggtgaccgaagtccgcggctatacaaaaggcgggcccgggcatgaggagcctgtgcccatgtctacctacgggtggaatctggttaaacttatgagcggaaaggacgtgttctacctgccgcctgaaaaatgtgatacactcctgtgcgacatcggcgagtccagcccctctcccaccgtcgaagagtccagaacaattcgggtgctgaagatggttgagccttggctcaaaaacaatcagttctgtatcaaggtgcttaacccctatatgcctaccgtcattgaacacctggagcgcctgcagagaaagtacggcgggatgctcgtgcggaatccgctgagcagaaactctacgcacgaaatgtattggatctccaatggaacaggcaacatcgtgagctctgtcaatatggttagccgccttctgctcaaccggtttaccatgacccatagacgccccacaattgagaaagatgtggacctgggggccggaacgcggcacgtgaacgctgaacctgagacccccaatatggacgtcatcggcgagagaattaagcgcatcaaagaagaacattcctctacatggcactacgatgacgaaaacccttataagacctgggcctaccacgggagctatgaggtgaaagctacaggatccgccagctccatgattaatggcgttgtgaagctgctcaccaagccctgggatgtcgtgccgatggttacacaaatggctatgaccgacacgacccctttcggccagcagcgggtgtttaaagaaaaggtcgatacaagaacaccccgccctatgcccgggacacggaaagtgatggagatcaccgccgagtggctgtggagaacgcttggacgcaacaagaaacctcggctgtgcacaagagaagagttcaccaagaaggttcgcacaaatgcggccatgggcgctgtgtttaccgaagagaaccaatgggactctgccagagctgccgtcgaagatgaggagttctggaaactcgtggaccgggaacgcgagctgcataaacttgggaaatgtggaagctgcgtctacaatatgatgggcaagagagagaagaagctgggggagtttggcaaagccaagggatcccgggcgatctggtacatgtggctcggcgctagatatctggagttcgaagccctggggtttctcaacgaggatcactggttctctcgggaaaatagctactccggagtggagggcgaagggctgcataaacttggatatattctgcgcgacatctctaaaattcccggcggggccatgtacgctgatgacacggccggctgggacaccagaatcacagaggatgacctccacaacgaggaaaagattacccagcagatggatccggagcatcggcagctggctaatgccatctttaaacttacatatcaaaacaaggttgtgaaagtccagcgccctacccccaagggaacagtgatggacatcattagcagaaaggatcagcggggctccggacaggtgggaacctacggcctgaatacgttcacaaacatggaagcgcaactcgttcgccagatggagggggaaggagtgctgagcaaagccgacctggagaatccccacctcctggagaagaaaatcacccagtggcttgaaaccaagggcgtcgagagactgaaacggatggctatttctggggatgactgcgtggttaagcctatcgatgaccgctttgccaacgctctcctggcccttaacgatatgggcaaggtgagaaaagacattccgcagtggcaaccctccaagggatggcacgattggcagcaggtccctttctgtagccatcacttccatgaactgatcatgaaagacggccggaagctcgtggtcccctgccgccctcaggacgagctgatcgggagagcgcggatttctcaaggagccggctggtccctgaaagaaacagcttgtctcgggaaggcctatgctcagatgtggagcctgatgtactttcaccgcagagatcttcggctggcctctaatgctatctgctccgccgtgcccgttcactggattcctaccagcagaacaacgtggtccatccatgcgcaccatcagtggatgaccacagaggacatgctcaccgtgtggaaccgcgtctggattgaggataatccctggatggaagacaagacaccggtgaccacgtgggaggatgttccttacctgggaaaacgggaagaccaatggtgtggcagccttatcgggctgacctctagagccacatgggctcagaacattctcaccgccatccaacaggtgcgcagcctgatcggcgatgaggagttcctggactatatgccctccatgaagcggtttagaaaagaagaggaatctgagggagccatttggtga

SEQ ID NO: 20852 - RNA, 9873 nt, synthetic construct
  misc_feature 1..9873: note = derived and/or modified CDS sequence (opt5) from DENV-3__FJ547062__SS-prME
  source 1..9873: mol_type = other RNA
acctccctgtgcctgatgatgatgctgcccgccacacttgctttccacctgacgtcccgggacggcgaacctcggatgatcgtggggaagaacgaacgcggaaagtctctcctgtttaagaccgccagcggcattaatatgtgtacacttatcgcgatggatctgggggaaatgtgcgacgataccgtcacatacaagtgtccgctcattgctgaagttgagcccgaagacatcgattgctggtgtaacctgacctccacatgggtgacctatggaacgtgcaatcaggccggcgagcatagacgggacaagcgctctgtggccctggctcctcacgtcgggatgggactcgataccagaacacagacctggatgagcgccgagggcgcttggagacaggtggaaaaagttgagacatgggccctgcgccatcccggcttcaccattcttgcgctgtttctcgcccactacatctccacgtctctgacacagaaggtggtcatcttcattcttctgatgctcgtgacccctagcatgacaatgagatgtgttggggtgggaaaccgggactttgtcgaaggcctgtccggggctacctgggtggatgtggtcctggagcatggaggctgcgttaccacaatggccaagaataaacccacgctcgacatcgagctgcagaagaccgaagctacacaacttgccaccctgcgcaaactctgtattgaggggaagatcacaaacattaccacggatagcagatgccctacacagggagaagcgatcctgccggaggaacaggaccagaattatgtgtgtaaacacacctacgtggatcggggctggggcaacgggtgcggacttttcggcaaggggtctctggtcacatgcgccaagtttcaatgtctcgagcccattgagggaaaagtggttcagtatgaaaatctgaagtacacagtgatcatcaccgtccacacaggcgaccagcatcaggtggggaacgacacgcaaggagttaccgtggagattacacctcaggcttccaccgtcgaagccatcctgcccgagtatggcacactcggcctggaatgcagccctcgcaccgggcttgatttcaatgagatgattctgctcacgatgaaaaacaaggcttggatggtgcacagacagtggtttttcgacctgccccttccgtggacctctggagccacaaccgagacacctacctggaatcggaaagaactgctcgtcacgtttaagaacgcccatgctaaaaagcaagaggtggttgtgctgggctcccaggaaggggcgatgcacacagccctgaccggagctacagagatccagaatagcggcgggacctctattttcgccggccacctcaagtgtcgcctgaaaatggataaacttgaactgaaaggaatgtcctacgccatgtgcctcaacacctttgtcctgaagaaagaggtgagcgagacacagcatggcacgatcctgatcaaggttgaatacaagggggaggacgctccctgtaaaattcctttctccaccgaagatggacaaggcaaggcccacaacgggagacttatcacagcgaatcccgtggtcaccaaaaaggaggagcccgtgaacattgaagctgagcctccgttcggagaatctaatatcgtgattggcatcggggacaaagccctcaagatcaactggtataagaaaggcagctccattggaaagatgtttgaggccacagctcggggcgccagacgcatggctatcctgggggataccgcctgggacttcggaagcgttggcggggtcctcaattctctcggaaaaatggtgcatcagatttttggctccgcgtacacggccctgttcagcggggtgtcttggatcatgaagattggcatcggagtccttctgacatggattggcctcaacagcaaaaatacctccatgtcttttagctgcatcgtgatcgggattatcaccctgtatctgggagctgttgtgcaggccgatatgggctgtgctattaactggaaggggaaggaacttaaatgcggatccggcatcttcgtcacaaatgaggtgcacacctggacagagcagtacaagtttcaagccgacagccccaaacggctcgcgacggccattgctggggcctgggaaaacggcgtttgtggaatcagatctaccacacgcatggagaatctgctgtggaagcagatcgctaacgaactcaattatattctgtgggagaacaatatcaaacttaccgtggtcgtgggcgatattatcggggttctggaacagggaaagcggacactcacccctcagcccatggagctgaaatactcctggaagacgtggggcaaggccaaaattgtgaccgccgagacacaaaacagctctttcatcatcgacgggcctaacacccccgaatgcccgtccgctagcagagcgtggaatgtctgggaggtggaagactatggatttggcgtgttcacaaccaacatttggctgaaacttcgcgaggtctacacacagtcctgtgatcatcggctcatgtctgccgctatcaaagacgaaagagccgttcacgccgatatgggctactggattgagagccagaagaatgggtcctggaaactggagaaggcttcttttatcgaagtgaagacctgcacgtggcctaaaagccacacactgtggtccaacggagtgctcgagagcgacatgattatccccaagtctctggccggccctatctcccagcataatcaccgccccgggtatcatacccaaaccgcgggaccttggcaccttggcaaactggaactcgatttcaactactgcgaggggacaaccgtcgtgattacggagaattgtggaacacggggccccagcctgagaaccacaaccgtttctggcaagctgatccacgaatggtgctgtcgctcctgcacacttccgcctctccggtatatgggggaggacggatgttggtacggcatggaaattagacccatcaacgagaaagaagagaatatggtcaagagcctggtgtctgctgggagcggaaaggtggataactttaccatgggcgttctgtgcctcgccattctgttcgaggaagtgatgcgggggaaattcggaaagaaacatatgatcgccggcgtcctttttacgttcgtgctgctcctgtccggccagattacctggcgcgacatggctcacacactgatcatgatcgggagcaatgcctctgatagaatgggaatgggcgttacctatcttgcgctgattgctacatttaagatccagcccttcctcgccctggggtttttcctccggaaactgacctccagagagaaccttctgctcggagtgggcctggccatggctacgacactgcaacttcctgaagacattgagcagatggccaatgggatcgctctgggactcatgaccctgaagctcattacacagtttgaaacctaccagctgtggaccgcccttgtcagcctgacatgttccaacacgatcttcaccctcacagtggcgtggcgcaccgccacactgatcctggctggcgtgtctcttctgccgctctgccaaagctcctctatgcggaagaccgattggctgcccatgacggtcgccgctatgggcgttcctcccctccctctgtttattttcagccttaaagacacacccaagagacgctcctggcctctgaatgagggggtgatggccgtgggactggtctctatcctcgccagctccctgcttagaaacgatgtgcccatggctggcccgctggttgccgggggactcctgattgcctgttatgtgatcaccggcaccagcgctgacctcacagtcgagaaagccgccgacgtgacctgggaagaggaagctgagcagacaggggtttctcataacctgatgattacggtggatgacgatggaaccatgcggatcaaggacgatgaaacagagaatatccttaccgtcctgctgaaaacagccctcctgattgtgtccggcatctttccttacagcattcccgcgacccttctggtctggcacacgtggcagaagcagacccaacgctctggcgtgctctgggacgttccttctcccccggagacacagaaagctgaactggaggaaggggtgtacagaatcaagcagcagggaattttcggcaagacccaagtcggggtgggagttcagaaagagggcgtgtttcatacaatgtggcacgtcacccgcggggcggtgctcacacacaacggaaagcggctggagcctaattgggccagcgtgaaaaaggatcttatcagctatggcggcgggtggagactgtccgctcagtggcaaaaaggagaagaggttcaggtcattgccgtggaacccggcaagaaccctaagaatttccagacgatgcccgggatcttccagaccacaaccggagagatcggcgcgattgctctggactttaaacccgggaccagcggatcccctatcattaaccgggaaggcaaggtggtcggcctctacgggaatggagtggttaccaagaacggcgggtatgtgagcggaatcgcccaaacgaatgccgagccggatggccccacccctgagctggaagaggaaatgttcaagaaacgcaaccttacaattatggacctgcatcccgggtctggcaagaccagaaagtacctccctgctatcgtccgggaggccatcaaacgcagactgcggacactcattctggctcccaccagagtggttgccgcggaaatggaggaggcccttaagggactgcctatccgctatcagacgacagctaccaaaagcgaacacaccggccgggagattgtggatctgatgtgccatgccacatttaccatgagactcctgtccccggtccgcgtgcccaattacaaccttatcattatggacgaagctcacttcacagatcctgcctctatcgccgctcgggggtatatcagcaccagagttggaatgggcgaggcggccgctatttttatgacggccacaccccctgggaccgccgaggctttcccccagtccaatgccccgatccaggacgaggagcgcgacattcctgaacggtcttggaacagcggaaatgagtggatcacagattttgtgggcaagaccgtctggttcgtgccctccattaaagcggggaacgacatcgctaactgtctgagaaagaatggcaagaaagtgattcaactctctcgcaagacgtttgataccgaataccagaaaacacggctgaacgactgggatttcgtcgttaccacagacatcagcgagatgggagccaattttaaggccgatagagtgatcgacccccggcgctgcctgaaacctgtgattctcaccgatggccccgagagagtcatccttgctgggcctatgccggtgacagccgcgtccgccgctcagcggcgcggaagagttggccggaacccccagaaggaaaatgaccaatacattttcaccgggcagcctctgaacaatgatgaggaccatgcccactggacggaagctaagatgctgctcgacaacatcaatacacccgagggaattatccctgccctgttcgaacccgagagagagaaaagcgctgccatcgatggcgaatatcgccttaagggggagtctcggaaaacctttgtggaactgatgagacgcggcgacctcccggtctggctggcgcacaaggtggcctccgagggaattaaatacaccgatcggaagtggtgcttcgacggcgaaagaaacaatcagatcctggaggagaacatggatgttgaaatttggacaaaagagggggaacgcaagaagctccggcctagatggcttgacgctcgcacctatagcgatcccctggccctgaaagagtttaaggacttcgctgccggaagaaaatctatcgccctcgatctggtgacagaaattggccgggtcccttcccatcttgcttaccgcacgagaaatgcgctggacaacctcgtgatgctgcacaccagcgagcatgggggacgggcctatcgccacgctgtcgaggaactgcccgagacaatggaaaccctccttctgctgggcctcatgatcctgcttacaggcggggccatgctgtttctcatctccggaaagggcattgggaaaacctctatcggactgatttgtgtgatcgttagctccggcatgctgtggatggccgatgtgcctctccagtggattgctagcgccatcgtgcttgagttctttatgatggtcctgctgattcccgagccggaaaagcaaagaacgcctcaggacaatcagctcgcgtacgttgtgatcgggatcctgacccttgccgctattgtggccgctaacgagatgggactgctcgaaacaaccaagcgggatctgggcatgtctaaagagcccggcgtcgtgtcccccacaagctatctggacgttgacctccaccctgcctctgcgtggaccctttacgccgtggctacgacagtcatcaccccgatgctgagacatacaattgaaaatagcaccgccaacgtgtccctggctgccatcgctaaccaagccgtcgtgctcatggggctggataagggatggcccatttctaaaatggaccttggcgttcctctgctcgcgctggggtgctacagccaggtgaatcccctgaccctcacagccgctgtccttctgctggtgacgcactatgccatcatcggacctggcctccaggctaaggccacccgcgaggcccagaaacggacagcggctgggattatgaagaaccccaccgttgatggaatcatgacaattgacctggatcctgtgatctacgactccaagttcgagaaacaacttggccaggtcatgctgctcgtgctgtgtgccgtgcagctgctccttatgagaacctcttgggctctgtgcgaagccctgacgctcgccacaggcccgattaccaccctgtgggaggggagccccggaaagttttggaatacaaccatcgctgtttccatggccaacatcttccgcggcagctatcttgcgggggccggactggctttttctattatgaaatccgtcggcacagggcggagaggaacgggcagccagggcgaaaccctcggggagaagtggaaaaagaagctgaatcaactgtcccggaaagagttcgatctctacaagaaatctggaatcacagaggtggaccgcaccgaggccaaggaaggccttaaaagaggggagacaacccatcacgctgtgagccggggatccgccaagctgcagtggtttgtcgaacgcaacatggttattcctgagggcagagtgatcgatctggggtgtggacggggcggctggtcttattactgcgcggggctcaaaaaggtgacggaagtccgcggatataccaagggcgggcccggacatgaggagcctgtgcccatgagcacatacggctggaatctggttaaacttatgtccgggaaggacgtgttctacctgccgcctgaaaaatgtgataccctcctgtgcgacattggagagagctctccctcccccacagtcgaagagagcagaaccatccgggtgctgaagatggttgagccttggctcaaaaacaatcagttctgtattaaggtgcttaacccctatatgcctacagtcatcgaacacctggagcgcctgcagagaaagtacggcggcatgctcgtgcggaatccgctgtctagaaactccacccacgaaatgtattggatcagcaatgggacgggaaacattgtgtctagcgtcaatatggtttcccgccttctgctcaaccggtttacaatgacccatagacgccccaccatcgagaaagatgtggacctgggcgccgggacacggcacgtgaacgctgaacctgagacgcccaatatggacgtcattggagagagaatcaagcgcattaaagaagaacattctagcacctggcactacgatgacgaaaacccttataagacatgggcctaccacggctcctatgaggtgaaagctaccgggagcgcctcctctatgatcaatggagttgtgaagctgctcacaaagccctgggatgtcgtgccgatggttacccaaatggctatgacagacaccacgcctttcggccagcagcgggtgtttaaagaaaaggtcgataccagaacaccccgccctatgcccggcacccggaaagtgatggagatcacagccgagtggctgtggagaacccttgggcgcaacaagaaacctcggctgtgcacgagagaagagttcacaaagaaggttcgcaccaatgcggccatgggagctgtgtttacagaagagaaccaatgggacagcgccagagctgccgtcgaagatgaggagttctggaaactcgtggaccgggaacgcgagctgcataaacttggcaaatgtgggtcctgcgtctacaatatgatgggaaagagagagaagaagctgggcgagtttgggaaagccaagggctctcgggcgatttggtacatgtggctcggagctagatatctggagttcgaagccctgggctttctcaacgaggatcactggttcagccgggaaaattcctactctggggtggagggagaaggcctgcataaacttgggtatatcctgcgcgacattagcaaaatccccggaggcgccatgtacgctgatgacaccgccgggtgggacacgagaattaccgaggatgacctccacaacgaggaaaagatcacacagcagatggatccggagcatcggcagctggctaatgccatctttaaacttacctatcaaaacaaggttgtgaaagtccagcgccctacacccaagggcaccgtgatggacattatctccagaaaggatcagcggggaagcggccaggtggggacatacggactgaataccttcacgaacatggaagcgcaactcgttcgccagatggagggcgaaggggtgctgtctaaagccgacctggagaatccccacctcctggagaagaaaattacacagtggcttgaaaccaagggagtcgagagactgaaacggatggctatctccggcgatgactgcgtggttaagcctattgatgaccgctttgccaacgctctcctggcccttaacgatatggggaaggtgagaaaagacatcccgcagtggcaacccagcaagggctggcacgattggcagcaggtccctttctgttctcatcacttccatgaactgatcatgaaagacggacggaagctcgtggtcccctgccgccctcaggacgagctgattggcagagcgcggatctcccaaggggccggatggagcctgaaagaaaccgcttgtctcggcaaggcctatgctcagatgtggtctctgatgtactttcaccgcagagatcttcggctggcctccaatgctatttgcagcgccgtgcccgttcactggatccctacatccagaaccacatggagcattcatgcgcaccatcagtggatgacgaccgaggacatgctcacagtgtggaaccgcgtctggatcgaggataatccctggatggaagacaagaccccggtgacaacctgggaggatgttccttacctggggaaacgggaagaccaatggtgtggatctcttattggcctgacgagcagagccacctgggctcagaacatcctcacagccatccaacaggtgcgctccctgattggggatgaggagttcctggactatatgccctctatgaagcggtttagaaaagaagaggaaagcgagggcgccatctggtga

SEQ ID NO: 20853 - RNA, 9873 nt, synthetic construct
  misc_feature 1..9873: note = derived and/or modified CDS sequence (opt5) from DENV-3__FJ461322__SS-prME
  source 1..9873: mol_type = other RNA
accagcctgtgcctcatgatgatgctgcccgccacacttgctttccacctgacgtcccgggacggcgaacctcggatgatcgtggggaagaacgaacgcggaaagtctctcctgtttaagaccgccagcggcattaatatgtgtacacttatcgcgatggatctgggggaaatgtgcgacgataccgtcacatacaagtgtccgctcattgctgaagttgaacccgaagacatcgattgctggtgtaacctgacctccacatgggtgacctatggaacgtgcaatcaggccggcgaacaccggcgggacaagcgctctgtggccctggctcctcacgtcgggatgggactcgataccagaacacagacctggatgagcgccgagggcgcttggagacaggtggaaaaggttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagaataaacccacgctcgacatcgagctgcagaagaccgaagctacacagcttgccaccctgcgcaaactctgtattgagggaaagatcacaaacattaccacggattccagatgccctacacagggcgaagcgatcctgccggaggaacaggaccagaattatgtgtgtaaacacacctacgtggatcggggctgggggaacggatgcggccttttcgggaagggaagcctggtcacatgcgccaagtttcagtgtctcgagcccattgagggcaaagtggttcagtatgaaaatctgaagtacacagtgatcatcaccgtccacacaggggaccagcatcaggtgggaaacgacacgcaaggcgttaccgtggagattacacctcaggcttctaccgtcgaagccgtgctgcccgagtatggcacactcgggctggaatgctcccctcgcaccggacttgatttcaatgagatgatcctgctcacgatgaaaaacaaggcttggatggtccacagacagtggtttttcgacctgccccttccgtggaccagcggcgccacaaccgagacacctacctggaatcggaaagaactgctcgtgacgtttaagaacgcccatgctaaaaagcaagaggttgtggtcctggggtctcaggaaggagcgatgcacacagccctgaccggcgctacagagattcaaaattccgggggcaccagcatcttcgccggacacctcaagtgtcgcctgaaaatggataaacttgaactgaaaggcatgtcttacgccatgtgcctcaacacctttgtgctgaagaaagaggtttccgagacacagcatgggacgattctgatcaaggtggaatacaagggagaggacgctccctgtaaaatccctttcagcaccgaagatggccaagggaaggcccacaacggaagacttattacagcgaatcccgtcgtgaccaaaaaggaggagcccgtgaacatcgaagctgagcctccgttcggcgaatccaatattgttatcgggattggcgacaaagccctcaagatcaactggtataagaaaggatctagcatcggcaagatgtttgaggccacagctagaggggccagacgcatggctattctgggagataccgcctgggacttcggctccgtcgggggagtgctgaatagcctcggcaaaatggtgcatcagatctttgggtctgcgtacacggccctgttctccggcgtcagctggattatgaagatcggaattggcgtgcttctgacatggatcgggctcaactctaaaaataccagcatgtccttttcttgcattgttatcggaatcattaccctgtatctgggcgctgtggtccaggccgatatggggtgtgctatcaactggaagggaaaggaacttaaatgcggcagcgggattttcgtgacaaatgaggttcacacctggacagagcagtacaagtttcaagccgactcccccaaacggctcgcgacggccatcgctggcgcctgggaaaacggagtgtgtggcattagaagcaccacacgcatggagaatctgctgtggaagcagatcgctaacgaactcaattatatcctgtgggagaacaatattaaacttaccgtcgtggttggggatatcattggagtgctggaacagggcaagcggacactcacccctcagcccatggagctgaaatactcttggaagacgtgggggaaggccaaaatcgtcaccgccgagacacaaaactccagcttcattatcgacggacctaacacccccgaatgcccgtctgcttccagagcgtggaatgtgtgggaggtggaagactatggctttggcgtcttcacaaccaacatctggctgaaacttcgcgaggtttacacacagagctgtgatcatcggctcatgtccgccgctattaaagacgaaagagccgtgcacgccgatatggggtactggatcgagtctcagaagaatggaagctggaaactggagaaggcttcctttattgaagtgaagacctgcacgtggcctaaatctcacacactgtggagcaacggcgtcctcgagtccgacatgatcattcccaagagcctggccgggcctatctctcagcataatcaccgccccggatatcatacccaaaccgcgggcccttggcaccttgggaaactggaactcgatttcaactactgcgagggaacaaccgtggttatcacggagaattgtggcacacggggcccctccctgagaaccacaaccgtgagcgggaagctgattcacgaatggtgctgtcgctcttgcacacttccgcctctccggtatatgggagaggacggctgttggtacgggatggaaatcagacccattaacgagaaagaagagaatatggtcaagtccctggtgagcgctggatctggcaaggttgataactttaccatgggggtgctgtgcctcgccatcctgttcgaggaagtcatgcggggaaaattcggcaagaaacatatgattgccggcgtgctttttacgttcgttctgctcctgagcgggcagatcacctggcgcgacatggctcacacactgattatgatcggatccaatgccagcgatagaatgggcatgggggtgacctatcttgcgctgatcgctacatttaagattcagcccttcctcgccctgggatttttcctccggaaactgacctctagagagaaccttctgctcggcgtcgggctggccatggctacgacactgcaacttcctgaagacatcgagcagatggccaatggaattgctctgggcctcatgaccctgaagctcatcacacagtttgaaacctaccagctgtggaccgcccttgtgtccctgacatgtagcaacacgattttcaccctcacagtggcgtggcgcaccgccacactgatcctggctggcgtctcccttctgccgctctgccaatctagctccatgcggaagaccgattggctgcccatgacggttgccgctatgggggtgcctcccctccctctgtttatcttctctcttaaagacacacccaagagacgcagctggcctctgaatgagggagtgatggccgtcggcctggtgtccattctcgcctctagcctgcttagaaacgatgttcccatggctgggccgctggtggcgggaggcctcctgatcgcctgttatgtcattaccgggacctccgctgacctcacagtggagaaagccgccgacgttacctgggaagaggaagctgagcagacaggagtgagccataacctgatgatcacggtcgatgacgatggcaccatgcggattaaggacgatgaaacagagaatatccttaccgtgctgctgaaaacagccctcctgatcgtctctggcatttttccttactccatccccgcgacccttctggtgtggcacacgtggcagaagcagacccaacgcagcggggttctctgggacgtgccttctcccccggagacacagaaagctgaactggaggaaggagtctacagaattaagcagcagggcatcttcgggaagacccaagtgggagttggcgtgcagaaagagggggtctttcatacaatgtggcacgtgacccggggagccgtgctcacacacaacggcaagcgcctggagcctaattgggcctccgttaaaaaggatcttattagctatggcgggggatggagactgtctgctcagtggcaaaaaggcgaagaggtccaggtgatcgccgtggaacccgggaagaaccctaagaatttccagacgatgcccggaattttccagaccacaaccggcgagatcggggcgatcgctctggactttaaacccggaacctccggcagccctattatcaaccgggaaggcaaggtcgtggggctctacggaaatggcgttgtgaccaagaacgggggatatgtctccggcattgcccaaacgaatgccgagccggatgggcccacccctgagctggaagaggaaatgttcaagaaacgcaaccttacaatcatggacctgcatcccggcagcggaaagaccagaaagtacctccctgctattgtgcgggaggccatcaaacgcagactgcggacactcatcctggctcccaccagagttgtggccgcggaaatggaggaggcccttaagggcctgcctattcgctatcagacgacagctaccaaatctgaacacaccgggcgggagatcgtcgatctgatgtgccatgccacatttaccatgagactcctgagcccggtgcgcgttcccaattacaaccttattatcatggacgaagctcacttcacagatcctgcctccattgccgctcggggatatatctctaccagagtgggcatgggggaggcggccgctatctttatgacggccacaccccctggaaccgccgaggctttcccccagagcaatgccccgattcaggacgaggagcgcgacatccctgaacggtcctggaactctggcaatgagtggattacagattttgtcgggaagaccgtgtggttcgtgcccagcatcaaagcgggcaacgacattgctaactgtctgagaaagaatggaaagaaagtcatccaactctcccgcaagacgtttgataccgaataccagaaaacacggctgaacgactgggatttcgttgtgaccacagacatttctgagatgggcgccaattttaaggccgatagagtgatcgacccccggcgctgcctgaaacctgtcatcctcaccgatgggcccgagagagtgattcttgctggacctatgccggttacagccgcgagcgccgctcagcggcgcggcagagtggggcggaacccccagaaggaaaatgaccaatacatcttcaccggacagcctctgaacaatgatgaggaccatgcccactggacggaagctaagatgctgctcgacaacattaatacacccgagggcatcattcctgccctgttcgaacccgagagagagaaatccgctgccatcgatggggaatatcgccttaagggcgagagccggaaaacctttgtcgaactgatgagacgcggagacctcccggtgtggctggcgcacaaggttgcctctgagggcatcaaatacaccgatcggaagtggtgcttcgacggggaaagaaacaatcagattctggaggagaacatggatgtggaaatctggacaaaagagggagaacgcaagaagctccggcctagatggcttgacgctcgcacctattccgatcccctggccctgaaagagtttaaggacttcgctgccggcagaaaaagcattgccctcgatctggtcacagaaatcgggcgggtgccttctcatcttgcttaccgcacgagaaatgcgctggacaacctcgtcatgctgcacacctccgagcatggaggccgggcctatcgccacgctgtggaggaactgcccgagacaatggaaaccctccttctgctgggcctcatgattctgcttacagggggagccatgctgtttctcatcagcggcaaggggatcggaaaaacctccattggcctgatctgtgttattgtgtctagcgggatgctgtggatggccgaggtgcctctccagtggatcgcttccgccattgtccttgagttctttatgatggttctgctgatccccgaaccggagaagcaaagaacgcctcaggataatcagctcgcgtacgtggtgattggaatcctgacccttgccgctatcgtcgccgctaacgaaatgggcctgctcgagacaaccaagcgggacctgggcatgagcaaagaacccggggtggtttctcccacatcctatctggatgtggacctccaccctgccagcgcgtggaccctttacgccgtcgctacgacagtgattaccccgatgctgagacatacaatcgaaaattctaccgccaacgtcagcctggctgccattgctaaccaagccgtggttctcatgggactggacaagggctggcccatctccaaaatggatcttggggtgcctctgctcgcgctgggatgctactctcaggtcaatcccctgaccctcacagccgctgtgcttctgctggttacgcactatgccattatcggccctgggctccaggctaaggccacccgcgaggcccagaaacggacagcggctggaatcatgaagaaccccaccgtggacggcattatgacaatcgatctggaccctgtcatttacgatagcaagttcgaaaaacaacttggccaggtgatgctgctcgtgctgtgtgccgttcagctgctccttatgagaacctcctgggctctgtgcgaggccctgacgctcgccacagggccgatcaccaccctgtgggaaggatctcccggcaagttttggaatacaaccattgctgtcagcatggccaacatcttccgcgggtcctatcttgcgggagccggcctggcttttagcatcatgaaatctgtggggacaggacggagaggcacgggctcccagggggagaccctcggagaaaagtggaaaaagaagctgaatcaactgagccggaaagagttcgacctctacaagaaatccggcattacagaggtggatcgcaccgaagccaaggaggggcttaaaagaggagaaacaacccatcacgctgtctctcggggcagcgccaagctgcagtggtttgttgagcgcaacatggtgatccctgaagggagagtgattgacctgggatgtggccggggcgggtggtcctattactgcgcgggactcaaaaaggtcacggaggtgcgcggctataccaaagggggacccggccatgaggaacctgttcccatgtctacatacgggtggaatatcgtgaaactgatgagcggaaaggatgtcttctaccttccgcctgagaaatgtgacaccctgctctgcgatattggcgaatccagcccctctcccacagtggaggagtccagaaccatccgggttctgaagatggtggaaccttggctgaaaaacaatcagttctgtattaaggtcctcaacccctatatgcctacagtgatcgagcaccttgaacgcctgcagagaaagtacggcgggatgctggtgcggaatccgctcagcagaaactctacccacgagatgtattggatctccaatggaacgggcaacattgtcagctctgttaatatggtgagccgcctgcttctgaaccggtttacaatgacccatagacgccccaccatcgaaaaagacgtggatctcggggccggaacacggcacgtcaacgctgagcctgagacgcccaatatggacgtgattggcgaaagaatcaagcgcattaaagaggaacattcctctacctggcactacgacgatgagaacccttataagacatgggcctaccacgggagctatgaagttaaagctaccggatccgccagctccatgatcaatggcgtggtcaagctgctgacaaagccctgggacgtggttccgatggtgacccaaatggctatgacagataccacgcctttcggccagcagcgggtctttaaagagaaggtggacaccagaacaccccgccctatgcccgggacccggaaagttatggagatcacagccgaatggctctggagaaccctgggacgcaacaagaaacctcggctttgcacgagagaggagttcacaaagaaggtgcgcaccaatgcggccatgggcgctgtctttacagaggaaaaccaatgggattctgccagagctgccgtggaggacgaggagttctggaaactggtcgatcgggagcgcgaactccataagctggggaaatgtggaagctgcgtgtacaatatgatgggcaagagagagaagaaacttggggagtttggcaaagccaaaggatcccgggcgatttggtacatgtggctgggcgctagatatctcgagttcgaggccctggggtttctgaacgaagaccactggttctctcgggagaatagctactccggagttgaaggcgaggggctccataagctgggatatatccttcgcgatatttctaaaatccccggcggggccatgtacgctgacgataccgccggctgggacacgagaattaccgaggacgatctgcacaacgaagagaagatcacacagcagatggacccggaacatcggcagctcgctaatgccatctttaaactgacctatcaaaacaaggtggtcaaagtgcagcgccctacacccaagggaaccgtgatggatattatcagcagaaaggaccagcggggctccgggcaggttggaacatacggccttaataccttcacgaacatggaggcgcaactggtgcgccagatggaaggggagggagtcctcagcaaagccgatctggagaatccccatctgctcgaaaagaaaattacacagtggctggagaccaagggcgtggaaagacttaaacggatggctatctctggggacgattgcgttgtgaagcctattgacgatcgctttgccaacgctctgctcgccctgaacgacatgggcaaggtcagaaaagatatcccgcagtggcaaccctccaagggatggcacgactggcaacaggtgcctttctgtagccatcacttccatgagcttatcatgaaagatggccggaagctggtcgtgccctgccgccctcaggacgaactcattgggagagcgcggatctctcaaggagccggctggtccctgaaagagaccgcttgtctggggaaggcctatgctcagatgtggagcctcatgtactttcaccgcagagacctgcggcttgcctctaatgctatttgctccgccgttcccgtgcactggatccctacaagcagaaccacatggtccattcatgcgcaccatcagtggatgacgaccgaggatatgctgacagtctggaaccgcgtgtggatcgaagacaatccctggatggaggataagaccccggttacaacctgggaagacattccttacctcggaaaacgggaggatcaatggtgtggcagcctgatcgggcttacgtctagagccacctgggctcagaacatcctgacagccattcaacaggtgcgcagcctcatcggcgacgaggagttcctggattatatgccctccatgaagcggtttagaaaagaggaagagtctgaaggagccatttggtga

SEQ ID NO: 20854 - RNA, 9873 nt, synthetic construct
  misc_feature 1..9873: note = derived and/or modified CDS sequence (opt5) from DENV-3__KF955458__SS-prME
  source 1..9873: mol_type = other RNA
accagcctgtgcctcatgatgatgctgcccgccacacttgctttccacctgacgtcccgggacggcgaacctcggatgatcgtggggaagaatgaacgcggaaagtctctcctgtttaagaccgccagcggcattaatatgtgtacacttatcgcgatggatctgggggaaatgtgcgacgataccgtcacatacaagtgtccgctcattgctgaagttgagcccgaagacatcgattgctggtgtaacctgacctccacatgggtgacctatggaacgtgcaatcaggccggcgagcatcggcgggacaagcgctctgtggccctggctcctcacgtcgggatgggactcgataccagaacacagacctggatgagcgccgagggcgcttggagacaggtggaaaaggttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagaataaacccacgctcgacatcgagctgcagaagaccgaagctacacagcttgccaccctgcgcaaactctgtattgagggaaagatcacaaacattaccacggattccagatgccctacacagggcgaagcgatcctgccggaggaacaggaccagaattatgtgtgtaaacacacctacgtggatcggggctgggggaacggatgcggccttttcgggaagggaagcctggtcacatgcgccaagtttcaatgtctcgagcccattgagggcaaagtggttcagtatgaaaatctgaagtacacagtgatcatcaccgtccacacaggggaccagcatcaggtgggaaacgacacgcaaggcgttaccgtggagattacacctcaggcttctaccgtcgaagccgtgctgcccgagtatggcacactcgggctggaatgctcccctcgcaccggacttgatttcaatgagatgatcctgctcacgatgaaaaacaaggcttggatggtccacagacagtggtttttcgacctgccccttccgtggaccagcggcgccacaaccgagacacctacctggaatcggaaagaactgctcgtgacgtttaagaacgcccatgctaaaaagcaagaggttgtggtcctggggtctcaggaaggagcgatgcacacagccctgaccggcgctacagagattcaaaattccgggggcaccagcatcttcgccggacacctcaagtgtcgcctgaaaatggataaacttgaactgaaaggcatgtcttacgccatgtgcctcaacacctttgtgctgaagaaagaggtttccgagacacagcatgggacgattctgatcaaggtggaatacaagggagaggacgctccctgtaaaatccctttcagcaccgaagatggccaagggaaggcccacaacggaagacttattacagcgaatcccgtcgtgaccaaaaaggaggagcccgtgaacatcgaagctgagcctccgttcggcgaatccaatattgttatcgggattggcgacaaagccctcaagatcaactggtataagaaaggatctagcatcggcaagatgtttgaggccacagctagaggggccagacgcatggctattctgggagataccgcctgggacttcggctccgtcgggggagtgctgaatagcctcggcaaaatggtgcatcagatctttgggtctgcgtacacggccctgttctccggcgtcagctggattatgaagatcggaattggcgtgcttctgacatggatcgggctcaactctaaaaataccagcatgtccttttcttgcattgttatcggaatcattaccctgtatctgggcgctgtggtccaggccgatatggggtgtgctatcaactggaagggaaaggaacttaaatgcggcagcgggattttcgtgacaaatgaggttcacacctggacagagcagtacaagtttcaagccgactcccccaaacggctcgcgacggccatcgctggcgcctgggaaaacggagtgtgtggcattagaagcaccacacgcatggagaatctgctgtggaagcagatcgctaacgaactcaattatatcctgtgggagaacaatattaaacttaccgtcgtggttggggatatcattggagtgctggaacagggcaagcggacactcacccctcagcccatggagctgaaatactcttggaagacgtgggggaaggccaaaatcgtcaccgccgagacacaaaactccagcttcattatcgacggacctaacacccccgaatgcccgtctgcttccagagcgtggaatgtgtgggaggtggaagactatggctttggcgtcttcacaaccaacatctggctgaaacttcgcgaggttaatacacagagctgtgatcatcggctcatgtccgccgctattaaagacgaaagagccgtgcacgccgatatggggtactggatcgagtctcagaagaacggaagctggaaactggagaaggcttcctttattgaagtgaagacctgcacgtggcctaaatctcacacactgtggagcaatggcgtcctcgagtccgacatgatcattcccaagagcctggccgggcctatctctcagcataaccaccgccccggataccatacccaaaccgcgggcccttggcaccttgggaaactggaactcgatttcaattattgcgagggaacaaccgtggttatcacggagaactgtggcacacggggcccctccctgagaaccacaaccgtgagcgggaagctgattcacgaatggtgctgtcgctcttgcacacttccgcctctccggtacatgggagaggacggctgttggtatgggatggaaatcagacccattaatgagaaagaagagaacatggtcaagtccctggtgagcgctggatctggcaaggttgataattttaccatgggggtgctgtgcctcgccatcctgttcgaggaagtcatgcggggaaaattcggcaagaaacatatgattgccggcgtgctttttacgttcgttctgctcctgagcgggcagatcacctggcgcgacatggctcacacactgattatgatcggatccaacgccagcgatagaatgggcatgggggtgacctaccttgcgctgatcgctacatttaagattcagcccttcctcgccctgggatttttcctccggaaactgacctctagagagaatcttctgctcggcgtcgggctggccatggctacgacactgcaacttcctgaagacatcgagcagatggccaacggaattgctctgggcctcatgaccctgaagctcatcacacagtttgaaacctatcagctgtggaccgcccttgtgtccctgacatgtagcaatacgattttcaccctcacagtggcgtggcgcaccgccacactgatcctggctggcgtctcccttctgccgctctgccaatctagctccatgcggaagaccgattggctgcccatgacggttgccgctatgggggtgcctcccctccctctgtttatcttctctcttaaagacacacccaagagacgcagctggcctctgaacgagggagtgatggccgtcggcctggtgtccattctcgcctctagcctgcttagaaacgatgttcccatggctgggccgctggtggcgggaggcctcctgatcgcctgttacgtcattaccgggacctccgctgacctcacagtggagaaagccgccgacgttacctgggaagaggaagctgagcagacaggagtgagccataatctgatgatcacggtcgatgacgatggcaccatgcggattaaggacgatgaaacagagaacatccttaccgtgctgctgaaaacagccctcctgatcgtctctggcatttttccttattccatccccgcgacccttctggtgtggcacacgtggcagaagcagacccaacgcagcggggttctctgggacgtgccttctcccccggagacacagaaagctgaactggaggaaggagtctacagaattaagcagcagggcatcttcgggaagacccaagtgggagttggcgtgcagaaagagggggtctttcatacaatgtggcacgtgacccggggagccgtgctcacacacaatggcaagcgcctggagcctaactgggcctccgttaaaaaggatcttattagctacggcgggggatggagactgtctgctcagtggcaaaaaggcgaagaggtccaggtgatcgccgtggaacccgggaagaatcctaagaacttccagacgatgcccggaattttccagaccacaaccggcgagatcggggcgatcgctctggactttaaacccggaacctccggcagccctattatcaatcgggaaggcaaggtcgtggggctctatggaaacggcgttgtgaccaagaatgggggatacgtctccggcattgcccaaacgaacgccgagccggatgggcccacccctgagctggaagaggaaatgttcaagaaacgcaatcttacaatcatggacctgcatcccggcagcggaaagaccagaaagtatctccctgctattgtgcgggaggccatcaaacgcagactgcggacactcatcctggctcccaccagagttgtggccgcggaaatggaggaggcccttaagggcctgcctattcgctaccagacgacagctaccaaatctgaacacaccgggcgggagatcgtcgatctgatgtgccatgccacatttaccatgagactcctgagcccggtgcgcgttcccaactataatcttattatcatggacgaagctcacttcacagatcctgcctccattgccgctcggggatacatctctaccagagtgggcatgggggaggcggccgctatctttatgacggccacaccccctggaaccgccgaggctttcccccagagcaacgccccgattcaggacgaggagcgcgacatccctgaacggtcctggaactctggcaacgagtggattacagattttgtcgggaagaccgtgtggttcgtgcccagcatcaaagcgggcaacgacattgctaattgtctgagaaagaacggaaagaaagtcatccaactctcccgcaagacgtttgataccgaatatcagaaaacacggctgaatgactgggatttcgttgtgaccacagacatttctgagatgggcgccaactttaaggccgatagagtgatcgacccccggcgctgcctgaaacctgtcatcctcaccgatgggcccgagagagtgattcttgctggacctatgccggttacagccgcgagcgccgctcagcggcgcggcagagtggggcggaatccccagaaggaaaacgaccaatacatcttcaccggacagcctctgaataacgatgaggaccatgcccactggacggaagctaagatgctgctcgacaatattaacacacccgagggcatcattcctgccctgttcgaacccgagagagagaaatccgctgccatcgatggggaataccgccttaagggcgagagccggaaaacctttgtcgaactgatgagacgcggagacctcccggtgtggctggcgcacaaggttgcctctgagggcatcaaatataccgatcggaagtggtgcttcgacggggaaagaaataaccagattctggaggagaatatggatgtggaaatctggacaaaagagggagaacgcaagaagctccggcctagatggcttgacgctcgcacctactccgatcccctggccctgaaagagtttaaggacttcgctgccggcagaaaaagcattgccctcgatctggtcacagaaatcgggcgggtgccttctcatcttgcttatcgcacgagaaacgcgctggacaatctcatgatgctgcacacctccgagcatggaggccgggcctaccgccacgctgtcgaggaactgcccgagacaatggaaaccctccttctgctgggcctcatgattctgcttacagggggagccatgctgtttctcatcagcggcaaggggatcggaaaaacctccattggcctgatctgtgtgattgtttctagcgggatgctgtggatggccgatgtgcctctccagtggatcgcttccgccattgtgcttgagttctttatgatggtcctgctgatccccgagccggaaaagcaaagaacgcctcaggacaaccagctcgcgtatgttgtgattggaatcctgacccttgccgctatcgtggccgctaatgagatgggcctgctcgaaacaaccaagcgggatctgggcatgagcaaagagcccggggtcgtgtctcccacatcctacctggacgttgacctccaccctgccagcgcgtggaccctttatgccgtggctacgacagtcattaccccgatgctgagacatacaatcgaaaactctaccgccaacgtgagcctggctgccattgctaatcaagccgtcgtgctcatgggactggataagggctggcccatctccaaaatggaccttggggttcctctgctcgcgctgggatgctactctcaggtgaaccccctgaccctcacagccgctgtccttctgctggtgacgcactacgccattatcggccctgggctccaggctaaggccacccgcgaggcccagaaacggacagcggctggaatcatgaagaatcccaccgttgatggcattatgacaatcgacctggatcctgtgatttatgacagcaagttcgagaaacaacttggccaggtcatgctgctcgtgctgtgtgccgtgcagctgctccttatgagaacctcctgggctctgtgcgaagccctgacgctcgccacagggccgatcaccaccctgtgggagggatctcccggcaagttttggaacacaaccattgctgttagcatggccaatatcttccgcgggtcctaccttgcgggagccggcctggcttttagcatcatgaaatctgtcgggacaggacggagaggcacgggctcccagggggaaaccctcggagagaagtggaaaaagaagctgaaccaactgagccggaaagagttcgatctctataagaaatccggcattacagaggtggaccgcaccgaggccaaggaagggcttaaaagaggagagacaacccatcacgctgtgtctcggggcagcgccaagctgcagtggtttgtcgaacgcaatatggttatccctgaggggagagtgattgatctgggatgtggccggggcgggtggtcctactattgcgcgggactcaaaaaggtgacggaagtccgcggctacaccaaaggcgggcccgggcatgaggagcctgtgcccatgtctacatatgggtggaacctggttaaacttatgagcggaaaggacgtgttctacctgccgcctgaaaaatgtgataccctcctgtgcgacatcggcgagtccagcccctctcccacagtcgaagagtccagaaccattcgggtgctgaagatggttgagccttggctcaaaaataaccagttctgtatcaaggtgcttaatccctacatgcctacagtcattgaacacctggagcgcctgcagagaaagtatggcgggatgctcgtgcggaacccgctgagcagaaattctacccacgaaatgtactggatctccaacggaacgggcaatatcgtgagctctgtcaacatggttagccgccttctgctcaaccggtttacaatgacccatagacgccccaccattgagaaagatgtggacctgggggccggaacacggcacgtgaatgctgaacctgagacgcccaacatggacgtcatcggcgagagaattaagcgcatcaaagaagaacattcctctacctggcactatgatgacgaaaatccttacaagacatgggcctatcacgggagctacgaggtgaaagctaccggatccgccagctccatgattaacggcgttgtgaagctgctcacaaagccctgggatgtcgtgccgatggttacccaaatggctatgacagacaccacgcctttcggccagcagcgggtgtttaaagaaaaggtcgataccagaacaccccgccctatgcccgggacccggaaagtgatggagatcacagccgagtggctgtggagaacccttggacgcaataagaaacctcggctgtgcacgagagaagagttcacaaagaaggttcgcaccaacgcggccatgggcgctgtgtttacagaagagaatcaatgggactctgccagagctgccgtcgaagatgaggagttctggaaactcgtggaccgggaacgcgagctgcataaacttgggaaatgtggaagctgcgtctataacatgatgggcaagagagagaagaagctgggggagtttggcaaagccaagggatcccgggcgatctggtacatgtggctcggcgctagatacctggagttcgaagccctggggtttctcaatgaggatcactggttctctcgggaaaacagctattccggagtggagggcgaagggctgcataaacttggatacattctgcgcgacatctctaaaattcccggcggggccatgtatgctgatgacaccgccggctgggacacgagaatcaccgaggatgacctccacaatgaggaaaagattacacagcagatggatccggagcatcggcagctggctaacgccatctttaaacttacctaccaaaataaggttgtgaaagtccagcgccctacacccaagggaaccgtgatggacatcattagcagaaaggatcagcggggctccggacaggtgggaacatatggcctgaacaccttcacgaatatggaagcgcaactcgttcgccagatggagggggaaggagtgctgagcaaagccgacctggagaacccccacctcctggagaagaaaatcacacagtggcttgaaaccaagggcgtcgagagactgaaacggatggctatttctggggatgactgcgtggttaagcctatcgatgaccgctttgccaacgctctcctggcccttaatgatatgggcaaggtgagaaaagacattccgcagtggcaaccctccaagggatggcacgattggcagcaggtccctttctgtagccatcacttccatgaactgatcatgaaagacggccggaagctcgtggtcccctgccgccctcaggacgagctgatcgggagagcgcggatttctcaaggagccggctggtccctgaaagaaaccgcttgtctcgggaaggcctacgctcagatgtggagcctgatgtattttcaccgcagagatcttcggctggcctctaacgctatctgctccgccgtgcccgttcactggattcctacaagcagaaccacatggtccatccatgcgcaccatcagtggatgacgaccgaggacatgctcacagtgtggaatcgcgtctggattgaggataacccctggatggaagacaagaccccggtgacaacctgggaggatgttccttacctgggaaaacgggaagaccaatggtgtggcagccttatcgggctgacgtctagagccacctgggctcagaatattctcacagccatccaacaggtgcgcagcctgatcggcgatgaggagttcctggactacatgccctccatgaagcggtttagaaaagaagaggaatctgagggagccatttggtga

SEQ ID NO: 20855 - RNA, 9873 nt, synthetic construct
  misc_feature 1..9873: note = derived and/or modified CDS sequence (opt5) from DENV-3__FJ562102__SS-prME
  source 1..9873: mol_type = other RNA
accagcctgtgcctcatgatgatgctgcccgccacacttgctttccacctgacgtcccgggacggcgaacctcggatgatcgtggggaagaacgaacgcggaaagtctctcctgtttaagaccgccagcggcattaatatgtgtacacttatcgcgatggatctgggggagatgtgcgacgataccgtcacatacaagtgtccgctcattgctgaagttgagcccgaagacatcgattgctggtgtaacctgacctccacatgggtgacctatggaacgtgcaatcaggccggcgagcatcggcgggacaagcgctctgtggccctggctcctcacgtcgggatgggactcgataccagaacacagacctggatgagcgccgagggcgcttggagacaggtggaaaaggttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagaataaacccacgctcgacatcgagctgcagaagaccgaagctacacagcttgccaccctgcgcaaactctgtattgagggaaagatcacaaacattaccacggattccagatgccctacacagggcgaagcgatcctgccggaggaacaggaccagaattatgtgtgtaaacacacctacgtggatcggggctgggggaacggatgcggccttttcgggaagggaagcctggtcacatgcgccaagtttcaatgtctcgagcccattgagggcaaagtggttcagtatgaaaatctgaagtacacagtgatcatcaccgtccacacaggggaccagcatcaggtgggaaacgacacgcaaggcgttaccgtggagattacacctcaggcttctaccgtcgaagccgtgctgcccgagtatggcacactcgggctggaatgctcccctcgcaccggacttgatttcaatgagatgatcctgctcacgatgaaaaacaaggcttggatggtccacagacagtggtttttcgacctgccccttccgtggaccagcggcgccacaaccgagacacctacctggaatcggaaagaactgctcgtgacgtttaagaacgcccatgctaaaaagcaagaggttgtggtcctggggtctcaggaaggagcgatgcacacagccctgaccggcgctacagagattcaaaattccgggggcaccagcatcttcgccggacacctcaagtgtcgcctgaaaatggataaacttgaactgaaaggcatgtcttacgccatgtgcctcaacacctttgtgctgaagaaagaggtttccgagacacagcatgggacgattctgatcaaggtggaatacaagggagaggacgctccctgtaaaatccctttcagcaccgaagatggccaagggaaggcccacaacggaagacttattacagcgaatcccgtcgtgaccaaaaaggaggagcccgtgaacatcgaagctgagcctccgttcggcgaatccaatattgttatcgggattggcgacaaagccctcaagatcaactggtataagaaaggatctagcatcggcaagatgtttgaggccacagctagaggggccagacgcatggctattctgggagataccgcctgggacttcggctccgtcgggggagtgctgaatagcctcggcaaaatggtgcatcagatctttgggtctgcgtacacggccctgttctccggcgtcagctggattatgaagatcggaattggcgtgcttctgacatggatcgggctcaactctaaaaataccagcatgtccttttcttgcattgttatcggaatcattaccctgtatctgggcgctgtggtccaggccgatatggggtgtgctatcaactggaagggaaaggaacttaaatgcggcagcgggattttcgtgacaaatgaggttcacacctggacagagcagtacaagtttcaagccgactcccccaaacggctcgcgacggccatcgctggcgcctgggaaaacggagtgtgtggcattagaagcaccacacgcatggagaatctgctgtggaagcagatcgctaacgaactcaattatatcctgtgggagaacaatattaaacttaccgtcgtggttggggatatcattggagtgctggaacagggcaagcggacactcacccctcagcccatggagctgaaatactcttggaagacgtgggggaaggccaaaatcgtcaccgccgagacacaaaactccagcttcattatcgacggacctaacacccccgaatgcccgtctgcttccagagcgtggaatgtgtgggaggtggaagactatggctttggcgtcttcacaaccaacatctggctgaaacttcgcgaggtttacacacagagctgtgatcatcggctcatgtccgccgctattaaagacgaaagagccgtgcacgccgatatggggtactggatcgagtctcagaagaatggaagctggaaactggagaaggcttcctttattgaagtgaagacctgcacgtggcctaaatctcacacactgtggagcaacggcgtcctcgagtccgacatgatcattcccaagagcctggccgggcctatctctcagcataatcaccgccccggatatcatacccaaaccgcgggcccttggcaccttgggaaactggaactcgatttcaactactgcgagggaacaaccgtggttatcacggagaattgtggcacacggggcccctccctgagaaccacaaccgtgagcgggaagctgattcacgaatggtgctgtcgctcttgcacacttccgcctctccggtatatgggagaggacggctgttggtacgggatggaaatcagacccattaacgagaaagaagagaatatggtcaagtccctggtgagcgctggatctggcaaggttgataactttaccatgggggtgctgtgcctcgccatcctgttcgaggaagtcatgcggggaaaattcggcaagaaacatatgattgccggcgtgctttttacgttcgttctgctcctgagcgggcagatcacctggcgcgacatggctcacacatttattatgatcggatccaatgccagcgatagaatgggcatgggggtgacctatctggcgcttatcgctacattcaagattcagccctttctggccctcggattctttctgcggaaactcacctctagagagaacctgcttctgggcgtcgggctcgccatggctacgacactgcaactgcctgaagacatcgagcagatggccaatggaattgctcttggcctgatgaccctcaagctgatcacacagttcgaaacctaccagctctggaccgccctggtgtcccttacatgtagcaacacgatttttaccctgacagtggcgtggcgcaccgccacactcatcctggctggcgtctccctgcttccgctgtgccaatctagctccatgcggaagaccgattggctccccatgacggttgccgctatgggggtgcctcccctgcctctcttcatcttttctctgaaagacacacccaagagacgcagctggcctcttaatgagggagtgatggccgtcggcctggtgtccattctggcctctagcctcctgagaaacgatgttcccatggctgggccgcttgtggcgggaggcctgctcatcgcctgttatgtcattaccgggacctccgctgacctgacagtggagaaagccgccgacgttacctgggaagaggaagctgagcagacaggagtgagccataacctcatgatcacggtcgatgacgatggcaccatgcggattaaggacgatgaaacagagaatatcctgaccgtgcttctgaaaacagccctgctcatcgtctctggcattttcccttactccatccccgcgaccctgcttgtgtggcacacgtggcagaagcagacccaacgcagcggggttctgtgggacgtgccttctcccccggagacacagaaagctgaactcgaggaaggagtctacagaattaagcagcagggcatctttgggaagacccaagtgggagttggcgtgcagaaagagggggtcttccatacaatgtggcacgtgacccggggagccgtgctgacacacaacggcaagcgcctcgagcctaattgggcctccgttaaaaaggatctgattagctatggcgggggatggagactttctgctcagtggcaaaaaggcgaagaggtccaggtgatcgccgtggaacccgggaagaaccctaagaatttccagacgatgcccggaatttttcagaccacaaccggcgagatcggggcgatcgctctggacttcaaacccggaacctccggcagccctattatcaaccgggaaggcaaggtcgtggggctgtacggaaatggcgttgtgaccaagaacgggggatatgtctccggcattgcccaaacgaatgccgagccggatgggcccacccctgagctcgaagaggaaatgtttaagaaacgcaacctgacaatcatggaccttcatcccggcagcggaaagaccagaaagtacctgcctgctattgtgcgggaggccatcaaacgcagactccggacactgatcctcgctcccaccagagttgtggccgcggaaatggaggaggccctgaagggccttcctattcgctatcagacgacagctaccaaatctgaacacaccgggcgggagatcgtcgatctgatgtgccatgccacattcaccatgagactgctcagcccggtgcgcgttcccaattacaacctgattatcatggacgaagctcactttacagatcctgcctccattgccgctcggggatatatctctaccagagtgggcatgggggaggcggccgctatcttcatgacggccacaccccctggaaccgccgaggcttttccccagagcaatgccccgattcaggacgaggagcgcgacatccctgaacggtcctggaactctggcaatgagtggattacagatttcgtcgggaagaccgtgtggtttgtgcccagcatcaaagcgggcaacgacattgctaactgtcttagaaagaatggaaagaaagtcatccaactgtcccgcaagacgttcgataccgaataccagaaaacacggctcaacgactgggattttgttgtgaccacagacatttctgagatgggcgccaatttcaaggccgatagagtgatcgacccccggcgctgcctgaaacctgtcatcctgaccgatgggcccgagagagtgattctcgctggacctatgccggttacagccgcgagcgccgctcagcggcgcggcagagtggggcggaacccccagaaggaaaatgaccaatacatcttcaccggacagcctcttaacaatgatgaggaccatgcccactggacggaagctaagatgctgctggacaacattaatacacccgagggcatcattcctgccctctttgaacccgagagagagaaatccgctgccatcgatggggaatatcgcctgaagggcgagagccggaaaaccttcgtcgaacttatgagacgcggagacctgccggtgtggctcgcgcacaaggttgcctctgagggcatcaaatacaccgatcggaagtggtgctttgacggggaaagaaacaatcagattctggaggagaacatggatgtggaaatctggacaaaagagggagaacgcaagaagctgcggcctagatggctcgacgctcgcacctattccgatccccttgccctgaaagagttcaaggactttgctgccggcagaaaaagcattgccctggatctcgtcacagaaatcgggcgggtgccttctcatctggcttaccgcacgagaaatgcgcttgacaacctggtcatgctccacacctccgagcatggaggccgggcctatcgccacgctgtggaggaactgcccgagacaatggaaaccctgctccttctgggcctgatgattctcctgacagggggagccatgcttttcctgatcagcggcaaggggatcggaaaaacctccattggcctcatctgtgttattgtgtctagcgggatgctgtggatggccgatgtgcctctgcagtggatcgcttccgccattatcctcgagtttttcatgatggtccttctgattcccgagccggaaaagcaaagaacgcctcaggacaatcagctggcgtacgttgtgatcggaatcctcaccctggccgctattgtggccgctaacgagatgggccttctggaaacaaccaagcgggatctcggcatgagcaaagagcccggggtcgtgtctcccacatcctatctggacgttgacctgcaccctgccagcgcgtggaccctctacgccgtggctacgacagtcatcaccccgatgcttagacatacaattgaaaattctaccgccaacgtgagcctggctgccatcgctaaccaagccgtcgtgctgatgggactcgataagggctggcccatttccaaaatggacctgggggttcctcttctggcgctcggatgctactctcaggtgaatcccctgaccctgacagccgctgtcctccttctggtgacgcactatgccatcatcggccctgggctgcaggctaaggccacccgcgaggcccagaaacggacagcggctggaattatgaagaaccccaccgttgatggcatcatgacaattgacctcgatcctgtgatctacgacagcaagtttgagaaacaactgggccaggtcatgcttctggtgctctgtgccgtgcagctgctgctcatgagaacctcctgggctctttgcgaagccctgacgctggccacagggccgattaccaccctctgggagggatctcccggcaagttctggaatacaaccatcgctgttagcatggccaacatctttcgcgggtcctatctggcgggagccggccttgctttcagcattatgaaatctgtcgggacaggacggagaggcacgggctcccagggggaaaccctgggagagaagtggaaaaagaagctcaatcaactgagccggaaagaatttgatctgtacaagaaatccggcatcacagaggtggaccgcaccgaggccaaggaagggctcaaaagaggagagacaacccatcacgctgtgtctcggggcagcgccaaacttcagtggttcgtcgaacgcaacatggttattcctgaggggagagtgatcgatctgggatgtggccggggcgggtggtcctattactgcgcgggactgaaaaaggtgacggaagtccgcggctataccaaaggcgggcccgggcatgaggagcctgtgcccatgtctacatacgggtggaatctcgttaaactgatgagcggaaaggacgtgttctaccttccgcctgaaaaatgtgataccctgctctgcgacattggcgagtccagcccctctcccacagtcgaagagtccagaaccatccgggtgctgaagatggttgagccttggctgaaaaacaatcagttttgtattaaggtgctcaacccctatatgcctacagtcatcgaacaccttgagcgcctgcagagaaagtacggcgggatgctggtgcggaatccgctcagcagaaactctacccacgaaatgtattggatctccaatggaacgggcaacattgtgagctctgtcaatatggttagccgcctgcttctgaaccggttcacaatgacccatagacgccccaccatcgagaaagatgtggacctcggggccggaacacggcacgtgaacgctgaacctgagacgcccaatatggacgtcattggcgagagaatcaagcgcattaaagaagaacactcctctacctggcactacgatgacgaaaacccttataagacatgggcctaccacgggagctatgaggtgaaagctaccggatccgccagctccatgatcaatggcgttgtgaagctgctgacaaagccctgggatgtcgtgccgatggttacccaaatggctatgacagacaccacgccttttggccagcagcgggtgttcaaagaaaaggtcgataccagaacaccccgccctatgcccgggacccggaaagtgatggagatcacagccgagtggctctggagaaccctgggacgcaacaagaaacctcggctttgcacgagagaagagtttacaaagaaggttcgcaccaatgcggccatgggcgctgtgttcacagaagagaaccaatgggactctgccagagctgccgtcgaagatgaggagttttggaaactggtggaccgggaacgcgagctccataagctggggaaatgtggaagctgcgtctacaatatgatgggcaagagagagaagaaacttggggagttcggcaaagccaagggatcccgggcgatttggtacatgtggctgggcgctagatatctcgagtttgaagccctggggttcctgaacgaggatcactggttttctcgggaaaatagctactccggagtggagggcgaagggctccataagctgggatatatccttcgcgacatttctaaaatccccggcggggccatgtacgctgatgacaccgccggctgggacacgagaattaccgaggatgacctgcacaacgaggaaaagatcacacagcagatggatccggagcatcggcagctcgctaatgccatcttcaaactgacctatcaaaacaaggttgtgaaagtccagcgccctacacccaagggaaccgtgatggacattatcagcagaaaggatcagcggggctccggacaggtgggaacatacggccttaatacctttacgaacatggaagcgcaactggttcgccagatggagggggaaggagtgctcagcaaagccgacctggagaatccccatctgctcgagaagaaaattacacagtggctggaaaccaagggcgtcgagagacttaaacggatggctatctctggggatgactgcgtggttaagcctattgatgaccgcttcgccaacgctctgctcgccctgaacgatatgggcaaggtgagaaaagacatcccgcagtggcaaccctccaagggatggcacgattggcagcaggtccctttctgtagccatcactttcatgaacttatcatgaaagacggccggaagctggtggtcccctgccgccctcaggacgagctcattgggagagcgcggatctctcaaggagccggctggtccctgaaagaaaccgcttgtctggggaaggcctatgctcagatgtggagcctcatgtacttccaccgcagagatctgcggcttgcctctaatgctatttgctccgccgtgcccgttcactggatccctacaagcagaaccacatggtccattcatgcgcaccatcagtggatgacgaccgaggacatgctgacagtgtggaaccgcgtctggatcgaggataatccctggatggaagacaagaccccggtgacaacctgggaggatgttccttacctcggaaaacgggaagaccaatggtgtggcagcctgattgggcttacgtctagagccacctgggctcagaacatcctgacagccatccaacaggtgcgcagcctcattggcgatgaggagtttctggactatatgccctccatgaagcggttcagaaaagaagaggaatctgagggagccatctggtga

SEQ ID NO: 20856 - RNA, 9873 nt, synthetic construct
  misc_feature 1..9873: note = derived and/or modified CDS sequence (opt5) from DENV-3__FJ410229__SS-prME
  source 1..9873: mol_type = other RNA
accagcctgtgcctcatgatgatgctgcccgccacacttgctttccacctgacgtcccgggacggcgaacctcggatgatcgtggggaagaacgaacgcggaaagtctctcctgtttaagaccgccagcggcattaatatgtgtacacttatcgcgatggatctgggggaaatgtgcgacgataccgtcacatacaagtgtccgctcattgctgaagttgagcccgaagacatcgattgctggtgtaacctgacctccacatgggtgacctatggaacgtgcaatcaggccggcgagcatcggcgggacaagcgctctgtggccctggctcctcacgtcgggatgggactcgataccagaacacagacctggatgagcgccgagggcgcttggagacaggtggaaaaggttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagaataaacccacgctcgacatcgagctgcagaagaccgaagctacacagcttgccaccctgcgcaaactctgtattgagggaaagatcacaaacattaccacggattccagatgccctacacagggcgaagcgatcctgccggaggaacaggaccagaattatgtgtgtaaacacacctacgtggatcggggctgggggaacggatgcggccttttcgggaagggaagcctggtcacatgcgccaagtttcaatgtctcgagcccattgagggcaaagtggttcagtatgaaaatctgaagtacacagtgatcatcaccgtccacacaggggaccagcatcaggtgggaaacgacacgcaaggcgttaccgtggagattacacctcaggcttctaccgtcgaagccgtgctgcccgagtatggcacactcgggctggaatgctcccctcgcaccggacttgatttcaatgagatgatcctgctcacgatgaaaaacaaggcttggatggtccacagacagtggtttttcgacctgccccttccgtggaccagcggcgccacaaccgagacacctacctggaatcggaaagaactgctcgtgacgtttaagaacgcccatgctaaaaagcaagaggttgtggtcctggggtctcaggaaggagcgatgcacacagccctgaccggcgctacagagattcaaaattccgggggcaccagcatcttcgccggacacctcaagtgtcgcctgaaaatggataaacttgaactgaaaggcatgtcttacgccatgtgcctcaacacctttgtgctgaagaaagaggtttccgagacacagcatgggacgattctgatcaaggtggaatacaagggagaggacgctccctgtaaaatccctttcagcaccgaagatggccaagggaaggcccacaacggaagacttattacagcgaatcccgtcgtgaccaaaaaggaggagcccgtgaacatcgaagctgagcctccgttcggcgaatccaatattgttatcgggattggcgacaaagccctcaagatcaactggtataagaaaggatctagcatcggcaagatgtttgaggccacagctagaggggccagacgcatggctattctgggagataccgcctgggacttcggctccgtcgggggagtgctgaatagcctcggcaaaatggtgcatcagatctttgggtctgcgtacacggccctgttctccggcgtcagctggattatgaagatcggaattggcgtgcttctgacatggatcgggctcaactctaaaaataccagcatgtccttttcttgcattgttatcggaatcattaccctgtatctgggcgctgtggtccaggccgatatggggtgtgctatcaactggaagggaaaggaacttaaatgcggcagcgggattttcgtgacaaatgaggttcacacctggacagagcagtacaagtttcaagccgactcccccaaacggctcgcgacggccatcgctggcgcctgggaaaacggagtgtgtggcattagaagcaccacacgcatggagaatctgctgtggaagcagatcgctaacgaactcaattatatcctgtgggagaacaatattaaacttaccgtcgtggttggggatatcattggagtgctggaacagggcaagcggacactcacccctcagcccatggagctgaaatactcttggaagacgtgggggaaggccaaaatcgtcaccgccgagacacaaaactccagcttcattatcgacggacctaacacccccgaatgcccgtctgcttccagagcgtggaatgtgtgggaggtggaagactatggctttggcgtcttcacaaccaacatctggctgaaacttcgcgaggtttacacacagagctgtgatcatcggctcatgtccgccgctattaaagacgaaagagccgtgcacgccgatatggggtactggatcgagtctcagaagaatggaagctggaaactggagaaggcttcctttattgaagtgaagacctgcacgtggcctaaatctcacacactgtggagcaacggcgtcctcgagtccgacatgatcattcccaagagcctggccgggcctatctctcagcataatcaccgccccggatatcatacccaaaccgcgggcccttggcaccttgggaaactggaactcgatttcaactactgcgagggaacaaccgtggttatcacggagaattgtggcacacggggcccctccctgagaaccacaaccgtgagcgggaagctgattcacgaatggtgctgtcgctcttgcacacttccgcctctccggtatatgggagaggacggctgttggtacgggatggaaatcagacccattaacgagaaagaagagaatatggtcaagtccctggtgagcgctggatctggcaaggttgataactttaccatgggggtgctgtgcctcgccatcctgttcgaggaagtcatgcggggaaaattcggcaagaaacatatgattgccggcgtgctttttacgttcgttctgctcctgagcgggcagatcacctggcgcgacatggctcacacactgattatgatcggatccaatgccagcgatagaatgggcatgggggtgacctatcttgcgctgatcgctacatttaagattcagcccttcctcgccctgggatttttcctccggaaactgacctctagagagaaccttctgctcggcgtcgggctggccatggctacgacactgcaacttcctgaagacatcgagcagatggccaatggaattgctctgggcctcatgaccctgaagctcatcacacagtttgaaacctaccagctgtggaccgcccttgtgtccctgacatgtagcaacacgattttcaccctcacagtggcgtggcgcaccgccacactgatcctggctggcgtctcccttctgccgctctgccaatctagctccatgcggaagaccgattggctgcccatgacggttgccgctatgggggtgcctcccctccctctgtttatcttctctcttaaagacacacccaagagacgcagctggcctctgaatgagggagtgatggccgtcggcctggtgtccattctcgcctctagcctgcttagaaacgatgttcccatggctgggccgctggtggcgggaggcctcctgatcgcctgttatgtcattaccgggacctccgctgacctcacagtggagaaagccgccgacgttacctgggaagaggaagctgagcagacaggagtgagccataacctgatgatcacggtcgatgacgatggcaccatgcggattaaggacgatgaaacagagaatatccttaccgtgctgctgaaaacagccctcctgatcgtctctggcatttttccttactccatccccgcgacccttctggtgtggcacacgtggcagaagcagacccaacgcagcggggttctctgggacgtgccttctcccccggagacacagaaagctgaactggaggaaggagtctacagaattaagcagcagggcatcttcgggaagacccaagtgggagttggcgtgcagaaagagggggtctttcatacaatgtggcacgtgacccggggagccgtgctcacacacaacggcaagcgcctggagcctaattgggcctccgttaaaaaggatcttattagctatggcgggggatggagactgtctgctcagtggcaaaaaggcgaagaggtccaggtgatcgccgtggaacccgggaagaaccctaagaatttccagacgatgcccggaattttccagaccacaaccggcgagatcggggcgatcgctctggactttaaacccggaacctccggcagccctattatcaaccgggaaggcaaggtcgtggggctctacggaaatggcgttgtgaccaagaacgggggatatgtctccggcattgcccaaacgaatgccgagccggatgggcccacccctgagctggaagaggaaatgttcaagaaacgcaaccttacaatcatggacctgcatcccggcagcggaaagaccagaaagtacctccctgctattgtgcgggaggccatcaaacgcagactgcggacactcatcctggctcccaccagagttgtggccgcggaaatggaggaggcccttaagggcctgcctattcgctatcagacgacagctaccaaatctgaacacaccgggcgggagatcgtcgatctgatgtgccatgccacatttaccatgagactcctgagcccggtgcgcgttcccaattacaaccttattatcatggacgaagctcacttcacagatcctgcctccattgccgctcggggatatatctctaccagagtgggcatgggggaggcggccgctatctttatgacggccacaccccctggaaccgccgaggctttcccccagagcaatgccccgattcaggacgaggagcgcgacatccctgaacggtcctggaactctggcaatgagtggattacagattttgtcgggaagaccgtgtggttcgtgcccagcatcaaagcgggcaacgacattgctaactgtctgagaaagaatggaaagaaagtcatccaactctcccgcaagacgtttgataccgaataccagaaaacacggctgaacgactgggatttcgttgtgaccacagacatttctgagatgggcgccaattttaaggccgatagagtgatcgacccccggcgctgcctgaaacctgtcatcctcaccgatgggcccgagagagtgattcttgctggacctatgccggttacagccgcgagcgccgctcagcggcgcggcagagtggggcggaacccccagaaggaaaatgaccaatacatcttcaccggacagcctctgaacaatgatgaggaccatgcccactggacggaagctaagatgctgctcgacaacattaatacacccgagggcatcattcctgccctgttcgaacccgagagagagaaatccgctgccatcgatggggaatatcgccttaagggcgagagccggaaaacctttgtcgaactgatgagacgcggagacctcccggtgtggctggcgcacaaggttgcctctgagggcatcaaatacaccgatcggaagtggtgcttcgacggggaaagaaacaatcagattctggaggagaacatggatgtggaaatctggacaaaagagggagaacgcaagaagctccggcctagatggcttgacgctcgcacctattccgatcccctggccctgaaagagtttaaggacttcgctgccggcagaaaaagcattgccctcgatctggtcacagaaatcgggcgggtgccttctcatcttgcttaccgcacgagaaatgcgctggacaacctcgtcatgctgcacacctccgagcatggaggccgggcctatcgccacgctgtggaggaactgcccgagacaatggaaaccctccttctgctgggcctcatgattctgcttacagggggagccatgctgtttctcatcagcggcaaggggatcggaaaaacctccattggcctgatctgtgttattgtgtctagcgggatgctgtggatggccgatgtgcctctccagtggatcgcttccgccattatccttgagttctttatgatggtcctgctgattcccgagccggaaaagcaaagaacgcctcaggacaatcagctcgcgtacgttgtgatcggaatcctgacccttgccgctattgtggccgctaacgagatgggcctgctcgaaacaaccaagcgggatctgggcatgagcaaagagcccggggtcgtgtctcccacatcctatctggacgttgacctccaccctgccagcgcgtggaccctttacgccgtggctacgacagtcatcaccccgatgctgagacatacaattgaaaattctaccgccaacgtgagcctggctgccatcgctaaccaagccgtcgtgctcatgggactggataagggctggcccatttccaaaatggaccttggggttcctctgctcgcgctgggatgctactctcaggtgaatcccctgaccctcacagccgctgtccttctgctggtgacgcactatgccatcatcggccctgggctccaggctaaggccacccgcgaggcccagaaacggacagcggctggaattatgaagaaccccaccgttgatggcatcatgacaattgacctggatcctgtgatctacgacagcaagttcgagaaacaacttggccaggtcatgctgctcgtgctgtgtgccgtgcagctgctccttatgagaacctcctgggctctgtgcgaagccctgacgctcgccacagggccgattaccaccctgtgggagggatctcccggcaagttttggaatacaaccatcgctgttagcatggccaacatcttccgcgggtcctatcttgcgggagccggcctggcttttagcattatgaaatctgtcgggacaggacggagaggcacgggctcccagggggaaaccctcggagagaagtggaaaaagaagctgaatcaactgagccggaaagagttcgatctctacaagaaatccggcatcacagaggtggaccgcaccgaggccaaggaagggcttaaaagaggagagacaacccatcacgctgtgtctcggggcagcgccaagctgcagtggtttgtcgaacgcaacatggttattcctgaggggagagtgatcgatctgggatgtggccggggcgggtggtcctattactgcgcgggactcaaaaaggtgacggaagtccgcggctataccaaaggcgggcccgggcatgaggagcctgtgcccatgtctacatacgggtggaatctggttaaacttatgagcggaaaggacgtgttctacctgccgcctgaaaaatgtgataccctcctgtgcgacattggcgagtccagcccctctcccacagtcgaagagtccagaaccatccgggtgctgaagatggttgagccttggctcaaaaacaatcagttctgtattaaggtgcttaacccctatatgcctacagtcatcgaacacctggagcgcctgcagagaaagtacggcgggatgctcgtgcggaatccgctgagcagaaactctacccacgaaatgtattggatctccaatggaacgggcaacattgtgagctctgtcaatatggttagccgccttctgctcaaccggtttacaatgacccatagacgccccaccatcgagaaagatgtggacctgggggccggaacacggcacgtgaacgctgaacctgagacgcccaatatggacgtcattggcgagagaatcaagcgcattaaagaagaacattcctctacctggcactacgatgacgaaaacccttataagacatgggcctaccacgggagctatgaggtgaaagctaccggatccgccagctccatgatcaatggcgttgtgaagctgctcacaaagccctgggatgtcgtgccgatggttacccaaatggctatgacagacaccacgcctttcggccagcagcgggtgtttaaagaaaaggtcgataccagaacaccccgccctatgcccgggacccggaaagtgatggagatcacagccgagtggctgtggagaacccttggacgcaacaagaaacctcggctgtgcacgagagaagagttcacaaagaaggttcgcaccaatgcggccatgggcgctgtgtttacagaagagaaccaatgggactctgccagagctgccgtcgaagatgaggagttctggaaactcgtggaccgggaacgcgagctgcataaacttgggaaatgtggaagctgcgtctacaatatgatgggcaagagagagaagaagctgggggagtttggcaaagccaagggatcccgggcgatttggtacatgtggctcggcgctagatatctggagttcgaagccctggggtttctcaacgaggatcactggttctctcgggaaaatagctactccggagtggagggcgaagggctgcataaacttggatatatcctgcgcgacatttctaaaatccccggcggggccatgtacgctgatgacaccgccggctgggacacgagaattaccgaggatgacctccacaacgaggaaaagatcacacagcagatggatccggagcatcggcagctggctaatgccatctttaaacttacctatcaaaacaaggttgtgaaagtccagcgccctacacccaagggaaccgtgatggacattatcagcagaaaggatcagcggggctccggacaggtgggaacatacggcctgaataccttcacgaacatggaagcgcaactcgttcgccagatggagggggaaggagtgctgagcaaagccgacctggagaatccccacctcctggagaagaaaattacacagtggcttgaaaccaagggcgtcgagagactgaaacggatggctatctctggggatgactgcgtggttaagcctattgatgaccgctttgccaacgctctcctggcccttaacgatatgggcaaggtgagaaaagacatcccgcagtggcaaccctccaagggatggcacgattggcagcaggtccctttctgtagccatcacttccatgaactgatcatgaaagacggccggaagctcgtggtcccctgccgccctcaggacgagctgattgggagagcgcggatctctcaaggagccggctggtccctgaaagaaaccgcttgtctcgggaaggcctatgctcagatgtggagcctgatgtactttcaccgcagagatcttcggctggcctctaatgctatttgctccgccgtgcccgttcactggatccctacaagcagaaccacatggtccattcatgcgcaccatcagtggatgacgaccgaggacatgctcacagtgtggaaccgcgtctggatcgaggataatccctggatggaagacaagaccccggtgacaacctgggaggatgttccttacctgggaaaacgggaagaccaatggtgtggcagccttattgggctgacgtctagagccacctgggctcagaacatcctcacagccatccaacaggtgcgcagcctgattggcgatgaggagttcctggactatatgccctccatgaagcggtttagaaaagaagaggaatctgagggagccatctggtga

SEQ ID NO: 20857 - RNA, 9873 nt, synthetic construct
  misc_feature 1..9873: note = derived and/or modified CDS sequence (opt5) from DENV-3__FJ461326__SS-prME
  source 1..9873: mol_type = other RNA
acctccctgtgcctgatgatgatgctgcccgcgacacttgctttccacctgacgtcccgggacggagagcctcggatgatcgtggggaagaacgaacgcggaaaatctctcctgtttaagaccgccagcggaattaatatgtgtacacttatcgcgatggatctgggggagatgtgcgacgataccgtcacatacaaatgtccgctcattgctgaagttgagcccgaagacatcgattgctggtgtaacctgacctccacatgggtgacctatggaacgtgcaatcaggccggcgagcatcggcgggacaagcgctctgtggccctggctcctcacgtcgggatgggactcgataccagaacacaaacctggatgagcgccgagggcgcttggagacaggtggaaaaagttgagacatgggccctgcgccatcccggcttcaccattcttgcgctgtttctcgcccactacatctccacgtctctgacacagaaggtggtcatcttcattcttctgatgctcgtgacccctagcatgacaatgagatgtgttggggtgggaaaccgggactttgtcgaaggcctgtccggggctacctgggtggatgtggtcctggagcatggaggctgcgttaccacaatggcccgcaataagcccacgctcgacatcgagctgcagaaaaccgaagctacacaacttgccaccctgagaaagctctgtattgaggggaaaatcacaaacattaccacggatagccggtgccctacacagggagaagcgatcctgccggaggaacaggaccagaattatgtgtgtaagcacacctacgtggatcgcggctggggcaacgggtgcggacttttcggcaaagggtctctggtcacatgcgccaagtttcaatgtctcgagcccattgagggaaaggtggttcagtatgaaaatctgaaatacacagtgatcatcaccgtccacacaggcgaccagcatcaggtggggaacgacacgcaaggagttaccgtggagattacacctcaggcttccaccgtcgaagccgtgctgcccgagtatggcacactcggcctggaatgcagccctagaaccgggcttgatttcaatgagatgatcctgctcacgatgaagaacaaggcttggatggtccaccggcagtggtttttcgacctgccccttccgtggacctctggagccacaaccgagacacctacctggaatcgcaaggaactgctcgtgacgtttaaaaacgcccatgctaagaaacaagaggttgtggtcctgggctcccaggaaggggcgatgcacacagccctgaccggagctacagagattcagaatagcggcgggacctctatcttcgccggccacctcaagtgtagactgaagatggataaacttgaactgaagggaatgtcctacgccatgtgcctcaacacctttgtgctgaaaaaggaggttagcgagacacagcatggcacgattctgatcaaagtggaatacaagggggaggacgctccctgtaagatccctttctccaccgaagatggacaaggcaaagcccacaacgggcggcttattacagcgaatcccgtcgtgaccaagaaagaggagcccgtgaacatcgaagctgagcctccgttcggagaatctaatattgttatcggcattggggacaaggccctcaaaatcaactggtataagaagggcagctccatcggaaaaatgtttgaggccacagctagaggcgcccgccggatggctattctgggggataccgcctgggacttcggaagcgtcggcggggtgctcaattctctcggaaagatggtgcatcagatctttggctccgcgtacacggccctgttcagcggggtctcttggattatgaaaatcggcattggagtgcttctgacatggatcggcctcaacagcaagaatacctccatgtcttttagctgcattgttatcgggatcattaccctgtatctgggagctgtggtccaggccgatatgggctgtgctatcaactggaaagggaaggaacttaagtgcggatccggcattttcgtgacaaatgaggttcacacctggacagagcagtacaaatttcaagccgacagccccaagagactcgcgacggccatcgctggggcctgggaaaacggcgtgtgtggcattcgctctaccacacggatggagaatctgctgtggaaacagatcgctaacgaactcaattatatcctgtgggagaacaatattaaacttaccgtcgtggttggcgatatcattggggtgctggaacagggaaaaagaacactcacccctcagcccatggagctgaagtactcctggaaaacgtggggcaaggccaagatcgtcaccgccgagacacaaaacagctctttcattatcgacgggcctaacacccccgaatgcccgtccgctagccgcgcgtggaatgtgtgggaggtggaagactatggatttggcgtcttcacaaccaacatctggctgaaacttcgggaggtttacacacagtcctgtgatcatagactcatgtctgccgctattaaggacgaacgcgccgtgcacgccgatatgggctactggatcgagagccagaaaaatgggtcctggaagctggagaaagctagctttattgaagtgaagacctgcacgtggcctaagagccacacactgtggtccaacggagtcctcgagagcgacatgatcattcccaaatctctggccggccctatctcccagcataatcaccggcccgggtatcatacccaaaccgcgggaccttggcaccttggcaagctggaactcgatttcaactactgcgaggggacaaccgtggttatcacggagaattgtggaacaagaggccccagcctgcgcaccacaaccgtgtctggcaaactgattcacgaatggtgctgtcggtcctgcacacttccgcctctcagatatatgggggaggacggatgttggtacggcatggaaatccggcccattaacgagaaggaagagaatatggtcaaaagcctggtgtctgctgggagcggaaaggttgataactttaccatgggcgtgctgtgcctcgccatcctgttcgaggaagtcatgcgcgggaagttcggcaagaagcatatgattgccggcgtgctttttacgttcgttctgctcctgtccggccagatcacctggagagacatggctcacacactgattatgatcgggagcaatgcctctgatcggatgggaatgggcgtgacctatcttgcgctgatcgctacatttaaaattcagcccttcctcgccctggggtttttcctcagaaagctgacctcccgcgagaaccttctgctcggagtcggcctggccatggctacgacactgcaacttcctgaagacatcgagcagatggccaatgggattgctctgggactcatgaccctgaaactcatcacacagtttgaaacctaccagctgtggaccgcccttgtgagcctgacatgttccaacacgattttcaccctcacagtggcgtggcggaccgccacactgatcctggctggcgtctctcttctgccgctctgccaaagctcctctatgagaaagaccgattggctgcccatgacggttgccgctatgggcgtgcctcccctccctctgtttatcttcagccttaaggacacacccaaacgcagatcctggcctctgaatgagggggtgatggccgtcggactggtgtctattctcgccagctccctgcttcggaacgatgttcccatggctggcccgctggtggccgggggactcctgatcgcctgttatgtcattaccggcaccagcgctgacctcacagtggagaaggccgccgacgttacctgggaagaggaagctgagcagacaggggtgtctcataacctgatgatcacggtcgatgacgatggaaccatgcgcattaaagacgatgaaacagagaatatccttaccgtgctgctgaagacagccctcctgatcgtctccggcatttttccttacagcatccccgcgacccttctggtgtggcacacgtggcagaaacagacccaaagatctggcgttctctgggacgtgccttctcccccggagacacagaaggctgaactggaggaaggggtctaccggattaaacagcagggaatcttcggcaagacccaagtgggggttggagtgcagaaggagggcgtctttcatacaatgtggcacgtgacccgcggggccgtgctcacacacaacggaaaaagactggagcctaattgggccagcgttaagaaagatcttattagctatggcggcgggtggcggctgtccgctcagtggcaaaagggagaagaggtccaggtgatcgccgtggaacccggcaaaaaccctaagaatttccagacgatgcccgggattttccagaccacaaccggagagatcggcgcgatcgctctggactttaagcccgggaccagcggatcccctattatcaaccgcgaaggcaaagtcgtgggcctctacgggaatggagttgtgacaaagaacggcgggtatgtcagcggaattgcccaaacgaatgccgagccggatggccccacccctgagctggaagaggaaatgttcaaaaagagaaaccttacaatcatggacctgcatcccgggtctggcaaaacccggaagtacctccctgctattgtgcgcgaggccatcaagagacggctgagaacactcatcctggctcccacccgcgttgtggccgcggaaatggaggaggcccttaaaggactgcctattcggtatcagacgacagctaccaagagcgaacacaccggcagagagatcgtcgatctgatgtgccatgccacatttaccatgcgcctcctgtccccggtgcgggttcccaattacaaccttattatcatggacgaagctcacttcacagatcctgcctctattgccgctagagggtatatcagcacccgcgtgggaatgggcgaggcggccgctatctttatgacggccacaccccctgggaccgccgaggctttcccccagtccaatgccccgattcaggacgaggagcgggacatccctgaaagatcttggaacagcggaaatgagtggattacagattttgtcggcaaaaccgtgtggttcgtgccctccatcaaggcggggaacgacattgctaactgtctgcgcaaaaatggcaagaaggtcatccaactctctcggaaaacgtttgataccgaataccagaagacaagactgaacgactgggatttcgttgtgaccacagacattagcgagatgggagccaattttaaagccgatcgggtgatcgacccccgcagatgcctgaagcctgtcatcctcaccgatggccccgagcgggtgattcttgctgggcctatgccggttacagccgcgtccgccgctcagcgcagaggacgggtgggcagaaacccccagaaagaaaatgaccaatacatcttcaccgggcagcctctgaacaatgatgaggaccatgcccactggacggaagctaagatgctgctcgacaacattaatacacccgagggaatcattcctgccctgttcgaacccgagcgcgaaaagtctgctgccatcgatggcgaatatcggcttaaaggggagtctagaaagacctttgtcgaactgatgcgccggggcgacctcccggtgtggctggcgcacaaagttgcctccgagggaatcaagtacaccgatagaaaatggtgcttcgacggcgaacgcaacaatcagattctggaggagaacatggatgtggaaatctggacaaaggagggggaacggaaaaagctcagacctcgctggcttgacgctagaacctatagcgatcccctggccctgaaggagtttaaagacttcgctgccggacggaagtctattgccctcgatctggtcacagaaatcggccgcgtgccttcccatcttgcttacagaacgcggaatgcgctggacaacctcgtcatgctgcacaccagcgagcatgggggacgcgcctatagacacgctgtggaggaactgcccgagacaatggaaaccctccttctgctgggcctcatgattctgcttacaggcggggccatgctgtttctcatctccggaaaaggcatcgggaagacctctattggactgatctgtgttattgccagctccggcatgctgtggatggctgatgtgcctctccagtggatcgccagcgcgattatccttgagttctttatgatggtgctgctgattcccgagccggaaaaacaacggacgcctcaggacaatcagctcgcctacgtcgttatcgggatcctgacccttgctgccattgtggctgccaacgagatgggactgctcgaaacaaccaagagagatctgggcatgtctaaggagcccggcgtggtctcccccacaagctatctggacgtggacctccaccctgcgtctgcctggaccctttacgctgttgccacgacagtgatcaccccgatgctgcgccatacaattgaaaatagcaccgctaacgtctccctggccgctatcgccaaccaagcggtggtcctcatggggctggataaaggatggcccatttctaagatggaccttggcgtgcctctgctcgccctggggtgctacagccaggttaatcccctgaccctcacagctgccgtgcttctgctggtcacgcactatgctatcatcggacctggcctccaggccaaagccacccgggaggcgcagaagagaacagctgccgggattatgaaaaaccccaccgtggatggaatcatgacaattgacctggatcctgttatctacgactccaagttcgagaagcaacttggccaggtgatgctgctcgtcctgtgtgctgtgcagctgctccttatgcgcacctcttgggccctgtgcgaagccctgacgctcgctacaggcccgattaccaccctgtgggaggggagccccggaaaattttggaatacaaccatcgccgtgtccatggcgaacatcttccggggcagctatcttgccggggctggactggccttttctattatgaagtccgttggcacagggagacggggaacgggcagccagggcgaaaccctcggggagaaatggaagaaaaagctgaatcaactgtcccgcaaggagttcgatctctacaaaaagtctggaatcacagaggtcgacagaaccgaggctaaagaaggccttaagagaggggaaacaacccatcacgccgtgagccgcggatccgcgaaactgcagtggtttgtggaaagaaacatggtcattcctgagggccgggttatcgatctggggtgtggacgcggcggctggtcttattactgcgccgggctcaagaaagtgacggaagtgagaggatataccaagggcgggcccggacatgaggagcctgtccccatgagcacatacggctggaatctggtgaaacttatgtccgggaaagacgttttctacctgccgcctgaaaagtgtgataccctcctgtgcgacattggagagagctctccctcccccacagtggaagagagccggaccatccgcgtcctgaaaatggtggagccttggctcaagaacaatcagttctgtattaaagttcttaacccctatatgcctacagtgatcgaacacctggagagactgcagcggaagtacggcggcatgctcgtcagaaatccgctgtctcgcaactccacccacgaaatgtattggatcagcaatgggacgggaaacattgtgtctagcgtgaatatggtctcccggcttctgctcaacagatttacaatgacccatcgccggcccaccatcgagaaggatgttgacctgggcgctgggacaagacacgtgaacgccgaacctgagacgcccaatatggacgtgattggagagcgcatcaaacggattaaggaagaacattctagcacctggcactacgatgacgaaaacccttataaaacatgggcttaccacggctcctatgaggtcaaggccaccgggagcgcttcctctatgatcaatggagtggttaaactgctcacaaagccctgggatgtggtcccgatggtgacccaaatggccatgacagacaccacgcctttcggccagcagagagtttttaaggaaaaagtggatacccgcacaccccggcctatgcccggcaccagaaaggtcatggagatcacagcggagtggctgtggcgcacccttgggcggaacaaaaagcctagactgtgcacgcgcgaagagttcaccaagaaggtgagaaccaatgccgctatgggagccgtttttacagaagagaaccaatgggacagcgctcgggccgccgtggaagatgaggagttctggaagctcgtcgaccgcgaaagagagctgcataaacttggcaagtgtgggtcctgcgtgtacaatatgatgggaaaacgggaaaagaaactgggcgagtttgggaaggcgaaaggctctagagctatttggtacatgtggctcggagcccggtatctggagttcgaagccctgggctttctcaacgaggatcactggttcagccgcgaaaattcctactctggggtcgagggagaaggcctgcataaacttgggtatatcctgagagacattagcaagatccccggaggcgctatgtacgccgatgacaccgctgggtgggacacgcggattaccgaggatgacctccacaacgaggagaaaatcacacagcagatggatccggagcatcgcaagctggccaatgcgatctttaaacttacctatcagaacaaggtggttaaagtgcaaagacctacacccaagggcaccgtcatggacattatctcccggaaggatcagcgcggaagcggccaggtggggacatacggactgaataccttcacgaacatggaagcccagctcgtgagacaaatggagggcgaaggggttctgtctaaagctgacctggagaatccccacctcctggagaagaaaattacacagtggcttgaaaccaagggagtggagcggctgaaacgcatggccatctccggcgatgactgcgtcgtgaagcctattgatgacagatttgctaacgccctcctggcgcttaacgatatggggaaggttcggaaagacatcccgcagtggcagcccagcaagggctggcacgattggcaacaggtgcctttctgttctcatcacttccatgaactgatcatgaaagacggacgcaagctcgtcgtgccctgcagacctcaggacgagctgattggccgggcccgcatctcccagggggctggatggagcctgaaagaaaccgcctgtctcggcaaggcttatgcccaaatgtggtctctgatgtactttcacagacgggatcttagactggcttccaatgccatttgcagcgcggtccccgtgcactggatccctacatcccgcaccacatggagcattcatgcccaccatcagtggatgacgaccgaggacatgctcacagtttggaaccgggtgtggatcgaggataatccctggatggaagacaagaccccggtcacaacctgggaggatgtgccttacctggggaaaagagaagaccagtggtgtggatctcttattggcctgacgagccgcgctacctgggcccaaaacatcctcacagccatccagcaggttcggtccctgattggggatgaggagttcctggactatatgccctctatgaagagatttcgcaaagaagaggaaagcgagggcgctatctggtga

SEQ ID NO: 20858 - RNA, 9873 nt, synthetic construct
  misc_feature 1..9873: note = derived and/or modified CDS sequence (opt5) from DENV-3__FJ461329__SS-prME
  source 1..9873: mol_type = other RNA
accagcctgtgcctcatgatgatgctgcccgccacacttgctttccacctgacgtcccgggacggcgaacctcggatgatcgtggggaagaatgaacgcggaaagtctctcctgtttaagaccgccagcggcattaatatgtgtacacttatcgcgatggatctgggggaaatgtgcgacgataccgtcacatacaagtgtccgctcattgctgaagttgagcccgaagacatcgattgctggtgtaacctgacctccacatgggtgacctatggaacgtgcaatcaggccggcgagcatcggcgggacaagcgctctgtggccctggctcctcacgtcgggatgggactcgataccagaacacagacctggatgagcgccgagggcgcttggagacaggtggaaaaggttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagaataaacccacgctcgacatcgagctgcagaagaccgaagctacacagcttgccaccctgcgcaaactctgtattgagggaaagatcacaaacattaccacggattccagatgccctacacagggcgaagcgatcctgccggaggaacaggaccagaattatgtgtgtaaacacacctacgtggatcggggctgggggaacggatgcggccttttcgggaagggaagcctggtcacatgcgccaagtttcaatgtctcgagcccattgagggcaaagtggttcagtatgaaaatctgaagtacacagtgatcatcaccgtccacacaggggaccagcatcaggtgggaaacgacacgcaaggcgttaccgtggagattacacctcaggcttctaccgtcgaagccgtgctgcccgagtatggcacactcgggctggaatgctcccctcgcaccggacttgatttcaatgagatgatcctgctcacgatgaaaaacaaggcttggatggtccacagacagtggtttttcgacctgccccttccgtggaccagcggcgccacaaccgagacacctacctggaatcggaaagaactgctcgtgacgtttaagaacgcccatgctaaaaagcaagaggttgtggtcctggggtctcaggaaggagcgatgcacacagccctgaccggcgctacagagattcaaaattccgggggcaccagcatcttcgccggacacctcaagtgtcgcctgaaaatggataaacttgaactgaaaggcatgtcttacgccatgtgcctcaacacctttgtgctgaagaaagaggtttccgagacacagcatgggacgattctgatcaaggtggaatacaagggagaggacgctccctgtaaaatccctttcagcaccgaagatggccaagggaaggcccacaacggaagacttattacagcgaatcccgtcgtgaccaaaaaggaggagcccgtgaacatcgaagctgagcctccgttcggcgaatccaatattgttatcgggattggcgacaaagccctcaagatcaactggtataagaaaggatctagcatcggcaagatgtttgaggccacagctagaggggccagacgcatggctattctgggagataccgcctgggacttcggctccgtcgggggagtgctgaatagcctcggcaaaatggtgcatcagatctttgggtctgcgtacacggccctgttctccggcgtcagctggattatgaagatcggaattggcgtgcttctgacatggatcgggctcaactctaaaaataccagcatgtccttttcttgcattgttatcggaatcattaccctgtatctgggcgctgtggtccaggccgatatggggtgtgctatcaactggaagggaaaggaacttaaatgcggcagcgggattttcgtgacaaatgaggttcacacctggacagagcagtacaagtttcaagccgactcccccaaacggctcgcgacggccatcgctggcgcctgggaaaacggagtgtgtggcattagaagcaccacacgcatggagaatctgctgtggaagcagatcgctaacgaactcaattatatcctgtgggagaacaatattaaacttaccgtcgtggttggggatatcattggagtgctggaacagggcaagcggacactcacccctcagcccatggagctgaaatactcttggaagacgtgggggaaggccaaaatcgtcaccgccgagacacaaaactccagcttcattatcgacggacctaacacccccgaatgcccgtctgcttccagagcgtggaatgtgtgggaggtggaagactatggctttggcgtcttcacaaccaacatctggctgaaacttcgcgaggtttacacacagagctgtgatcatcggctcatgtccgccgctattaaagacgaaagagccgtgcacgccgatatggggtactggatcgagtctcagaagaatggaagctggaaactggagaaggcttcctttattgaagtgaagacctgcacgtggcctaaatctcacacactgtggagcaacggcgtcctcgagtccgacatgatcattcccaagagcctggccgggcctatctctcagcataatcaccgccccggatatcatacccaaaccgcgggcccttggcaccttgggaaactggaactcgatttcaactactgcgagggaacaaccgtggttatcacggaggactgtggcacacggggcccctccctgagaaccacaaccgtgagcgggaagctgattcacgaatggtgctgtcgctcttgcacacttccgcctctccggtatatgggagaggatggctgttggtacgggatggaaatcagacccattaatgagaaagaagagaacatggtcaagtccctggtgagcgctggatctggcaaggttgacaattttaccatgggggtgctgtgcctcgccatcctgttcgaggaagtcatgcggggaaaattcggcaagaaacatatgattgccggcgtgctttttacgttcgttctgctcctgagcgggcagatcacctggcgcgatatggctcacacactgattatgatcggatccaacgccagcgacagaatgggcatgggggtgacctatcttgcgctgatcgctacatttaagattcagcccttcctcgccctgggatttttcctccggaaactgacctctagagagaatcttctgctcggcgtcgggctggccatggctacgacactgcaacttcctgaagatatcgagcagatggccaacggaattgctctgggcctcatgaccctgaagctcatcacacagtttgaaacctaccagctgtggaccgcccttgtgtccctgacatgtagcaatacgattttcaccctcacagtggcgtggcgcaccgccacactgatcctggctggcgtctcccttctgccgctctgccaatctagctccatgcggaagaccgactggctgcccatgacggttgccgctatgggggtgcctcccctccctctgtttatcttctctcttaaagatacacccaagagacgcagctggcctctgaacgagggagtgatggccgtcggcctggtgtccattctcgcctctagcctgcttagaaatgacgttcccatggctgggccgctggtggcgggaggcctcctgatcgcctgttatgtcattaccgggacctccgctgacctcacagtggagaaagccgccgatgttacctgggaagaggaagctgagcagacaggagtgagccataacctgatgatcacggtcgacgatgacggcaccatgcggattaaggatgacgaaacagagaacatccttaccgtgctgctgaaaacagccctcctgatcgtctctggcatttttccttactccatccccgcgacccttctggtgtggcacacgtggcagaagcagacccaacgcagcggggttctctgggatgtgccttctcccccggagacacagaaagctgaactggaggaaggagtctacagaattaagcagcagggcatcttcgggaagacccaagtgggagttggcgtgcagaaagagggggtctttcatacaatgtggcacgtgacccggggagccgtgctcacacacaatggcaagcgcctggagcctaactgggcctccgttaaaaaggaccttattagctatggcgggggatggagactgtctgctcagtggcaaaaaggcgaagaggtccaggtgatcgccgtggaacccgggaagaatcctaagaacttccagacgatgcccggaattttccagaccacaaccggcgagatcggggcgatcgctctggattttaaacccggaacctccggcagccctattatcaatcgggaaggcaaggtcgtggggctctacggaaacggcgttgtgaccaagaatgggggatatgtctccggcattgcccaaacgaacgccgagccggacgggcccacccctgagctggaagaggaaatgttcaagaaacgcaatcttacaatcatggatctgcatcccggcagcggaaagaccagaaagtacctccctgctattgtgcgggaggccatcaaacgcagactgcggacactcatcctggctcccaccagagttgtggccgcggaaatggaggaggcccttaagggcctgcctattcgctatcagacgacagctaccaaatctgaacacaccgggcgggagatcgtcgacctgatgtgccatgccacatttaccatgagactcctgagcccggtgcgcgttcccaactacaatcttattatcatggatgaagctcacttcacagaccctgcctccattgccgctcggggatatatctctaccagagtgggcatgggggaggcggccgctatctttatgacggccacaccccctggaaccgccgaggctttcccccagagcaacgccccgattcaggacgaggagcgcgatatccctgaacggtcctggaactctggcaacgagtggattacagactttgtcgggaagaccgtgtggttcgtgcccagcatcaaagcgggcaatgatattgctaactgtctgagaaagaacggaaagaaagtcatccaactctcccgcaagacgtttgacaccgaataccagaaaacacggctgaatgattgggacttcgttgtgaccacagatatttctgagatgggcgccaactttaaggccgacagagtgatcgatccccggcgctgcctgaaacctgtcatcctcaccgacgggcccgagagagtgattcttgctggacctatgccggttacagccgcgagcgccgctcagcggcgcggcagagtggggcggaatccccagaaggaaaacgatcaatacatcttcaccggacagcctctgaataacgacgaggaccatgcccactggacggaagctaagatgctgctcgataatattaacacacccgagggcatcattcctgccctgttcgaacccgagagagagaaatccgctgccatcgacggggaatatcgccttaagggcgagagccggaaaacctttgtcgaactgatgagacgcggagatctcccggtgtggctggcgcacaaggttgcctctgagggcatcaaatacaccgaccggaagtggtgcttcgatggggaaagaaataaccagattctggaggagaatatggacgtggaaatctggacaaaagagggagaacgcaagaagctccggcctagatggcttgatgctcgcacctattccgaccccctggccctgaaagagtttaaggatttcgctgccggcagaaaaagcattgccctcgacctggtcacagaaatcgggcgggtgccttctcatcttgcttaccgcacgagaaacgcgctggataatctcgtcatgctgcacacctccgagcatggaggccgggcctatcgccacgctgtggaggaactgcccgagacaatggaaaccctccttctgctgggcctcatgattctgcttacagggggagccatgctgtttctcatcagcggcaaggggatcggaaaaacctccattggcctgatctgtgttattgtgtctagcgggatgctgtggatggccgacatccctctccagtggattgcttccgccatcgtgcttgagttctttatgatggtcctgctgattcccgagccggaaaagcaaagaacgcctcaggataaccagctcgcgtacgttgtgatcggaatcctgacccttgccgctattgtggccgctaatgagatgggcctgctcgaaacaaccaagcgggacctgggcatgagcaaagagcccggggtcgtgtctcccacatcctatctggacgttgatctccaccctgccagcgcgtggaccctttacgccgtggctacgacagtcatcaccccgatgctgagacatacaattgaaaactctaccgccaatgtgagcctggctgccatcgctaaccaagccgtcgtgctcatgggactggacaagggctggcccatttccaaaatggatcttggggttcctctgctcgcgctgggatgctactctcaggtgaaccccctgaccctcacagccgctgtccttctgctggtgacgcactatgccatcatcggccctgggctccaggctaaggccacccgcgaggcccagaaacggacagcggctggaattatgaagaatcccaccgttgacggcatcatgacaattgatctggaccctgtgatctacgatagcaagttcgagaaacaacttggccaggtcatgctgctcgtgctgtgtgccgtgcagctgctccttatgagaacctcctgggctctgtgcgaagccctgacgctcgccacagggccgattaccaccctgtgggagggatctcccggcaagttttggaacacaaccatcgctgttagcatggccaatatcttccgcgggtcctatcttgcgggagccggcctggcttttagcattatgaaatctgtcgggacaggacggagaggcacgggctcccagggggaaaccctcggagagaagtggaaaaagaagctgaaccaactgagccggaaagagttcgacctctacaagaaatccggcatcacagaggtggatcgcaccgaggccaaggaagggcttaaaagaggagagacaacccatcacgctgtgtctcggggcagcgccaagctgcagtggtttgtcgaacgcaatatggttattcctgaggggagagtgatcgacctgggatgtggccggggcgggtggtcctattactgcgcgggactcaaaaaggtgacggaagtccgcggctataccaaaggcgggcccgggcatgaggagcctgtgcccatgtctacatacgggtggaacctggttaaacttatgagcggaaaggatgtgttctacctgccgcctgaaaaatgtgacaccctcctgtgcgatattggcgagtccagcccctctcccacagtcgaagagtccagaaccatccgggtgctgaagatggttgagccttggctcaaaaataaccagttctgtattaaggtgcttaatccctatatgcctacagtcatcgaacacctggagcgcctgcagagaaagtacggcgggatgctcgtgcggaacccgctgagcagaaattctacccacgaaatgtattggatctccaacggaacgggcaatattgtgagctctgtcaacatggttagccgccttctgctcaatcggtttacaatgacccatagacgccccaccatcgagaaagacgtggacctgggggccggaacacggcacgtgaacgctgaacctgagacgcccaacatggatgtcattggcgagagaatcaagcgcattaaagaagaacattcctctacctggcactacgacgatgaaaatccttataagacatgggcctaccacgggagctatgaggtgaaagctaccggatccgccagctccatgatcaacggcgttgtgaagctgctcacaaagccctgggacgtcgtgccgatggttacccaaatggctatgacagataccacgcctttcggccagcagcgggtgtttaaagaaaaggtcgacaccagaacaccccgccctatgcccgggacccggaaagtgatggagatcacagccgagtggctgtggagaacccttggacgcaataagaaacctcggctgtgcacgagagaagagttcacaaagaaggttcgcaccaacgcggccatgggcgctgtgtttacagaagagaatcaatgggattctgccagagctgccgtcgaagacgaggagttctggaaactcgtggatcgggaacgcgagctgcataaacttgggaaatgtggaagctgcgtctacaacatgatgggcaagagagagaagaagctgggggagtttggcaaagccaagggatcccgggcgatttggtacatgtggctcggcgctagatatctggagttcgaagccctggggtttctcaatgaggaccactggttctctcgggaaaacagctactccggagtggagggcgaagggctgcataaacttggatatatcctgcgcgatatttctaaaatccccggcggggccatgtacgctgacgacaccgccggctgggatacgagaattaccgaggacgatctccacaatgaggaaaagatcacacagcagatggacccggagcatcggcagctggctaacgccatctttaaacttacctatcaaaataaggttgtgaaagtccagcgccctacacccaagggaaccgtgatggatattatcagcagaaaggaccagcggggctccggacaggtgggaacatacggcctgaacaccttcacgaatatggaagcgcaactcgttcgccagatggagggggaaggagtgctgagcaaagccgatctggagaacccccacctcctggagaagaaaattacacagtggcttgaaaccaagggcgtcgagagactgaaacggatggctatctctggggacgattgcgtggttaagcctattgacgatcgctttgccaatgctctcctggcccttaacgacatgggcaaggtgagaaaagatatcccgcagtggcaaccctccaagggatggcacgactggcagcaggtccctttctgtagccatcacttccatgaactgatcatgaaagacggccggaagctcgtggtcccctgccgccctcaggatgagctgattgggagagcgcggatctctcaaggagccggctggtccctgaaagaaaccgcttgtctcgggaaggcctatgctcagatgtggagcctgatgtactttcaccgcagagaccttcggctggcctctaacgctatttgctccgccgtgcccgttcactggatccctacaagcagaaccacatggtccattcatgcgcaccatcagtggatgacgaccgaggatatgctcacagtgtggaatcgcgtctggatcgaggacaacccctggatggaagataagaccccggtgacaacctgggaggacgttccttacctgggaaaacgggaagatcaatggtgtggcagccttattgggctgacgtctagagccacctgggctcagaatatcctcacagccatccaacaggtgcgcagcctgattggcaacgaggagttcctggactatatgccctccatgaagcggtttagaaaagaagaggaatctgagggagccatctggtga

SEQ ID NO: 20859 - RNA, 9873 nt, synthetic construct
  misc_feature 1..9873: note = derived and/or modified CDS sequence (opt5) from DENV-3__KF955459__SS-prME
  source 1..9873: mol_type = other RNA
accagcctgtgcctcatgatgatgctgcccgccacccttgctttccacctgacgtcccgggacggcgaacctcggatgatcgtggggaagaacgaacgcggaaagtctctcctgtttaagaccgccagcggcattaatatgtgtacacttatcgcgatggatctgggggagatgtgcgacgataccgtcacatacaagtgtccgctcattgctgaagttgagcccgaagacatcgattgctggtgtaacctgacctccacatgggtgacctatggaacgtgcaatcaggccggcgagcatagacgggacaagcgctctgtggccctggctcctcacgtcgggatgggactcgataccagaacacagacctggatgagcgccgagggcgcttggcggcaggtcgaaaaggttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagaataagcccacgctcgacatcgagctgcagaagaccgaagctacacagcttgccaccctgcgcaaactctgtattgagggaaagatcacaaacattaccacggattccagatgccctacacagggcgaagcgatcctgccggaggaacaggaccagaattatgtgtgtaaacacacctacgtggatcggggctgggggaacggatgcggccttttcgggaagggaagcctggtgacctgcgccaagtttcaatgtctcgagcccattgagggcaaagtggttcagtatgaaaatctgaagtacacagtgatcatcaccgtccacacaggggaccagcatcaggtgggaaacgacacgcaaggcgttaccgtggagattacacctcaggcttctaccgtcgaagccgtgctgcccgagtatggcacactcgggctggaatgctcccctcgcaccggacttgatttcaatgagatgatcctgctcacgatgaaaaacaaggcttggatggtccacagacagtggtttttcgacctgccccttccgtggaccagcggcgccacaaccgagacacctacctggaatcggaaagaactgctcgtgacgtttaagaacgcccatgctaaaaagcaagaggttgtggtcctggggtctcaggaaggagcgatgcacacagccctgaccggcgctacagagattcaaaattccgggggcaccagcatcttcgccggacacctcaagtgtcgcctgaaaatggataaacttgaactgaaaggcatgtcttacgccatgtgcctcaacacctttgtgctgaagaaagaggtttccgagacacagcatgggacgattctgatcaaggtggaatacaagggagaggacgctccctgtaaaatccctttcagcaccgaagatggccaagggaaggcccacaacggaagacttattacagcgaatcccgtcgtgaccaaaaaggaggagcccgtgaacatcgaagctgagcctccgttcggcgaatccaatattgttatcgggattggcgacaaagccctcaagatcaactggtataagaaaggatctagcatcggcaagatgtttgaggccacagctagaggggccagacgcatggctattctgggagataccgcctgggacttcggctccgtcgggggagtgctgaatagcctcggcaaaatggtgcatcagatctttgggtctgcgtacacggccctgttctccggcgtcagctggattatgaagatcggaattggcgtgcttctgacatggatcgggctcaactctaaaaataccagcatgtccttttcttgcattgttatcggaatcattaccctgtatctgggcgctgtggtccaggccgatatggggtgtgctatcaactggaagggaaaggaacttaaatgcggcagcgggattttcgtgacaaatgaggttcacacctggacagagcagtacaagtttcaagccgactcccccaaacggctcgcgacggccatcgctggcgcctgggaaaacggagtgtgtggcattagaagcgctacccgcatggagaatctgctgtggaagcagatcgccaacgaactcaattatatcctgtgggagaacaatattaaacttacagtcgtggttggggatatcattggagtgctggaacagggcaagcggaccctcacacctcagcccatggagctgaaatactcttggaagacctgggggaaggccaaaatcgtcacggctgagacccaaaactccagcttcattatcgacggacctaacacacccgaatgcccgtctgcgtccagagcctggaatgtgtgggaggtggaagactatggctttggcgtcttcaccacaaacatctggctgaaacttcgcgaggtttacacccagagctgtgatcatcggctcatgtccgctgccattaaagacgaaagagccgtgcacgctgatatggggtactggatcgagtctcagaagaatggaagctggaaactggagaaggcctcctttattgaagtgaagacatgcacctggcctaaatctcacacgctgtggagcaacggcgtcctcgagtccgacatgatcattcccaagagcctggcggggcctatctctcagcataatcaccgccccggatatcatacacaaaccgctggcccttggcaccttgggaaactggaactcgatttcaactactgcgagggaaccacagtggttatcaccgagaattgtggcacgcggggcccctccctgagaacaaccacagtgagcgggaagctgattcacgaatggtgctgtcgctcttgcacccttccgcctctccggtatatgggagaggacggctgttggtacgggatggaaatcagacccattaacgagaaagaagagaatatggtcaagtccctggtgagcgccggatctggcaaggttgataactttacaatgggggtgctgtgcctcgccatcctgttcgaggaagtcatgcggggaaaattcggcaagaaacatatgattgctggcgtgctttttaccttcgttctgctcctgagcgggcagatcacgtggcgcgacatggcccacaccctgattatgatcggatccaatgcgagcgatagaatgggcatgggggtgacatatcttgctctgatcgccacctttaagattcagcccttcctcgccctgggatttttcctccggaaactgacatctagagagaaccttctgctcggcgtcgggctggctatggccaccacgctgcaacttcctgaagacatcgagcagatggctaatggaattgccctgggcctcatgacactgaagctcatcacccagtttgaaacataccagctgtggaccgcgcttgtgtccctgacctgtagcaacacaattttcacgctcaccgtggcctggcgcacagctaccctgatcctggccggcgtctcccttctgccgctctgccaatctagctccatgcggaagacagattggctgcccatgaccgttgctgccatgggggtgcctcccctccctctgtttatcttctctcttaaagacacgcccaagagacgcagctggcctctgaatgagggagtgatggccgtcggcctggtgtccattctcgcttctagcctgcttagaaacgatgttcccatggcggggccgctggtggccggaggcctcctgatcgcttgttatgtcattacagggacctccgccgacctcaccgtggagaaagccgctgacgttacatgggaagaggaagccgagcagaccggagtgagccataacctgatgatcacagtcgatgacgatggcacgatgcggattaaggacgatgaaaccgagaatatccttacagtgctgctgaaaaccgcgctcctgatcgtctctggcatttttccttactccatccccgctacacttctggtgtggcacacctggcagaagcagacgcaacgcagcggggttctctgggacgtgccttctcccccggagacccagaaagccgaactggaggaaggagtctacagaattaagcagcagggcatcttcgggaagacacaagtgggagttggcgtgcagaaagagggggtctttcataccatgtggcacgtgacacggggagccgtgctcacccacaacggcaagcgcctggagcctaattgggcttccgttaaaaaggatcttattagctatggcgggggatggagactgtctgcccagtggcaaaaaggcgaagaggtccaggtgatcgcggtggaacccgggaagaaccctaagaatttccagacaatgcccggaattttccagacgaccacaggcgagatcggggctatcgccctggactttaaacccggaacctccggcagccctattatcaaccgggaaggcaaggtcgtggggctctacggaaatggcgttgtgaccaaaaacgggggatatgtctccggcattgcccaaacaaatgctgagccggatgggcccacgcctgagctggaagaggaaatgttcaagaaacgcaaccttaccatcatggacctgcatcccggcagcggaaagacaagaaagtacctccctgccattgtgcgggaggctatcaaacgcagactgcggaccctcatcctggcccccacaagagttgtggcggccgaaatggaggaggctcttaagggcctgcctattcgctatcagaccacggccacaaaatctgaacacaccgggcgggagatcgtcgatctgatgtgccatgctacctttacaatgagactcctgagcccggtgcgcgttcccaattacaaccttattatcatggacgaagcccacttcaccgatcctgcctccattgctgcgcggggatatatctctacaagagtgggcatgggggaggccgctgccatctttatgaccgccacgccccctggaacagctgaagccttcccccagagcaatgcgccgattcaggacgaggagcgcgacatccctgaacggtcctggaactctggcaatgagtggattaccgattttgtcgggaagacagtgtggttcgtgcccagcatcaaagctggcaacgacattgccaactgtctgagaaagaatggaaagaaagtcatccaactctcccgcaagacctttgatacggaataccagaaaacccggctgaacgactgggatttcgttgtgacaaccgacatttctgagatgggcgccaattttaaggctgatagagtgatcgacccccggcgctgcctgaaacctgtcatcctcacagatgggcccgagagagtgattcttgccggacctatgccggttaccgcggccagcgctgcccagcggcgcggcagagtggggcggaacccccagaaggaaaatgaccaatacatcttcacaggacagcctctgaacaatgatgaggaccatgctcactggaccgaagccaagatgctgctcgacaacattaatacgcccgagggcatcattcctgctctgttcgaacccgagagagagaaatccgccgcgatcgatggggaatatcgccttaagggcgagagccggaaaacatttgtcgaactgatgagacgcggagacctcccggtgtggctggcccacaaggttgcttctgagggcatcaaatacaccgatcggaagtggtgcttcgacggggaaagaaacaatcagattctggaggagaacatggatgtggaaatctggaccaaagagggagaacgcaagaagctccggcctagatggcttgacgcccgcacatattccgatcccctggctctgaaagagtttaaggacttcgccgccggcagaaaaagcattgctctcgatctggtcaccgaaatcgggcgggtgccttctcatcttgcgtaccgcacaagaaatgccctggacaacctcgtcatgctgcacacgtccgagcatggaggccgggcttatcgccacgccgtggaggaactgcccgagaccatggaaacactccttctgctgggcctcatgattctgcttaccgggggagccatgctgtttctcatcagcggcaaggggatcggaaaaacatccattggcctgatctgtgttattgtgtctagcgggatgctgtggatggctgatgtgcctctccagtggatcgcctccgcgattatccttgagttctttatgatggtcctgctgattcccgagccggaaaagcaaagaacccctcaggacaatcagctcgcctacgttgtgatcggaatcctgacgcttgctgccattgtggctgccaacgagatgggcctgctcgaaaccacaaagcgggatctgggcatgagcaaagagcccggggtcgtgtctcccacctcctatctggacgttgacctccaccctgcgagcgcctggacactttacgctgtggccaccacggtcatcacaccgatgctgagacataccattgaaaattctacagctaacgtgagcctggccgctatcgccaaccaagcggtcgtgctcatgggactggataagggctggcccatttccaaaatggaccttggggttcctctgctcgccctgggatgctactctcaggtgaatcccctgaccctcaccgctgccgtccttctgctggtgacacactatgctatcatcggccctgggctccaggccaaggccacgcgcgaggcgcagaaacggaccgctgccggaattatgaagaaccccacagttgatggcatcatgaccattgacctggatcctgtgatctacgacagcaagttcgagaaacaacttggccaggtcatgctgctcgtgctgtgtgctgtgcagctgctccttatgagaacatcctgggccctgtgcgaagccctgaccctcgctacggggccgattacaaccctgtgggagggatctcccggcaagttttggaataccacaatcgccgttagcatggcgaacatcttccgcgggtcctatcttgccggagctggcctggcctttagcattatgaaatctgtcgggaccggacggagaggcacaggctcccagggggaaacgctcggagagaagtggaaaaagaagctgaatcaactgagccggaaagagttcgatctctacaagaaatccggcatcaccgaggtggaccgcacagaggctaaggaagggcttaaaagaggagagaccacacatcacgccgtgtctcggggcagcgcgaagctgcagtggtttgtcgaacgcaacatggttattcctgaggggagagtgatcgatctgggatgtggccggggcgggtggtcctattactgcgccggactcaaaaaggtgaccgaagtccgcggctatacgaaaggcgggcccgggcatgaggagcctgtgcccatgtctacctacgggtggaatctggttaaacttatgagcggaaaggacgtgttctacctgccgcctgaaaaatgtgatacactcctgtgcgacattggcgagtccagcccctctcccaccgtcgaagagtccagaacaatccgggtgctgaagatggttgagccttggctcaaaaacaatcagttctgtattaaggtgcttaacccctatatgcctaccgtcatcgaacacctggagcgcctgcagagaaagtacggcgggatgctcgtgcggaatccgctgagcagaaactctacacacgaaatgtattggatctccaatggaaccggcaacattgtgagctctgtcaatatggttagccgccttctgctcaaccggtttacgatgacacatagacgccccaccatcgagaaagatgtggacctgggggctggaacccggcacgtgaacgccgaacctgagacacccaatatggacgtcattggcgagagaatcaagcgcattaaagaagaacattcctctacgtggcactacgatgacgaaaacccttataagacctgggcttaccacgggagctatgaggtgaaagccacaggatccgctagctccatgatcaatggcgttgtgaagctgctcaccaagccctgggatgtcgtgccgatggttacacaaatggccatgaccgacacaacccctttcggccagcagcgggtgtttaaagaaaaggtcgatacgagaacaccccgccctatgcccgggacacggaaagtgatggagatcaccgcggagtggctgtggagaacacttggacgcaacaagaaacctcggctgtgcaccagagaagagttcacgaagaaggttcgcacaaatgccgctatgggcgccgtgtttaccgaagagaaccaatgggactctgctagagccgccgtcgaagatgaggagttctggaaactcgtggaccgggaacgcgagctgcataaacttgggaaatgtggaagctgcgtctacaatatgatgggcaagagagagaagaagctgggggagtttggcaaagcgaagggatcccgggctatttggtacatgtggctcggcgccagatatctggagttcgaagccctggggtttctcaacgaggatcactggttctctcgggaaaatagctactccggagtggagggcgaagggctgcataaacttggatatatcctgcgcgacatttctaaaatccccggcggggctatgtacgccgatgacacagctggctgggacaccagaattacggaggatgacctccacaacgaggaaaagatcacccagcagatggatccggagcatcggcagctggccaatgcgatctttaaacttacatatcaaaacaaggttgtgaaagtccagcgccctacccccaagggaacagtgatggacattatcagcagaaaggatcagcggggctccggacaggtgggaacctacggcctgaatacattcaccaacatggaagcccaactcgttcgccagatggagggggaaggagtgctgagcaaagctgacctggagaatccccacctcctggagaagaaaattacgcagtggcttgaaacaaagggcgtcgagagactgaaacggatggccatctctggggatgactgcgtggttaagcctattgatgaccgctttgctaacgccctcctggcgcttaacgatatgggcaaggtgagaaaagacatcccgcagtggcaaccctccaagggatggcacgattggcagcaggtccctttctgtagccatcacttccatgaactgatcatgaaagacggccggaagctcgtggtcccctgccgccctcaggacgagctgattgggagagcccggatctctcaaggagctggctggtccctgaaagaaaccgcctgtctcgggaaggcttatgcccagatgtggagcctgatgtactttcaccgcagagatcttcggctggcttctaatgccatttgctccgcggtgcccgttcactggatccctaccagcagaacaacctggtccattcatgcccaccatcagtggatgacaacggaggacatgctcaccgtgtggaaccgcgtctggatcgaggataatccctggatggaagacaagacaccggtgaccacatgggaggatgttccttacctgggaaaacgggaagaccaatggtgtggcagccttattgggctgacctctagagctacgtgggcccagaacatcctcaccgccatccaacaggtgcgcagcctgattggcgatgaggagttcctggactatatgccctccatgaagcggtttagaaaagaagaggaatctgagggagctatctggtga

SEQ ID NO: 20860 - RNA, 9873 nt, synthetic construct
  misc_feature 1..9873: note = derived and/or modified CDS sequence (opt5) from DENV-3__FJ547066__SS-prME
  source 1..9873: mol_type = other RNA
accagcctgtgcctcatgatgatgctgcccgccacacttgctttccacctgacgtccagagacggcgagcctcggatgatcgtggggaagaacgaacgcggaaaatctctcctgtttaagaccgccagcggcattaatatgtgtacacttatcgcgatggatctgggggagatgtgcgacgataccgtcacatacaaatgtccgctcattgctgaaatggagcccgaagacatcgattgctggtgtaacctgacctccacatgggttacctatggaacgtgcaatcaggccggcgagcatagacgggacaagcgctctgtggccctggctcctcacgtggggatgggactcgataccagaacacaaacctggatgagcgccgagggcgcttggcggcaggtcgaaaaagtggagacatgggccctgcgccatcccggcttcaccattcttgcgctgtttctcgcccactacatcgggacgtccctgacacagaaggttgtgatcttcattcttctgatgctcgtcaccccttctatgacaatgagatgtgtgggagttggcaaccgggactttgtggaagggctgagcggagctacctgggtcgatgtggtgctggagcatggcgggtgcgtcaccacaatggccaagaataaacccacgctcgacatcgagctgcagaagaccgaagctacacaacttgccaccctgcgcaaactctgtattgagggaaagatcacaaacattaccacggattccagatgccctacacagggcgaagcgatcctgccggaggaacaggaccagaattatgtttgtaaacacacctacgtggatcggggctgggggaacggatgcggccttttcgggaagggaagcctggtgacctgcgccaagtttcaatgtctcgagcccattgagggcaaagtcgtgcagtatgaaaatctgaagtacacagttatcatcaccgtgcacacaggggaccagcatcaggtcggaaacgacacgcaaggcgtgaccgttgagattacacctcaggcttctaccgtggaagccgtcctgcccgagtatggcacactcgggctggaatgctcccctcgcaccggacttgatttcaatgagatgatcctgctcacgatgaaaaacaaggcttggatggtgcacagacagtggtttttcgacctgccccttccgtggaccagcggcgccacaaccgagacacctacctggaatcggaaagaactgctcgtcacgtttaagaacgcccatgctaaaaagcaagaggtggttgtgctggggtctcaggaaggagcgatgcacacagccctgaccggcgctacagagattcagaattccgggggcaccagcatcttcgccggacacctcaagtgtcgcctgaaaatggataagcttgaactgaaaggcatgtcttacgccatgtgcctcaacacctttgtcctgaagaaagaggtgtccgagacacagcatgggacgattctgatcaaggttgaatacaagggagaggacgctccctgtaaaatccctttcagcaccgaagatggccaagggaaggcccacaacggaagacttattacagcgaatcccgtggtcaccaaaaaggaggagcccgtgaacatcgaagctgagcctccgttcggcgaatccaatattgtgatcgggattggcgacaaagccctcaagatcaactggtataagaaaggatctagcatcggcaagatgtttgaggccacagctcggggggccagacgcatggctattctgggagataccgcctgggacttcggctccgttgggggagtcctgaatagcctcggcaaaatggtgcatcagatctttgggtctgcgtacacggccctgttctccggcgtgagctggattatgaagatcggaattggcgtccttctgacatggatcgggctcaactctaaaaataccagcatgtccttttcttgcattgtgatcggaatcattaccctgtatctgggcgctgttgtgcaggccgatatggggtgtgctatcaactggaagggaaaggaacttaaatgcggcagcgggattttcgtcacaaatgaggtgcacacctggacagagcagtacaagtttcaagccgactcccccaaacggctcgcgacggccatcgctggcgcctgggaaaacggagtttgtggcattagaagcaccacacgcatggagaatctgctgtggaagcagatcgctaacgaactcaattatatcctgtgggagaacaatattaaacttaccgtggtcgtgggggatatcattggagttctggaacagggcaagcggacactcacccctcagcccatggagctgaaatactcttggaagacgtgggggaaggccaaaatcgtgaccgccgagacacaaaactccagcttcattatcgacggacctaacacccccgaatgcccgtctgcttccagagcgtggaatgtctgggaggtggaagactatggctttggcgtgttcacaaccaacatctggctgaagcttcgcgaggtctacacacagagctgtgatcatcggctcatgtccgccgctattaaagacgaaagagccgttcacgccgatatggggtactggatcgagtctcagaagaatggaagctggaaactggagaaggcttcctttattgaagtgaagacctgcacgtggcctaaatctcacacactgtggagcaacggcgtgctcgagtccgacatgatcattcccaagagcctggccgggcctatctctcagcataatcaccgccccggatatcatacccaaaccgcgggcccttggcaccttgggaaactggaactcgatttcaactactgcgagggaacaaccgtcgtgatcacggagaattgtggcacacggggcccctccctgagaaccacaaccgttagcgggaagctgattcacgaatggtgctgtcgctcttgcacacttccgcctctccggtatatgggagaggacggctgttggtacgggatggaaatcagacccattaacgagaaagaagagaatatggtgaagtccctggtcagcgctggatctggcaaggtggataactttaccatgggggttctgtgcctcgccatcctgttcgaggaagtgatgcggggaaaattcggcaagaaacatatgattgccggcgtcctttttacgttcgtgctgctcctgagcgggcagatcacctggcgcgacatggctcacacactgattatgatcggatccaatgccagcgatagaatgggcatgggggttacctatcttgcgctgatcgctacatttaagattcagcccttcctcgccctgggatttttcctccggaaactgacctctagagagaaccttctgctcggcgtggggctggccatggctacgacactgcaacttcctgaagacatcgagcagatggccaatggaattgctctgggcctcatgaccctgaagctcatcacacagtttgaaacctaccagctgtggaccgcccttgtctccctgacatgtagcaacacgattttcaccctcacagtggcgtggcgcaccgccacactgatcctggctggcgtgtcccttctgccgctctgccaatctagctccatgcggaagaccgattggctgcccatgacggtcgccgctatgggggttcctcccctccctctgtttatcttctctcttaaagacacacccaagagacgcagctggcctctgaatgagggagtgatggccgtgggcctggtctccattctcgcctctagcctgcttagaaacgatgtgcccatggctgggccgctggttgcgggaggcctcctgatcgcctgttatgtgattaccgggacctccgctgacctcacagtcgagaaagccgccgacgtgacctgggaagaggaagctgagcagacaggagttagccataacctgatgatcacggtggatgacgatggcaccatgcggattaaggacgatgaaacagagaatatccttaccgtcctgctgaaaacagccctcctgatcgtgtctggcatttttccttactccatccccgcgacccttctggtctggcacacgtggcagaagcagacccaacgcagcggggtgctctgggacgttccttctcccccggagacacagaaagctgaactggaggaaggagtgtacagaattaagcagcagggcatcttcgggaagacccaagtcggagtgggcgttcagaaagagggggtgtttcatacaatgtggcacgtcacccggggagccgtgctcacacacaacggcaagcgcctggagcctaattgggcctccgtgaaaaaggatcttattagctatggcgggggatggagactgtctgctcagtggcaaaaaggcgaagaggttcaggtcatcgccgtggaacccgggaagaaccctaagaatttccagacgatgcccggaattttccagaccacaaccggcgagatcggggcgatcgctctggactttaaacccggaacctccggcagccctattatcaaccgggaaggcaaggtggtcgggctctacggaaatggcgtggttacaaaaaacgggggatatgtgtccggcattgcccaaacgaatgccgagccggatgggcccacccctgagctggaagaggaaatgttcaagaaacgcaaccttacaatcatggacctgcatcccggcagcggaaagaccagaaagtacctccctgctattgtccgggaggccatcaaacgcagactgcggacactcatcctggctcccaccagagtggttgccgcggaaatggaggaggcccttaagggcctgcctattcgctatcagacgacagctaccaaatctgaacacaccgggcgggagatcgtggatctgatgtgccatgccacatttaccatgagactcctgagcccggtccgcgtgcccaattacaaccttattatcatggacgaagctcacttcacagatcctgcctccattgccgctcggggatatatctctaccagagttggcatgggggaggcggccgctatctttatgacggccacaccccctggaaccgccgaagctttcccccagagcaatgccccgattcaggacgaggagcgcgacatccctgaacggtcctggaactctggcaatgagtggattacagattttgtggggaagaccgtctggttcgtgcccagcatcaaagcgggcaacgacattgctaactgtctgagaaagaatggaaagaaagtgatccaactctcccgcaagacgtttgataccgaataccagaaaacacggctgaacgactgggatttcgtcgttaccacagacatttctgagatgggcgccaattttaaggccgatagagtgatcgacccccggcgctgcctgaaacctgtgatcctcaccgatgggcccgagagagtcattcttgctggacctatgccggtgacagccgcgagcgccgctcagcggcgcggcagagttgggcggaacccccagaaggaaaatgaccaatacatcttcaccggacagcctctgaacaatgatgaggaccatgcccactggacggaagctaagatgctgctcgacaacattaatacacccgagggcatcattcctgccctgttcgaacccgagagagagaaatccgctgccatcgatggggaatatcgccttaagggcgagagccggaaaacctttgtggaactgatgagacgcggagacctcccggtctggctggcgcacaaggtggcctctgagggcatcaaatacaccgatcggaagtggtgcttcgacggggaaagaaacaatcagattctggaggagaacatggatgttgaaatctggacaaaagagggagaacgcaagaagctccggcctagatggcttgacgctcgcacctattccgatcccctggccctgaaagagtttaaggacttcgctgccggcagaaaaagcattgccctcgatctggtgacagaaatcgggcgggtcccttctcatcttgcttaccgcacgagaaatgcgctggacaacctcgtgatgctgcacacctccgagcatggaggccgggcctatcgccacgctgtcgaggaactgcccgagacaatggaaaccctccttctgctgggcctcatgattctgcttacagggggagccatgctgtttctcatcagcggcaaggggatcggaaaaacctccattggcctgatctgtgtgattgtttctagcgggatgctgtggatggccgatgtgcctctccagtggatcgcttccgccattatccttgagttctttatgatggtgctgctgattcccgagccggaaaagcaaagaacgcctcaggacaatcagctcgcgtacgtcgttatcggaatcctgacccttgccgctattgtggccgctaacgagatgggcctgctcgaaacaaccaagcgggatctgggcatgagcaaagagcccggggtggtctctcccacatcctatctggacgtggacctccaccctgccagcgcgtggaccctttacgccgttgctacgacagtgatcaccccgatgctgagacatacaattgaaaattctaccgccaacgtcagcctggctgccatcgctaaccaagccgtggtcctcatgggactggataagggctggcccatttccaaaatggaccttggggtgcctctgctcgcgctgggatgctactctcaggttaatcccctgaccctcacagccgctgtgcttctgctggtcacgcactatgccatcatcggccctgggctccaggctaaggccacccgcgaggcccagaaacggacagcggctggaattatgaagaaccccaccgtggatggcatcatgacaattgacctggatcctgttatctacgacagcaagttcgagaaacaacttggccaggtgatgctgctcgtcctgtgtgccgtgcagctgctccttatgagaacctcctgggctctgtgcgaagccctgacgctcgccacagggccgattaccaccctgtgggagggatctcccggcaagttttggaatacaaccatcgctgtgagcatggccaacatcttccgcgggtcctatcttgcgggagccggcctggcttttagcattatgaaatctgttgggacaggacggagaggcacgggctcccagggggaaaccctcggagagaagtggaaaaagaagctgaatcaactgagccggaaagaattcgatctctacaagaaatccggcatcacagaggtcgaccgcaccgaggccaaggaagggcttaaaagaggagagacaacccatcacgctgtgtctcggggcagcgccaagctgcagtggtttgtggaacgcaacatggtcattcctgaggggagagttatcgatctgggatgtggccggggcgggtggtcctattactgcgcgggactcaaaaaggtgacggaagtgcgcggctataccaaggggggacccggccatgaggagcctgtccccatgtctacatacgggtggaatctggtgaaacttatgagcggaaaggacgttttctacctgccgcctgaaaaatgtgataccctcctgtgcgacattggcgagtccagcccctctcccacagtggaagagtccagaaccatccgggtcctgaagatggtggagccttggctcaaaaacaatcagttctgtattaaggttcttaacccctatatgcctacagtgatcgaacacctggagcgcctgcagagaaagtacggcgggatgctcgtccggaatccgctgagcagaaactctacccacgaaatgtattggatctccaatggaacgggcaacattgtgagctctgtgaatatggtcagccgccttctgctcaaccggtttacaatgacccatagacgccccaccatcgagaaagatgttgacctgggggccggaacacggcacgtgaacgctgaacctgagacgcccaatatggacgtgattggcgagagaatcaagcgcattaaagaagagcattcctctacctggcactacgatgacgaaaacccttataagacatgggcctaccacgggagctatgaggtcaaagctaccggatccgccagctccatgatcaatggcgtggttaagctgctcacaaagccctgggatgtggtcccgatggtgacccaaatggctatgacagacaccacgcctttcggccagcagcgggtttttaaagaaaaggtggataccagaacaccccgccctatgcccgggacccggaaagtcatggagatcacagccgagtggctgtggagaacccttggacgcaacaagaaacctcggctgtgcacgagagaagagttcacaaagaaggtgcgcaccaatgcggccatgggcgctgtttttacagaagagaaccaatgggactctgccagagctgccgtggaagatgaggggttctggaaactcgtcgaccgggagcgcgaactgcataagcttggaaaatgtggcagctgcgtgtacaatatgatggggaagagagagaaaaagctgggcgaatttggaaaagccaagggctcccgggcgatttggtacatgtggctcggggctagatatctggagttcgaggccctgggatttctcaacgaagatcactggttctctcgggagaatagctactccggcgtcgaaggggagggactgcataagcttggctatatcctgcgcgacatttctaaaatccccgggggcgccatgtacgctgatgacaccgccggatgggacacgagaattaccgaagatgacctccacaacgaggagaagatcacacagcagatggatccggaacatcggcagctggctaatgccatctttaaacttacctatcaaaacaaggtggttaaagtgcagcgccctacacccaagggcaccgtcatggacattatcagcagaaaggatcagcgggggtccggacaggtgggcacatacgggctgaataccttcacgaacatggaggcgcaactcgtgcgccagatggaaggagagggcgttctgagcaaagccgacctggaaaatccccacctcctggagaagaaaattacacagtggcttgagaccaagggggtggaaagactgaaacggatggctatctctggcgatgactgcgtcgtgaagcctattgatgaccgctttgccaacgctctcctggcccttaacgatatgggaaaggttagaaaagacatcccgcagtggcaaccctccaagggctggcacgattggcagcaggtgcctttctgtagccatcacttccatgagctgatcatgaaagacgggcggaagctcgtcgtgccctgccgccctcaggacgaactgattggaagagcgcggatctctcaaggcgccgggtggtccctgaaagagaccgcttgtctcggaaaggcctatgctcagatgtggagcctgatgtactttcaccgcagagatcttcggctggcctctaatgctatttgctccgccgtccccgtgcactggatccctacaagcagaaccacatggtccattcatgcgcaccatcagtggatgacgaccgaagacatgctcacagtttggaaccgcgtgtggatcgaggataatccctggatggaggacaagaccccggtcacaacctgggaagatgtgccttacctgggcaaacgggaggaccaatggtgtgggagccttattggcctgacgtctagagccacctgggctcagaacatcctcacagccatccagcaggttcgcagcctgattggagatgaagagttcctggactatatgccctccatgaagcggtttagaaaagaggaagagtctgaaggcgccatctggtga

SEQ ID NO: 20861 - RNA, 9873 nt, synthetic construct
  misc_feature 1..9873: note = derived and/or modified CDS sequence (opt5) from DENV-3__KF955460__SS-prME
  source 1..9873: mol_type = other RNA
accagcctgtgcctcatgatgatgctgcccgccacccttgctttccacctgacgtcccgggacggagaacctcggatgatcgtggggaagaatgaacgcggaaaatctctcctgtttaagaccgccagcggcattaatatgtgtacacttatcgcgatggatctgggggaaatgtgcgacgataccgtcacatacaaatgtccgctcattgctgaagttgagcccgaagacatcgattgctggtgtaacctgacctccacatgggtgacctatggaacgtgcaatcaggccggcgagcatcggcgggacaagcgctctgtggccctggctcctcacgtcgggatgggactcgatacccggacacagacctggatgagcgccgagggcgcttggagacaggtggaaaaagttgagacatgggccctgcgccatcccggcttcaccattcttgcgctgtttctcgcccactacatcgggacgtccctgacacagaaggtggtcatcttcacccttctgatgctcgtgacaccttctatgaccatgagatgtgttggagtgggcaaccgggactttgtcgaagggctgagcggagctacctgggtggatgtggtcctggagcatggcgggtgcgttacaacgatggccaagaataaacccaccctcgacattgagctgcagaagacagaagctacccagcttgccacactgcgcaaactctgtatcgagggaaagattaccaacatcacgacagattccagatgccctacccagggcgaagcgattctgccggaggaacaggaccagaattatgtgtgtaaacacacctacgtggatcggggctgggggaacggatgcggccttttcgggaagggaagcctggtcacatgcgccaagtttcagtgtctcgagcccatcgagggcaaagtggttcagtatgaaaatctgaagtacaccgtgattatcacagtccacacgggggaccagcatcaggtgggaaacgacacccaaggcgttacagtggagatcacccctcaggcttctacagtcgaagccgtgctgcccgagtatggcaccctcgggctggaatgctcccctcgcacgggacttgatttcaatgagatgattctgctcaccatgaaaaacaaggcttggatggtccacagacagtggtttttcgacctgccccttccgtggacaagcggcgccaccacagagacccctacgtggaatcggaaagaactgctcgtgacatttaagaacgcccatgctaaaaagcaagaggttgtggtcctggggtctcaggaaggagcgatgcacaccgccctgacaggcgctaccgagatccaaaattccgggggcaccagcattttcgccggacacctcaagtgtcgcctgaaaatggataaacttgaactgaaaggcatgtcttacgccatgtgcctcaacacatttgtgctgaagaaagaggtttccgagacgcagcatgggaccatcctgattaaggtggaatacaagggagaggacgctccctgtaaaatccctttcagcacagaagatggccaagggaaggcccacaacggaagacttatcaccgcgaatcccgtcgtgaccaagaaggaggagcccgtgaacattgaagctgagcctccgttcggcgaatccaatatcgttattgggatcggcaacaaagccctcaagattaattggtataagaaaggatctagcatcggcaagatgtttgaggccaccgctagaggggccagacgcatggctatcctgggagacacggcctgggatttcggctccgtcgggggagtgctgaacagcctcggcaaaatggtgcatcagatttttgggtctgcgtacacagccctgttctccggcgtcagctggatcatgaagattggaatcggcgtgcttctgacctggattgggctcaattctaaaaacaccagcatgtccttttcttgcatcgttattggaatcatcacactgtatctgggcgctgtggtccaggccgacatggggtgtgctattaattggaagggaaaggaacttaaatgcggcagcgggatcttcgtgaccaacgaggttcacacatggacggagcagtacaagtttcaagccgattcccccaaacggctcgcgaccgccattgctggcgcctgggaaaatggagtgtgtggcatcagaagcacaacccgcatggagaacctgctgtggaagcagattgctaatgaactcaactatatcctgtgggagaataacatcaaacttacagtcgtggttggggacattatcggagtgctggaacagggcaagcggaccctcacgcctcagcccatggagctgaaatactcttggaagacctgggggaaggccaaaattgtcacagccgagacccaaaactccagcttcatcattgatggacctaatacacccgaatgcccgtctgcttccagagcgtggaacgtgtgggaggtggaagactatggctttggcgtcttcaccacaaatatctggctgaaacttcgcgaggtttacacccagagctgtgaccatcggctcatgtccgccgctatcaaagatgaaagagccgtgcacgccgacatggggtactggattgagtctcagaagaacggaagctggaaactggagaaggcttcctttatcgaagtgaagacgtgcacatggcctaaatctcacaccctgtggagcaatggcgtcctcgagtccgatatgattatccccaagagcctggccgggcctatttctcagcataaccaccgccccggatatcatacccaaacagcgggcccttggcaccttgggaaactggaactcgacttcaattactgcgagggaaccacggtggttatcacagagaactgtggcacccggggcccctccctgagaacaaccacagtgagcgggaagctgatccacgaatggtgctgtcgctcttgcacccttccgcctctccggtatatgggagaggatggctgttggtacgggatggaaattagacccatcaatgagaaagaagagaacatggtcaagtccctggtgagcgctggatctggcaaggttgacaattttacgatgggggtgctgtgcctcgccattctgttcgaggaagtcatgcggggaaaattcggcaagaaacatatgatcgccggcgtgctttttaccttcgttctgctcctgagcgggcagattacatggcgcgatatggctcacaccctgatcatgattggatccaacgccagcgacagaatgggcatgggggtgacatatcttgcgctgatcgctacctttaagatccagcccttcctcgccctgggatttttcctccggaaactgacgtctagagagaatcttctgctcggcgtcgggctggccatggctacaaccctgcaacttcctgaagatattgagcagatggccaacggaatcgctctgggcctcatgacactgaagctcattacccagtttgaaacctaccagctgtggacagcccttgtgtccctgacgtgtagcaataccatcttcacactcaccgtggcgtggcgcacagccaccctgattctggctggcgtctcccttctgccgctctgccaatctagctccatgcggaagacggactggctgcccatgacagttgccgctatgggggtgcctcccctccctctgtttatcttctctcttaaagatacccccaagagacgcagctggcctctgaacgagggagtgatggccgtcggcctggtgtccatcctcgcctctagcctgcttagaaacgacgttcccatggctgggccgctggtggcgggaggcctcctgattgcctgttatgtcatcaccgggacatccgctgatctcaccgtggagaaagccgccgacgttacatgggaagaggaagctgagcagacgggagtgagccataatctgatgattaccgtcgacgatgacggcacaatgcggatcaaggatgacgaaaccgagaacattcttacagtgctgctgaaaaccgccctcctgatcgtctctggcatctttccttactccattcccgcgacgcttctggtgtggcacacctggcagaagcagacacaacgcagcggggttctctgggatgtgccttctcccccggagacccagaaagctgaactggaggaaggagtctacagaatcaagcagcagggcattttcgggaagacacaagtgggagttggcgtgcagaaagagggggtctttcataccatgtggcacgtgacacggggagccgtgctcacgcacaatggcaagcgcctggagcctaactgggcctccgttaaaaaggaccttatcagctatggcgggggatggagactgtctgctcagtggcaaaaaggcgaagaggtccaggtgattgccgtggaacccgggaagaatcctaagaacttccagaccatgcccggaatcttccagacaaccaccggcgagattggggcgatcgctctggattttaaacccggaacatccggcagccctatcattaatcgggaaggcaaggtcgtggggctctacggaaacggcgttgtgacgaaaaatgggggatatgtctccggcatcgcccaaaccaacgccgagccggacgggcccacacctgagctggaagaggaaatgttcaagaaacgcaatcttaccattatggatctgcatcccggcagcggaaagacaagaaagtacctccctgctatcgtgcgggaggccattaaacgcagactgcggaccctcatcctggctcccacgagagttgtggccgcggaaatggaggaggcccttaagggcctgcctatccgctatcagacaaccgctaccaaatctgaacacacagggcgggagattgtcgacctgatgtgccatgccacctttacaatgagactcctgagcccggtgcgcgttcccaactacaatcttatcattatggatgaagctcacttcaccgaccctgcctccatcgccgctcggggatatatttctacgagagtgggcatgggggaggcggccgctatctttatgacagccacaccccctggaacagccgaggctttcccccagagcaacgccccgatccaggatgaggagaaggacattcctgaacgctcctggaactctggcaacgagtggatcaccgactttgtcgggaaaacggtgtggttcgtgcccagcattaaggcgggcaacgatatcgctaattgtctgcggaagaacggcaaaaaggtcattcaactctccagaaaaacctttgacacagaataccagaagacccgcctgaatgattgggacttcgttgtgacaaccgatatctctgagatgggagccaactttaaagccgaccgggtgattgatcccagacggtgcctgaagcctgtcatcctcacagacgggcccgagcgcgtgatccttgctggacctatgccggttaccgccgcgagcgccgctcagagacggggccgcgtggggagaaatccccagaaggaaaacgatcaatacattttcacgggacagcctctgaataacgacgaggatcatgcccactggacagaagctaaaatgctgctcgacaatatcaacacccccgagggcattatccctgccctgttcgaacccgagcgggagaagtccgctgccattgacggggaatatagacttaaaggcgagagccgcaagacctttgtcgaactgatgcggagaggagatctcccggtgtggctggcgcacaaagttgcctctgagggcatcaagtacacagaccgcaaatggtgcttcgatggggaacggaataaccagatcctggaggagaatatggacgtggaaatttggaccaaggagggagaaagaaagaaactccgccctcggtggcttgatgctagaacatattccgaccccctggccctgaaggagtttaaagatttcgctgccggccgcaagagcatcgccctcgacctggtcacggaaattgggagagtgccttctcatcttgcttaccggacccgcaacgcgctggataatctcgtcatgctgcacacatccgagcatggaggcagagcctatcggcacgctgtggaggaactgcccgagaccatggaaacactccttctgctgggcctcatgatcctgcttaccgggggagccatgctgtttctcattagcggcaaagggatcggaaagacgtccatcggcctgatttgtgttatcgtgtctagcgggatgctgtggatggccgacgtgcctctccagtggattgcttccgccatcgtccttgagttctttatgatggttctgctgattcccgagccggaaaagcaacgcacccctcaggataaccagctcgcgtacgtggtgatcggcattctgacacttgccgctatcgtcgccgctaatgagatgggcctgctcgaaaccacaaaaagagacctgggcatgagcaaggagcccggggtggtttctcccacctcctatctggatgtggacctccaccctgccagcgcgtggacgctttacgccgtcgctacaaccgtgatcacaccgatgctgcggcataccattgaaaactctaccgccaacgtcagcctggctgccatcgctaatcaagccgtggttctcatgggactggacaaaggctggcccatttccaagatggatcttggggtgcctctgctcgcgctgggatgctactctcaggtcaaccccctgacactcacggccgctgtgcttctgctggttacccactatgccatcattggccctgggctccaggctaaagccacaagagaggcccagaagcgcaccgcggctggaatcatgaagaatcccacagtggacggcatcatgaccattgatctggaccctgtcatctacgatagcaaattcgagaagcaacttggccaggtgatgctgctcgtgctgtgtgccgttcagctgctccttatgcggacgtcctgggctctgtgcgaagccctgacactcgccaccgggccgattaccacactgtgggagggatctcccggcaaattttggaacaccacaatcgctgtcagcatggccaatattttcagagggtcctatcttgcgggagccggcctggcttttagcatcatgaagtctgtggggacgggacgccggggcaccggctcccagggggaaacactcggagagaaatggaagaagaaactgaaccaactgagcagaaaggagttcgacctctacaaaaagtccggcatcaccgaggtggatcggacagaggccaaagaagggcttaagcgcggagagaccacgcatcacgctgtctctagaggcagcgccaaactgcagtggtttgttgaacggaatatggtgattcctgaggggcgcgtgatcgacctgggatgtggcagaggcgggtggtcctattactgcgcgggactcaagaaggtcaccgaagtgcggggctatacaaaagggggacccggccatgaggagcctgttcccatgtctacctacgggtggaacattgtgaagctgatgagcggaaaagatgtcttctaccttccgcctgaaaagtgtgacacactgctctgcgatatcggcgagtccagcccctctcccaccgtggaagagtcccgcacaattagagttctgaaaatggtggagccttggctgaagaataaccagttctgtatcaaggtcctcaatccctatatgcctaccgtgattgaacaccttgagcggctgcagcgcaaatacggcgggatgctggtgagaaacccgctcagcagaaattctacgcacgaaatgtattggatctccaacggaacaggcaatatcgtcagctctgttaacatggtgagcagactgcttctgaaccgctttaccatgacccatcggagacccacaattgagaaggacgtggatctcggggccggaacgcgccacgtcaatgctgaacctgagacccccaacatggacgtgatcggcgagcggattaaaagaatcaaggaagaacactcctctacatggcactacgacgatgaaaatccttataaaacctgggcctaccacgggagctatgaggttaaggctacaggatccgccagctccatgattaacggcgtggtcaagctgctgaccaaaccctgggacgtggttccgatggtgacacaaatggctatgaccgatacgacccctttcggccagcagcgcgtctttaaggaaaaagtggacacacggacccccagacctatgcccgggacacgcaaggttatggagatcaccgccgagtggctctggcggacgctgggaagaaataaaaagcctcgcctttgcacacgggaagagttcaccaagaaagtgagaacaaacgcggccatgggcgctgtctttaccgaagagaatcaatgggattctgcccgcgctgccgtggaagacgaggagttctggaagctggtcgatagagaacgggagctccataaactggggaagtgtggaagctgcgtgtacaacatgatgggcaaacgcgaaaagaaacttggggagtttggcaaggccaagggatccagagcgatctggtacatgtggctgggcgctcggtatctcgagttcgaagccctggggtttctgaatgaggaccactggttctctagagaaaacagctactccggagttgagggcgaagggctccataaactgggatatattcttcgggatatctctaagattcccggcggggccatgtacgctgacgatacggccggctgggacacccgcatcacagaggacgatctgcacaatgaggagaagattacccagcagatggacccggagcatagacagctcgctaacgccatctttaagctgacatatcaaaataaagtggtcaaggtgcagcggcctacccccaagggaacagtgatggatatcattagccgcaaagaccagagaggctccgggcaggttggaacctacggccttaacacgttcacaaatatggaagcgcaactggtgcggcagatggagggggaaggagtcctcagcaaggccgatctggagaacccccatctgctcgagaaaaagatcacccagtggctggaaaccaaaggcgtggagcgccttaagagaatggctatttctggggacgattgcgttgtgaagcctatcgacgatcggtttgccaacgctctgctcgccctgaatgacatgggcaaagtccgcaaggatattccgcagtggcaaccctccaaaggatggcacgactggcaacaggtgcctttctgtagccatcacttccatgaacttatcatgaaggatggcagaaaactggtcgtgccctgccggcctcaggacgagctcatcgggcgcgcgagaatttctcaaggagccggctggtccctgaaggaaacagcttgtctggggaaggcctatgctcagatgtggagcctcatgtactttcaccggcgcgacctgagacttgcctctaacgctatctgctccgccgttcccgtgcactggattcctaccagccggacaacgtggtccatccatgcgcaccatcagtggatgaccacagaggatatgctgaccgtctggaatagagtgtggattgaggacaacccctggatggaagataaaacaccggttaccacgtgggaggacatcccttacctcggaaagcgcgaagatcaatggtgtggcagcctgattgggcttacctctcgggccacatgggctcagaatatcctgaccgccatccaacaggtgagaagcctcattggcgacgaggagttcctggattatatgccctccatgaaacgctttcggaaggaagaggaatctgagggagccatctggtga

SEQ ID NO: 20862 - RNA, 9873 nt, synthetic construct
  misc_feature 1..9873: note = derived and/or modified CDS sequence (opt5) from DENV-3__FJ461334__SS-prME
  source 1..9873: mol_type = other RNA
accagcctgtgcctcatgatgatgctgcccgccacccttgctttccacctgacgtcccgggacggcgaacctcggatgatcgtggggaagaacgaacgcggaaagtctctcctgtttaagaccgccagcggcattaatatgtgtacccttatcgcgatggatctgggggagatgtgcgacgataccgtcacatacaagtgtccgctcattgctgaagttgagcccgaagacatcgattgctggtgtaacctgacctccacatgggtgacctatggaacgtgcaatcaggccggcgagcatagacgggacaagcgctctgtggccctggctcctcacgtcgggatgggactcgataccagaacacagacctggatgagcgccgagggcgcttggcggcaggtcgaaaaggttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagaataagcccacgctcgacatcgagctgcagaagaccgaagctacacagcttgccaccctgcgcaaactctgtattgagggaaagatcacaaacattaccacggattccagatgccctacacagggcgaagcgatcctgccggaggaacaggaccagaattatgtgtgtaaacacacctacgtggatcggggctgggggaacggatgcggccttttcgggaagggaagcctggtgacctgcgccaagtttcaatgtctcgagcccattgagggcaaagtggttcagtatgaaaatctgaagtacacagtgatcatcaccgtccacacaggggaccagcatcaggtgggaaacgacacgcaaggcgttaccgtggagattacacctcaggcttctaccgtcgaagccgtgctgcccgagtatggcacactcgggctggaatgctcccctcgcaccggacttgatttcaatgagatgatcctgctcacgatgaaaaacaaggcttggatggtccacagacagtggtttttcgacctgccccttccgtggaccagcggcgccacaaccgagacacctacctggaatcggaaagaactgctcgtgacgtttaagaacgcccatgctaaaaagcaagaggttgtggtcctggggtctcaggaaggagcgatgcacacagccctgaccggcgctacagagattcaaaattccgggggcaccagcatcttcgccggacacctcaagtgtcgcctgaaaatggataaacttgaactgaaaggcatgtcttacgccatgtgcctcaacacctttgtgctgaagaaagaggtttccgagacacagcatgggacgattctgatcaaggtggaatacaagggagaggacgctccctgtaaaatccctttcagcaccgaagatggccaagggaaggcccacaacggaagacttattacagcgaatcccgtcgtgaccaaaaaggaggagcccgtgaacatcgaagctgagcctccgttcggcgaatccaatattgttatcgggattggcgacaaagccctcaagatcaactggtataagaaaggatctagcatcggcaagatgtttgaggccacagctagaggggccagacgcatggctattctgggagataccgcctgggacttcggctccgtcgggggagtgctgaatagcctcggcaaaatggtgcatcagatctttgggtctgcgtacacggccctgttctccggcgtcagctggattatgaagatcggaattggcgtgcttctgacatggatcgggctcaactctaaaaataccagcatgtccttttcttgcattgttatcggaatcattaccctgtatctgggcgctgtggtccaggccgatatggggtgtgctatcaactggaagggaaaggaacttaaatgcggcagcgggattttcgtgacaaatgaggttcacacctggacagagcagtacaagtttcaagccgactcccccaaacggctcgcgacggccatcgctggcgcctgggaaaacggagtgtgtggcattagaagcaccacacgcatggagaatctgctgtggaagcagatcgctaacgaactcaattatatcctgtgggagaacaatattaaacttaccgtcgtggttggggatatcattggagtgctggaacagggcaagcggacactcacccctcagcccatggagctgaaatactcttggaagacgtgggggaaggccaaaatcgtcaccgccgagacacaaaactccagcttcattatcgacggacctaacacccccgaatgcccgtctgcttccagagcgtggaatgtgtgggaggtggaagactatggctttggcgtcttcacaaccaacatctggctgaaacttcgcgaggtttacacacagagctgtgatcatcggctcatgtccgccgctattaaagacgaaagagccgtgcacgccgatatggggtactggatcgagtctcagaagaatggaagctggaaactggagaaggcttcctttattgaagtgaagacctgcacgtggcctaaatctcacacactgtggagcaacggcgtcctcgagtccgacatgatcattcccaagagcctggccgggcctatctctcagcataatcaccgccccggatatcatacccaaaccgcgggcccttggcaccttgggaaactggaactcgatttcaactactgcgagggaacaaccgtggttatcacggagaattgtggcacacggggcccctccctgagaaccacaaccgtgagcgggaagctgattcacgaatggtgctgtcgctcttgcacacttccgcctctccggtatatgggagaggacggctgttggtacgggatggaaatcagacccattaacgagaaagaagagaatatggtcaagtccctggtgagcgctggatctggcaaggttgataactttaccatgggggtgctgtgcctcgccatcctgttcgaggaagtcatgcggggaaaattcggcaagaaacatatgattgccggcgtgctttttacgttcgttctgctcctgagcgggcagatcacctggcgcgacatggctcacacactgattatgatcggatccaatgccagcgatagaatgggcatgggggtgacctatcttgcgctgatcgctacatttaagattcagcccttcctcgccctgggatttttcctccggaaactgacctctagagagaaccttctgctcggcgtcgggctggccatggctacgacactgcaacttcctgaagacatcgagcagatggccaatggaattgctctgggcctcatgaccctgaagctcatcacacagtttgaaacctaccagctgtggaccgcccttgtgtccctgacatgtagcaacacgattttcaccctcacagtggcgtggcgcaccgccacactgatcctggctggcgtctcccttctgccgctctgccaatctagctccatgcggaagaccgattggctgcccatgacggttgccgctatgggggtgcctcccctccctctgtttatcttctctcttaaagacacacccaagagacgcagctggcctctgaatgagggagtgatggccgtcggcctggtgtccattctcgcctctagcctgcttagaaacgatgttcccatggctgggccgctggtggcgggaggcctcctgatcgcctgttatgtcattaccgggacctccgctgacctcacagtggagaaagccgccgacgttacctgggaagaggaagctgagcagacaggagtgagccataacctgatgatcacggtcgatgacgatggcaccatgcggattaaggacgatgaaacagagaatatccttaccgtgctgctgaaaacagccctcctgatcgtctctggcatttttccttactccatccccgcgacccttctggtgtggcacacgtggcagaagcagacccaacgcagcggggttctctgggacgtgccttctcccccggagacacagaaagctgaactggaggaaggagtctacagaattaagcagcagggcatcttcgggaagacccaagtgggagttggcgtgcagaaagagggggtctttcatacaatgtggcacgtgacccggggagccgtgctcacacacaacggcaagcgcctggagcctaattgggcctccgttaaaaaggatcttattagctatggcgggggatggagactgtctacgcagtggcaaaaaggcgaagaggtccaggtgatcgctgtggaacccgggaagaaccctaagaatttccagaccatgcccggaattttccagacaaccaccggcgagatcggggccatcgcgctggactttaaacccggaacatccggcagccctattatcaaccgggaaggcaaggtcgtggggctctacggaaatggcgttgtgacgaaaaacgggggatatgtctccggcattgctcaaaccaatgccgagccggatgggcccacacctgagctggaagaggaaatgttcaagaaacgcaaccttaccatcatggacctgcatcccggcagcggaaagacaagaaagtacctccctgccattgtgcgggaggctatcaaacgcagactgcggaccctcatcctggcccccacgagagttgtggctgccgaaatggaggaggcgcttaagggcctgcctattcgctatcagacaaccgccaccaaatctgaacacacagggcgggagatcgtcgatctgatgtgccatgctacctttacaatgagactcctgagcccggtgcgcgttcccaattacaaccttattatcatggacgaagcccacttcaccgatcctgcttccattgccgcccggggatatatctctacgagagtgggcatgggggaggctgcggccatctttatgacagctacaccccctggaacagccgaagccttcccccagagcaatgctccgattcaggacgaggagcgcgacatccctgaacggtcctggaactctggcaatgagtggattaccgattttgtcgggaagacggtgtggttcgtgcccagcatcaaagccggcaacgacattgcgaactgtctgagaaagaatggaaagaaagtcatccaactctcccgcaagacctttgatacagaataccagaaaacccggctgaacgactgggatttcgttgtgacaaccgacatttctgagatgggcgctaattttaaggccgatagagtgatcgacccccggcgctgcctgaaacctgtcatcctcacagatgggcccgagagagtgattcttgccggacctatgccggttaccgctgccagcgcggcccagcggcgcggcagagtggggcggaacccccagaaggaaaatgaccaatacatcttcacgggacagcctctgaacaatgatgaggaccatgctcactggacagaagccaagatgctgctcgacaacattaatacccccgagggcatcattcctgctctgttcgaacccgagagagagaaatccgccgctatcgatggggaatatcgccttaagggcgagagccggaaaacctttgtcgaactgatgagacgcggagacctcccggtgtggctggcccacaaggttgcgtctgagggcatcaaatacacagatcggaagtggtgcttcgacggggaaagaaacaatcagattctggaggagaacatggatgtggaaatctggaccaaagagggagaacgcaagaagctccggcctagatggcttgacgcccgcacatattccgatcccctggctctgaaagagtttaaggacttcgccgctggcagaaaaagcattgccctcgatctggtcacggaaatcgggcgggtgccttctcatcttgcctaccgcaccagaaatgctctggacaacctcgtcatgctgcacacatccgagcatggaggccgggcgtatcgccacgccgtggaggaactgcccgagaccatggaaacactccttctgctgggcctcatgattctgcttaccgggggagctatgctgtttctcatcagcggcaaggggatcggaaaaacgtccattggcctgatctgtgttattgtgtctagcgggatgctgtggatggccgatgtgcctctccagtggatcgcctccgctattatccttgagttctttatgatggtcctgctgattcccgagccggaaaagcaaagaacccctcaggacaatcagctcgcctacgttgtgatcggaatcctgacacttgcggccattgtggctgccaacgagatgggcctgctcgaaaccacaaagcgggatctgggcatgagcaaagagcccggggtcgtgtctcccacctcctatctggacgttgacctccaccctgctagcgcctggacgctttacgcggtggccacaaccgtcatcacaccgatgctgagacataccattgaaaattctaccgctaacgtgagcctggccgctatcgccaaccaagctgtcgtgctcatgggactggataagggctggcccatttccaaaatggaccttggggttcctctgctcgccctgggatgctactctcaggtgaatcccctgacactcacggcggccgtccttctgctggtgacccactatgctatcatcggccctgggctccaggccaaggctacacgcgaggcccagaaacggaccgccgcgggaattatgaagaaccccacagttgatggcatcatgaccattgacctggatcctgtgatctacgacagcaagttcgagaaacaacttggccaggtcatgctgctcgtgctgtgtgctgtgcagctgctccttatgagaacgtcctgggccctgtgcgaagctctgacactcgccaccgggccgattaccacactgtgggagggatctcccggcaagttttggaataccacaatcgccgttagcatggctaacatcttccgcgggtcctatcttgccggagcgggcctggcctttagcattatgaaatctgtcgggacgggacggagaggcaccggctcccagggggaaacactcggagagaagtggaaaaagaagctgaatcaactgagccggaaagagttcgatctctacaagaaatccggcatcaccgaggtggaccgcacagaggctaaggaagggcttaaaagaggagagaccacgcatcacgccgtgtctcggggcagcgctaagctgcagtggtttgtcgaacgcaacatggttattcctgaggggagagtgatcgatctgggatgtggccggggcgggtggtcctattactgcgccggactcaaaaaggtgaccgaagtccgcggctatacaaaaggcgggcccgggcatgaggagcctgtgcccatgtctacctacgggtggaatctggttaaacttatgagcggaaaggacgtgttctacctgccgcctgaaaaatgtgatacactcctgtgcgacattggcgagtccagcccctctcccaccgtcgaagagtccagaacaatccgggtgctgaagatggttgagccttggctcaaaaacaatcagttctgtattaaggtgcttaacccctatatgcctaccgtcatcgaacacctggagcgcctgcagagaaagtacggcgggatgctcgtgcggaatccgctgagcagaaactctacgcacgaaatgtattggatctccaatggaacaggcaacattgtgagctctgtcaatatggttagccgccttctgctcaaccggtttaccatgacccatagacgccccacaatcgagaaagatgtggacctgggggcgggaacgcggcacgtgaacgccgaacctgagacccccaatatggacgtcattggcgagagaatcaagcgcattaaagaagaacattcctctacatggcactacgatgacgaaaacccttataagacctgggcttaccacgggagctatgaggtgaaagccacaggatccgctagctccatgatcaatggcgttgtgaagctgctcaccaagccctgggatgtcgtgccgatggttacacaaatggccatgaccgacacgacccctttcggccagcagcgggtgtttaaagaaaaggtcgatacaagaacaccccgccctatgcccgggacacggaaagtgatggagatcaccgctgagtggctgtggagaacgcttggacgcaacaagaaacctcggctgtgcacaagagaagagttcaccaagaaggttcgcacaaatgccgcgatgggcgccgtgtttaccgaagagaaccaatgggactctgctagagccgctgtcgaagatgaggagttctggaaactcgtggaccgggaacgcgagctgcataaacttgggaaatgtggaagctgcgtctacaatatgatgggcaagagagagaagaagctgggggagtttggcaaagccaagggatcccgggccatttggtacatgtggctcggcgcgagatatctggagttcgaagctctggggtttctcaacgaggatcactggttctctcgggaaaatagctactccggagtggagggcgaagggctgcataaacttggatatatcctgcgcgacatttctaaaatccccggcggggccatgtacgccgatgacacggctggctgggacaccagaattacagaggatgacctccacaacgaggaaaagatcacccagcagatggatccggagcatcggcagctggccaatgctatctttaaacttacatatcaaaacaaggttgtgaaagtccagcgccctacccccaagggaacagtgatggacattatcagcagaaaggatcagcggggctccggacaggtgggaacctacggcctgaatacgttcacaaacatggaagcccaactcgttcgccagatggagggggaaggagtgctgagcaaagcggacctggagaatccccacctcctggagaagaaaattacccagtggcttgaaaccaagggcgtcgagagactgaaacggatggccatctctggggatgactgcgtggttaagcctattgatgaccgctttgctaacgccctcctggctcttaacgatatgggcaaggtgagaaaagacatcccgcagtggcaaccctccaagggatggcacgattggcagcaggtccctttctgtagccatcacttccatgaactgatcatgaaagacggccggaagctcgtggtcccctgccgccctcaggacgagctgattgggagagcccggatctctcaaggagcgggctggtccctgaaagaaacagcctgtctcgggaaggcttatgcccagatgtggagcctgatgtactttcaccgcagagatcttcggctggcttctaatgccatttgctccgctgtgcccgttcactggatccctaccagcagaacaacgtggtccattcatgcccaccatcagtggatgaccacagaggacatgctcaccgtgtggaaccgcgtctggatcgaggataatccctggatggaagacaagacaccggtgaccacgtgggaggatgttccttacctgggaaaacgggaagaccaatggtgtggcagccttattgggctgacctctagagcgacatgggcccagaacatcctcaccgctatccaacaggtgcgcagcctgattggcgatgaggagttcctggactatatgccctccatgaagcggtttagaaaagaagaggaatctgagggagccatctggtga

SEQ ID NO: 20863 - RNA, 9873 nt, synthetic construct
  misc_feature 1..9873: note = derived and/or modified CDS sequence (opt5) from DENV-3__FJ461337__SS-prME
  source 1..9873: mol_type = other RNA
accagcctgtgcctcatgatgatgctgcccgccacccttgctttccacctgacgtcccgggacggcgaacctcggatgatcgtggggaagaatgaacgcggaaagtctctcctgtttaagaccgccagcggcattaatatgtgtacacttatcgcgatggatctgggggagatgtgcgacgataccgtcacatacaagtgtccgctcattgctgaagttgagcccgaagacatcgattgctggtgtaacctgacctccacatgggtgacctatggaacgtgcaatcaggccggcgagcatagacgggacaagcgctctgtggccctggctcctcacgtcgggatgggactcgataccagaacacagacctggatgagcgccgagggcgcttggcggcaggtcgaaaaggttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagaataagcccacgctcgacatcgagctgcagaagaccgaagctacacagcttgccaccctgcgcaaactctgtattgagggaaagatcacaaacattaccacggattccagatgccctacacagggcgaagcgatcctgccggaggaacaggaccagaattatgtgtgtaaacacacctacgtggatcggggctgggggaacggatgcggccttttcgggaagggaagcctggtgacctgcgccaagtttcaatgtctcgagcccattgagggcaaagtggttcagtatgaaaatctgaagtacacagtgatcatcaccgtccacacaggggaccagcatcaggtgggaaacgacacgcaaggcgttaccgtggagattacacctcaggcttctaccgtcgaagccgtgctgcccgagtatggcacactcgggctggaatgctcccctcgcaccggacttgatttcaatgagatgatcctgctcacgatgaaaaacaaggcttggatggtccacagacagtggtttttcgacctgccccttccgtggaccagcggcgccacaaccgagacacctacctggaatcggaaagaactgctcgtgacgtttaagaacgcccatgctaaaaagcaagaggttgtggtcctggggtctcaggaaggagcgatgcacacagccctgaccggcgctacagagattcaaaattccgggggcaccagcatcttcgccggacacctcaagtgtcgcctgaaaatggataaacttgaactgaaaggcatgtcttacgccatgtgcctcaacacctttgtgctgaagaaagaggtttccgagacacagcatgggacgattctgatcaaggtggaatacaagggagaggacgctccctgtaaaatccctttcagcaccgaagatggccaagggaaggcccacaacggaagacttattacagcgaatcccgtcgtgaccaaaaaggaggagcccgtgaacatcgaagctgagcctccgttcggcgaatccaatattgttatcgggattggcgacaaagccctcaagatcaactggtataagaaaggatctagcatcggcaagatgtttgaggccacagctagaggggccagacgcatggctattctgggagataccgcctgggacttcggctccatgggaggggtcctgaatagcctcggcaaaatggtgcatcagatctttgggtctgcgtacacggccctgttctccggcgtgagctggattatgaagatcggaattggcgtccttctgacatggatcgggctcaactctaaaaataccagcatgtccttttcttgcattgtgatcggaatcattaccctgtatctgggcgctgttgtgcaggccgatatggggtgtgctatcaactggaagggaaaggaacttaaatgcggcagcgggattttcgtcacaaatgaggtgcacacctggacagagcagtacaagtttcaagccgactcccccaaacggctcgcgacggccatcgctggcgcctgggaaaacggagtttgtggcattagaagcaccacacgcatggagaatctgctgtggaagcagatcgctaacgaactcaattatatcctgtgggagaacaatattaaacttaccgtggtcgtgggggatatcattggagttctggaacagggcaagcggacactcacccctcagcccatggagctgaaatactcttggaagacgtgggggaaggccaaaatcgtgaccgccgagacacaaaactccagcttcattatcgacggacctaacacccccgaatgcccgtctgcttccagagcgtggaatgtctgggaggtggaagactatggctttggcgtgttcacaaccaacatctggctgaaacttcgcgaggtctacacacagagctgtgatcatcggctcatgtccgccgctattaaagacgaaagagccgttcacgccgatatggggtactggatcgagtctcagaagaatggaagctggaaactggagaaggcttcctttattgaagtgaagacctgcacgtggcctaaatctcacacactgtggagcaacggcgtgctcgagtccgacatgatcattcccaagagcctggccgggcctatctctcagcataatcaccgccccggatatcatacccaaaccgcgggcccttggcaccttgggaaactggaactcgatttcaactactgcgagggaacaaccgtcgtgatcacggaggactgtggcacacggggcccctccctgagaaccacaaccgttagcgggaagctgattcacgaatggtgctgtcgctcttgcacacttccgcctctccggtatatgggagaggatggctgttggtacgggatggaaatcagacccattaatgagaaagaagagaacatggtgaagtccctggtcagcgctggatctggcaaggtggacaattttaccatgggggttctgtgcctcgccatcctgttcgaggaagtgatgcggggaaaattcggcaagaaacatatgattgccggcgtcctttttacgttcgtgctgctcctgagcgggcagatcacctggcgcgatatggctcacacactgattatgatcggatccaacgccagcgacagaatgggcatgggggttacctatcttgcgctgatcgctacatttaagattcagcccttcctcgccctgggatttttcctccggaaactgacctctagagagaatcttctgctcggcgtggggctggccatggctacgacactgcaacttcctgaagatatcgagcagatggccaacggaattgctctgggcctcatgaccctgaagctcatcacacagtttgaaacctaccagctgtggaccgcccttgtctccctgacatgtagcaatacgattttcaccctcacagtggcgtggcgcaccgccacactgatcctggctggcgtgtcccttctgccgctctgccaatctagctccatgcggaagaccgactggctgcccatgacggtcgccgctatgggggttcctcccctccctctgtttatcttctctcttaaagatacacccaagagacgcagctggcctctgaacgagggagtgatggccgtgggcctggtctccattctcgcctctagcctgcttagaaatgacgtgcccatggctgggccgctggttgcgggaggcctcctgatcgcctgttatgtgattaccgggacctccgctgacctcacagtcgagaaagccgccgatgtgacctgggaagaggaagctgagcagacaggagttagccataacctgatgatcacggtggacgatgacggcaccatgcggattaaggatgacgaaacagagaacatccttaccgtcctgctgaaaacagccctcctgatcgtgtctggcatttttccttactccatccccgcgacccttctggtctggcacacgtggcagaagcagacccaacgcagcggggtgctctgggatgttccttctcccccggagacacagaaagctgaactggaggaaggagtgtacagaattaagcagcagggcatcttcgggaagacccaagtcggagtgggcgttcagaaagagggggtgtttcatacaatgtggcacgtcacccggggagccgtgctcacacacaatggcaagcgcctggagcctaactgggcctccgtgaaaaaggaccttattagctatggcgggggatggagactgtctgctcagtggcaaaaaggcgaagaggttcaggtcatcgccgtggaacccgggaagaatcctaagaacttccagacgatgcccggaattttccagaccacagcgggcgagatcggggctatcgccctggattttaaacccggaacctccggcagccctattatcaatcgggaaggcaaggtggtcgggctctacggaaacggcgtggttaccaaaaatgggggatatgtgtccggcattgcccaaacaaacgctgagccggacgggcccacgcctgagctggaagaggaaatgttcaagaaacgcaatcttaccatcatggatctgcatcccggcagcggaaagacaagaaagtacctccctgccattgtccgggaggctatcaaacgcagactgcggaccctcatcctggcccccacaagagtggttgcggccgaaatggaggaggctcttaagggcctgcctattcgctatcagaccacggccacaaaatctgaacacaccgggcgggagatcgtggacctgatgtgccatgctacctttacaatgagactcctgagcccggtccgcgtgcccaactacaatcttattatcatggatgaagcccacttcaccgaccctgcctccattgctgcgcggggatatatctctacaagagttggcatgggggaggccgctgccatctttatgaccgccacgccccctggaacagctgaagccttcccccagagcaacgcgccgattcaggacgaggagcgcgatatccctgaacggtcctggaactctggcaacgagtggattaccgactttgtggggaagacagtctggttcgtgcccagcatcaaagctggcaatgatattgccaactgtctgagaaagaacggaaagaaagtgatccaactctcccgcaagacctttgacacggaataccagaaaacccggctgaatgattgggacttcgtcgttacaaccgatatttctgagatgggcgccaactttaaggctgacagagtgatcgatccccggcgctgcctgaaacctgtgatcctcacagacgggcccgagagagtcattcttgccggacctatgccggtgaccgcggccagcgctgcccagcggcgcggcagagttgggcggaatccccagaaggaaaacgatcaatacatcttcacaggacagcctctgaataacgacgaggaccatgctcactggaccgaagccaagatgctgctcgataatattaacacgcccgagggcatcattcctgctctgttcgaacccgagagagagaaatccgccgcgatcgacggggaatatcgccttaagggcgagagccggaaaacatttgtggaactgatgagacgcggagatctcccggtctggctggcccacaaggtggcttctgagggcatcaaatacaccgaccggaagtggtgcttcgatggggaaagaaataaccagattctggaggagaatatggacgttgaaatctggaccaaagagggagaacgcaagaagctccggcctagatggcttgatgcccgcacatattccgaccccctggctctgaaagagtttaaggatttcgccgccggcagaaaaagcattgctctcgacctggtgaccgaaatcgggcgggtcccttctcatcttgcgtaccgcacaagaaacgccctggataatctcgtgatgctgcacacgtccgagcatggaggccgggcttatcgccacgccgtcgaggaactgcccgagaccatggaaacactccttctgctgggcctcatgattctgcttaccgggggagccatgctgtttctcatcagcggcaaggggatcggaaaaacatccattggcctgatctgtgtgattgtttctagcgggatgctgtggatggctgacgtgcctctccagtggatcgcctccgcgattgtgcttgagttctttatgatggtcctgctgatccccgagccggaaaagcaaagaacccctcaggataaccagctcgcctacgttgtgattggaatcctgacgcttgctgccatcgtggctgccaatgagatgggcctgctcgaaaccacaaagcgggacctgggcatgagcaaagagcccggggtcgtgtctcccacctcctatctggacgttgatctccaccctgcgagcgcctggacactttacgctgtggccaccacggtcattacaccgatgctgagacataccatcgaaaactctacagctaatgtgagcctggccgctattgccaaccaagcggtcgtgctcatgggactggacaagggctggcccatctccaaaatggatcttggggttcctctgctcgccctgggatgctactctcaggtgaaccccctgaccctcaccgctgccgtccttctgctggtgacacactatgctattatcggccctgggctccaggccaaggccacgcgcgaggcgcagaaacggaccgctgccggaatcatgaagaatcccacagttgacggcattatgaccatcgatctggaccctgtgatttacgatagcaagttcgagaaacaacttggccaggtcatgctgctcgtgctgtgtgctgtgcagctgctccttatgagaacatcctgggccctgtgcgaagccctgaccctcgctacggggccgatcacaaccctgtgggagggatctcccggcaagttttggaacaccacaattgccgttagcatggcgaatatcttccgcgggtcctatcttgccggagctggcctggcctttagcatcatgaaatctgtcgggaccggacggagaggcacaggctcccagggggaaacgctcggagagaagtggaaaaagaagctgaaccaactgagccggaaagagttcgacctctacaagaaatccggcattaccgaggtggatcgcacagaggctaaggaagggcttaaaagaggagagaccacacatcacgccgtgtctcggggcagcgcgaagctgcagtggtttgtcgaacgcaatatggttatccctgaggggagagtgattgacctgggatgtggccggggcgggtggtcctattactgcgccggactcaaaaaggtgaccgaagtccgcggctatacgaaaggcgggcccgggcatgaggagcctgtgcccatgtctacctacgggtggaacctggttaaacttatgagcggaaaggatgtgttctacctgccgcctgaaaaatgtgacacactcctgtgcgatatcggcgagtccagcccctctcccaccgtcgaagagtccagaacaattcgggtgctgaagatggttgagccttggctcaaaaataaccagttctgtatcaaggtgcttaatccctatatgcctaccgtcattgaacacctggagcgcctgcagagaaagtacggcgggatgctcgtgcggaacccgctgagcagaaattctacacacgaaatgtattggatctccaacggaaccggcaatatcgtgagctctgtcaacatggttagccgccttctgctcaatcggtttacgatgacacatagacgccccaccattgagaaagacgtggacctgggggctggaacccggcacgtgaacgccgaacctgagacacccaacatggatgtcatcggcgagagaattaagcgcatcaaagaagaacattcctctacgtggcactacgacgatgaaaatccttataagacctgggcttaccacgggagctatgaggtgaaagccacaggatccgctagctccatgattaacggcgttgtgaagctgctcaccaagccctgggacgtcgtgccgatggttacacaaatggccatgaccgatacaacccctttcggccagcagcgggtgtttaaagaaaaggtcgacacgagaacaccccgccctatgcccgggacacggaaagtgatggagatcaccgcggagtggctgtggagaacacttggacgcaataagaaacctcggctgtgcaccagagaagagttcacgaagaaggttcgcacaaacgccgctatgggcgccgtgtttaccgaagagaatcaatgggattctgctagagccgccgtcgaagacgaggagttctggaaactcgtggatcgggaacgcgagctgcataaacttgggaaatgtggaagctgcgtctacaacatgatgggcaagagagagaagaagctgggggagtttggcaaagcgaagggatcccgggctatctggtacatgtggctcggcgccagatatctggagttcgaagccctggggtttctcaatgaggaccactggttctctcgggaaaacagctactccggagtggagggcgaagggctgcataaacttggatatattctgcgcgatatctctaaaattcccggcggggctatgtacgccgacgacacagctggctgggataccagaatcacggaggacgatctccacaatgaggaaaagattacccagcagatggacccggagcatcggcagctggccaacgcgatctttaaacttacatatcaaaataaggttgtgaaagtccagcgccctacccccaagggaacagtgatggatatcattagcagaaaggaccagcggggctccggacaggtgggaacctacggcctgaacacattcaccaatatggaagcccaactcgttcgccagatggagggggaaggagtgctgagcaaagctgatctggagaacccccacctcctggagaagaaaatcacgcagtggcttgaaacaaagggcgtcgagagactgaaacggatggccatttctggggacgattgcgtggttaagcctatcgacgatcgctttgctaatgccctcctggcgcttaacgacatgggcaaggtgagaaaagatattccgcagtggcaaccctccaagggatggcacgactggcagcaggtccctttctgtagccatcacttccatgaactgatcatgaaagacggccggaagctcgtggtcccctgccgccctcaggatgagctgatcgggagagcccggatttctcaaggagctggctggtccctgaaagaaaccgcctgtctcgggaaggcttatgcccagatgtggagcctgatgtactttcaccgcagagaccttcggctggcttctaacgccatctgctccgcggtgcccgttcactggattcctaccagcagaacaacctggtccatccatgcccaccatcagtggatgacaacggaggatatgctcaccgtgtggaatcgcgtctggattgaggacaacccctggatggaagataagacaccggtgaccacatgggaggacgttccttacctgggaaaacgggaagatcaatggtgtggcagccttatcgggctgacctctagagctacgtgggcccagaatattctcaccgccatccaacaggtgcgcagcctgatcggcgacgaggagttcctggattatatgccctccatgaagcggtttagaaaagaagaggaatctgagggagctatttggtga

SEQ ID NO: 20864 - RNA, 9873 nt, synthetic construct
  misc_feature 1..9873: note = derived and/or modified CDS sequence (opt5) from DENV-3__FJ461338__SS-prME
  source 1..9873: mol_type = other RNA
accagcctgtgcctcatgatgatgctgcccgccacacttgctttccacctgacgtccagagacggagaacctcggatgatcgtggggaagaacgaacgcggaaaatctctcctgtttaagaccgccagcggaattaatatgtgtacacttatcgcgatggatctgggggaaatgtgcgacgataccgtgacatacaaatgtccgctcgttgctgaagtggagcccgaagacattgattgctggtgtaacctgacctccacatgggtgacctatggaacgtgcaatcaggccggcgagcatagacgggacaagcgctctgtggccctggctcctcacgtggggatgggactcgataccagaacacagacctggatgagcgccgagggcgcttggcggcaggttgaaaaagtggagacatgggccctgcgccatcccggcttcaccatccttgcgctgtttctcgcccactacattgggacgtccctgacacagaaggtcgtgatcttcatccttctgatgctcgttaccccttctatgacaatgagatgtgtgggagtcggcaaccgggactttgtggaagggctgagcggagctacctgggtggatgtcgttctggagcatggcgggtgcgtgaccacaatggccaagaataaacccacgctcgacattgagctgcagaagaccgaagctacacagcttgccaccctgcgcaaactctgtatcgagggaaagattacaaacatcaccacggattccagatgccctacacagggcgaagcgattctgccggaggaacaggaccagaattatgtgtgtaaacacacctacgtcgatcggggctgggggaacggatgcggccttttcgggaagggaagcctggtgacctgcgccaagtttcaatgtctcgagcccatcgagggcaaagttgtgcagtatgaaaatctgaagtacacagtcattatcaccgtgcacacaggggaccagcatcaggttggaaacgacacgcaaggcgtgaccgtcgagatcacacctcaggcttctaccgtggaagccgtcctgcccgagtatggcacactcgggctggaatgctcccctcgcaccggacttgatttcaatgagatgattctgctcacgatgaaaaacaaggcttggatggtgcacagacagtggtttttcgacctgccccttccgtggaccagcggcgccacaaccgagacacctacctggaataaaaaggaactgctcgttacgtttaaaaacgcccatgctaagaagcaagaggtggtcgtgctggggtctcaggaaggagcgatgcacacagccctgaccggcgctacagagatccaaaattccgggggcaccagcattttcgccggacacctcaaatgtcggctgaagatggataaacttgaactgaagggcatgtcttacgccatgtgcctcaacacctttgttctgaaaaaggaggtgtccgagacacagcatgggacgatcctgattaaggtcgaatacaaaggagaggacgctccctgtaagatccctttcagcaccgaagatggccaagggaaagcccacaacggacgccttatcacagcgaatcccgtggtgaccaagaaagaggagcccgttaacattgaagctgagcctccgttcggcgaatccaatatcgtcattgggatcggcgacaaggccctcaagattaactggtataaaaagggatctagcatcggcaaaatgtttgaggccacagctagaggggcccggagaatggctatcctgggagataccgcctgggacttcggctccgtcggcggggtgctgaatagcctcgggaagatggtccatcagatttttgggtctgcgtacacggccctgttctccggcgtgagctggatcatgaaaattggaatcggcgttcttctgacatggattgggctcaactctaagaataccagcatgtccttttcttgcatcgtgattggaatcatcaccctgtatctgggcgctgtcgtgcaggccgatatggggtgtgctattaactggaagggaaaagaacttaagtgcggcagcgggatcttcgttacaaatgaggtgcacacctggacagagcagtacaaatttcaagccgactcccccaagcgcctcgcgacggccattgctggcgcctgggaaaacggagtctgtggcatccggagcaccacaagaatggagaatctgctgtggaaacagattgctaacgaactcaattatatcctgtgggagaacaatatcaaacttaccgtggttgtgggggatattatcggagtcctggaacagggcaaacgcacactcacccctcagcccatggagctgaagtactcttggaagacgtgggggaaagccaagattgtgaccgccgagacacaaaactccagcttcatcattgacggacctaacacccccgaatgcccgtctgcttcccgggcgtggaatgtgtgggaggtcgaagactatggctttggcgttttcacaaccaacatctggctgaaacttagagaggtgtacacacagagctgtgatcatcgcctcatgtccgccgctatcaaggacgaacgggccgtgcacgccgatatggggtactggattgagtctcagaaaaatggaagctggaagctggagaaggcttcctttatcgaagtcaaaacctgcacgtggcctaagtctcacacactgtggagcaacggcgtgctcgagtccgacatgattatccccaaaagcctggccgggcctatttctcagcataatcacagacccggatatcatacccaaaccgcgggcccttggcaccttgggaagctggaactcgatttcaactactgcgagggaacaaccgttgtgatcacggagaattgtggcacacgcggcccctccctgcggaccacaaccgtcagcgggaaactgatccacgaatggtgctgtagatcttgcacacttccgcctctccgctatatgggagaggacggctgttggtacgggatggaaattcggcccatcaacgagaaggaagagaatatggtgaagtccctggttagcgctggatctggcaaagtggataactttaccatgggggtcctgtgcctcgccattctgttcgaggaagtgatgagaggaaagttcggcaaaaagcatatgatcgccggcgttctttttacgttcgtgctgctcctgagcgggcagattacctggcgggacatggctcacacactgatcatgattggatccaatgccagcgatcgcatgggcatgggggtcacctatcttgcgctgatcgctacatttaaaatccagcccttcctcgccctgggatttttcctcagaaagctgacctctcgggagaaccttctgctcggcgtggggctggccatggctacgacactgcaacttcctgaagacattgagcagatggccaatggaatcgctctgggcctcatgaccctgaagctcattacacagtttgaaacctaccagctgtggaccgcccttgtgtccctgacatgtagcaacacgatcttcaccctcacagtcgcgtggagaaccgccacactgattctggctggcgtttcccttctgccgctctgccaatctagctccatgcgcaaaaccgattggctgcccatgacggtggccgctatgggggtgcctcccctccctctgtttatcttctctcttaaggacacacccaaacggagaagctggcctctgaatgagggagtcatggccgtgggcctggtttccatcctcgcctctagcctgcttcgcaacgatgtgcccatggctgggccgctggtcgcgggaggcctcctgattgcctgttatgtgatcaccgggacctccgctgacctcacagttgagaaggccgccgacgtgacctgggaagaggaagctgagcagacaggagtcagccataacctgatgattacggtggatgacgatggcaccatgagaatcaaagacgatgaaacagagaatattcttaccgtcctgctgaagacagccctcctgatcgtgtctggcatctttccttactccattcccgcgacccttctggtttggcacacgtggcagaaacagacccaacggagcggggtgctctgggacgtcccttctcccccggagacacagaaggctgaactggaggaaggagtgtaccgcatcaagcagcagggcattttcgggaaaacccaagttggagtgggcgtccagaaggagggggtgtttcatacaatgtggcacgtgaccagaggagccgttctcacacacaacggcaaacggctggagcctaattgggcctccgtcaagaaagatcttatcagctatggcgggggatggcgcctgtctgctcagtggcaaaagggcgaagaggtccaggtgattgccgtcgaacccgggaagaaccctaaaaatttccagacgatgcccggaatcttccagaccacaaccggcgagattggggcgatcgctctggactttaagcccggaacctccggcagccctatcattaacagagaaggcaaagtggttgggctctacggaaatggcgtggtcacaaagaacgggggatatgtgtccggcatcgcccaaacgaatgccgagccggatgggcccacccctgagctggaagaggaaatgttcaaaaagcggaaccttacaattatggacctgcatcccggcagcggaaagacccgcaaatacctccctgctatcgttagagaggccattaagcggcgcctgagaacactcatcctggctcccacccgggtggtcgccgcggaaatggaggaggcccttaaaggcctgcctatcagatatcagacgacagctaccaagtctgaacacaccgggcgcgagattgtggatctgatgtgccatgccacatttaccatgcggctcctgagcccggttagagtgcccaattacaaccttatcattatggacgaagctcacttcacagatcctgcctccatcgccgctcgcggatatatttctacccgggtcggcatgggggaggcggccgctatctttatgacggccacaccccctggaaccgccgaggctttcccccagagcaatgccccgatccaggacgaggagagagacattcctgaacgctcctggaactctggcaatgagtggatcacagattttgtggggaaaaccgtgtggttcgtccccagcattaaggcgggcaacgacatcgctaactgtctgcggaagaatggcaagaaggttattcaactctccagaaaaacgtttgataccgaataccagaagacacgcctgaacgactgggatttcgtggtgaccacagacatctctgagatgggcgccaattttaaagccgatcgggtcattgaccccagacggtgcctgaagcctgtgatcctcaccgatgggcccgagcgcgttatccttgctggacctatgccggtgacagccgcgagcgccgctcagagacggggccgcgtcgggagaaacccccagaaggaaaatgaccaatacattttcaccggacagcctctgaacaatgatgaggaccatgcccactggacggaagctaaaatgctgctcgacaacatcaatacacccgagggcattatccctgccctgttcgaacccgagcgggagaagtccgctgccattgatggggaatatagacttaaaggcgagagccgcaagacctttgtggaactgatgcggagaggagacctcccggtttggctggcgcacaaagtggcctctgagggcatcaagtacaccgatcgcaaatggtgcttcgacggggaacggaacaatcagatcctggaggagaacatggatgtcgaaatttggacaaaggagggagaaagaaagaaactccgccctcggtggcttgacgctagaacctattccgatcccctggccctgaaggagtttaaagacttcgctgccggccgcaagagcatcgccctcgatctggtgacagaaattgggagagtcccttctcatcttgcttaccggacgcgcaatgcgctggacaacctcgtgatgctgcacacctccgagcatggaggcagagcctatcggcacgctgttgaggaactgcccgagacaatggaaaccctccttctgctgggcctcatgatcctgcttacagggggagccatgctgtttctcattagcggcaaagggatcggaaagacctccatcggcctgatttgtgtgatcgtgtctagcgggatgctgtggatggccgatgtccctctccagtggattgcttccgccatcgttcttgagttctttatgatggtgctgctgattcccgagccggaaaagcaacgcacgcctcaggacaatcagctcgcgtacgtggtcatcggcattctgacccttgccgctatcgtggccgctaacgagatgggcctgctcgaaacaaccaaaagagatctgggcatgagcaaggagcccggggttgtgtctcccacatcctatctggacgtcgacctccaccctgccagcgcgtggaccctttacgccgtggctacgacagtcatcaccccgatgctgcggcatacaattgaaaattctaccgccaacgtgagcctggctgccatcgctaaccaagccgttgtgctcatgggactggataaaggctggcccatttccaagatggaccttggggtccctctgctcgcgctgggatgctactctcaggtgaatcccctgaccctcacagccgctgttcttctgctggtgacgcactatgccatcattggccctgggctccaggctaaagccaccagagaggcccagaagcgcacagcggctggaatcatgaagaaccccaccgtcgatggcatcatgacaattgacctggatcctgtgatctacgacagcaaattcgagaagcaacttggccaggtgatgctgctcgttctgtgtgccgtccagctgctccttatgcggacctcctgggctctgtgcgaagccctgacgctcgccacagggccgattaccaccctgtgggagggatctcccggcaaattttggaatacaaccatcgctgtgagcatggccaacattttcagagggtcctatcttgcgggagccggcctggcttttagcatcatgaagtctgtggggacaggacgccggggcacgggctcccagggggaaaccctcggagagaaatggaagaagaaactgaatcaactgagcagaaaggagttcgatctctacaaaaagtccggcatcacagaggtcgaccggaccgaggccaaagaagggcttaagcgcggagagacaacccatcacgctgtttctagaggcagcgccaaactgcagtggtttgtggaacggaacatggtgattcctgaggggcgcgtcatcgatctgggatgtggcagaggcgggtggtcctattactgcgcgggactcaagaaggtgacggaagttcggggctataccaaagggggacccggccatgaggagcctgtgcccatgtctacatacgggtggaatattgtcaagctgatgagcggaaaagacgtgttctaccttccgcctgaaaagtgtgataccctgctctgcgacatcggcgagtccagcccctctcccacagttgaagagtcccgcaccattagagtgctgaaaatggtcgagccttggctgaagaacaatcagttctgtatcaaggtgctcaacccctatatgcctacagtgattgaacaccttgagcggctgcagcgcaaatacggcgggatgctggtcagaaatccgctcagccggaactctacccacgaaatgtattggatctccaatggaacgggcaacatcgttagctctgtgaatatggtgagcagactgcttctgaaccgctttacaatgacccatcggagacccaccattgagaaggatgtcgacctcggggccggaacacgccacgtgaacgctgaacctgagacgcccaatatggacgttatcggcgagcggattaaaagaatcaaggaagaacactcctctacctggcactacgatgacgaaaacccttataaaacatgggcctaccacgggagctatgaggtgaaggctaccggatccgccagctccatgattaatggcgtcgtgaagctgctgacaaaaccctgggatgttgtgccgatggtcacccaaatggctatgacagacaccacgcctttcggccagcagcgcgtgtttaaggaaaaagttgatacccggacacccagacctatgcccgggacccgcaaggtgatggagatcacagccgagtggctctggcggaccctgggaagaaacaaaaagcctcgcctttgcacgcgggaagagttcacaaagaaagtcagaaccaatgcggccatgggcgctgtgtttacagaagagaaccaatgggactctgcccgcgctgccgtcgaagatgaggagttctggaagctggtggacagagaacgggagctccataaactggggaagtgtggaagctgcgtttacaatatgatgggcaaacgcgaaaagaaacttggggagtttggcaaggccaagggatccagagcgatctggtacatgtggctgggcgctcggtatctcgagttcgaagccctggggtttctgaacgaggatcactggttctctagagaaaatagctactccggagtggagggcgaagggctccataaactgggatatattcttcgggacatctctaagattcccggcggggccatgtacgctgatgacaccgccggctgggacacgcgcatcaccgaggatgacctgcacaacgaggagaaaattacacagcagatggatccggagcatagacagctcgctaatgccatctttaagctgacctatcaaaacaaagtcgtgaaggtgcagcggcctacacccaagggaaccgttatggacatcattagccgcaaagatcagagaggctccggacaggtgggaacatacggccttaataccttcacgaacatggaagcgcaactggtccggcagatggagggggaaggagtgctcagcaaggccgacctggagaatccccatctgctcgagaaaaagatcacacagtggctggaaaccaaaggcgttgagcgccttaagagaatggctatttctggggatgactgcgtggtcaagcctatcgatgaccggtttgccaacgctctgctcgccctgaacgatatgggcaaagtgcgcaaggacattccgcagtggcaaccctccaaaggatggcacgattggcagcaggtccctttctgtagccatcacttccatgaacttatcatgaaggacggcagaaaactggtggttccctgccggcctcaggacgagctcatcgggcgcgcgagaatttctcaaggagccggctggtccctgaaggaaaccgcttgtctggggaaggcctatgctcagatgtggagcctcatgtactttcaccggcgcgatctgagacttgcctctaatgctatctgctccgccgtgcccgtccactggattcctacaagccggaccacatggtccatccatgcgcaccatcagtggatgacgaccgaggacatgctgacagtgtggaacagagtttggattgaggataatccctggatggaagacaaaaccccggtgacaacctgggaggatgtcccttacctcggaaagcgcgaagaccaatggtgtggcagcctgatcgggcttacgtctcgggccacctgggctcagaacattctgacagccatccaacaggtgagaagcctcatcggcgatgaggagttcctggactatatgccctccatgaaacgctttcggaaggaagaggaatctgagggagccatttggtga

SEQ ID NO: 20865 - RNA, 9873 nt, synthetic construct
  misc_feature 1..9873: note = derived and/or modified CDS sequence (opt5) from DENV-3__FJ562103__SS-prME
  source 1..9873: mol_type = other RNA
accagcctgtgcctcatgatgatgctgcccgccacacttgctttccacctgacgtccagagacggcgagcctcggatgatcgtggggaagaacgaacgcggaaaatctctcctgtttaagaccgccagcggcattaatatgtgtacacttatcgcgatggatctgggggagatgtgcgacgataccgtcacatacagatgtccgctcattgctgaagttgagcccgaagacatcgattgctggtgtaacctgacctccacatgggtgacctatggaacgtgcaatcaggccggcgagcatcggcgcgacaaaagatctgtggccctggctcctcacgtcgggatgggactcgatacccggacacaaacctggatgagcgccgagggcgcttggcgccaggtggaaaaggttgagacatgggccctgagacatcccggcttcaccattcttgcgctgtttctcgcccactacatcgggacgtccctgacacagaaagtggtcatcttcacccttctgatgctcgtgacaccttctatgaccatgcggtgtgttggagtgggcaaccgcgactttgtcgaagggctgagcggagctacctgggtggatgtggtcctggagcatggcgggtgcgttacaacgatggccaagaataagcccaccctcgacattgagctgcagaaaacagaagctacccaacttgccacactgagaaagctctgtatcgagggaaaaattaccaacatcacgacagattcccggtgccctacccagggcgaagcgattctgccggaggaacaggaccagaattatgtgtgtaagcacacctacgtggatcgcggctgggggaacggatgcggccttttcgggaaaggaagcctggtcacatgcgccaagtttcaatgtctcgagcccatcgagggcaaggtggttcagtatgaaaatctgaaatacaccgtgattatcacagtccacacgggggaccagcatcaggtgggaaacgacacccaaggcgttacagtggagatcacccctcaggcttctacagtcgaagccgtgctgcccgagtatggcaccctcgggctggaatgctcccctagaacgggacttgatttcaatgagatgattctgctcaccatgaagaacaaagcttggatggtccaccggcagtggtttttcgacctgccccttccgtggacaagcggcgccaccacagagacccctacgtggaatcgcaaggaactgctcgtgacatttaaaaacgcccatgctaagaaacaagaggttgtggtcctggggtctcaggaaggagcgatgcacaccgccctgacaggcgctaccgagatccagaattccgggggcaccagcattttcgccggacacctcaagtgtagactgaagatggataaacttgaactgaagggcatgtcttacgccatgtgcctcaacacatttgtgctgaaaaaggaggtttccgagacgcagcatgggaccatcctgattaaagtggaatacaagggagaggacgctccctgtaagatccctttcagcacagaagatggccaagggaaagcccacaacggacggcttatcaccgcgaatcccgtcgtgacaaagaaagaggagcccgtgaacattgaagctgagcctccgttcggcgaatccaatatcgttattgggatcggcaacaaggccctcaaaattaattggtataagaagggatctagcatcggcaaaatgtttgaggccaccgctagaggggcccgccggatggctatcctgggagacacggcctgggatttcggctccgtcgggggagtgctgaacagcctcggcaagatggtgcatcagatttttgggtctgcgtacacagccctgttctccggcgtcagctggatcatgaaaattggaatcggcgtgcttctgacctggattgggctcaattctaagaacaccagcatgtccttttcttgcatcgttattggaatcatcacactgtatctgggcgctgtggtccaggccgacatggggtgtgctattaattggaaaggaaaggaacttaagtgcggcagcgggatcttcgtgaccaacgaggttcacacatggacggagcagtacaaatttcaagccgattcccccaagagactcgcgaccgccattgctggcgcctgggaaaatggagtgtgtggcatccgcagcacaacccggatggagaacctgctgtggaaacagattgctaatgaactcaactatatcctgtgggagaataacatcaagcttacagtcgtggttggggacattatcggagtgctggaacagggcaaaagaaccctcacgcctcagcccatggagctgaagtactcttggaaaacctgggggaaggccaagattgtcacagccgagacccaaaactccagcttcatcattgatggacctaatacacccgaatgcccgtctgcttcccgcgcgtggaacgtgtgggaggtggaagactatggctttggcgtcttcaccacaaatatctggctgaaacttcgggaggtttacacccagagctgtgaccatagactcatgtccgccgctatcaaggatgaacgcgccgtgcacgccgacatggggtactggattgagtctcagaaaaacggaagctggaagctggagaaagcttcctttatcgaagtgaagacgtgcacatggcctaagtctcacaccctgtggagcaatggcgtcctcgagtccgatatgattatccccaaaagcctggccgggcctatttctcagcataaccaccggcccggatatcatacccaaacagcgggcccttggcaccttgggaagctggaactcgacttcaattactgcgagggaaccacggtggttatcacagagaactgtggcaccagaggcccctccctgcgcacaaccacagtgagcgggaaactgatccacgaatggtgctgtcggtcttgcacccttccgcctctcagatatatgggagaggatggctgttggtacgggatggaaattcggcccatcaatgagaaggaagagaacatggtcaaatccctggtgagcgctggatctggcaaggttgacaattttacgatgggggtgctgtgcctcgccattctgttcgaggaagtcatgcgcggaaagttcggcaaaaagcatatgatcgccggcgtgctttttaccttcgttctgctcctgagcgggcagattacatggagagatatggctcacaccctgatcatgattggatccaacgccagcgaccggatgggcatgggggtgacatatcttgcgctgatcgctacctttaaaatccagcccttcctcgccctgggatttttcctcagaaagctgacgtctcgcgagaatcttctgctcggcgtcgggctggccatggctacaaccctgcaacttcctgaagatattgagcagatggccaacggaatcgctctgggcctcatgacactgaaactcattacccagtttgaaacctaccagctgtggacagcccttgtgtccctgacgtgtagcaataccatcttcacactcaccgtggcgtggcggacagccaccctgattctggctggcgtctcccttctgccgctctgccaatctagctccatgagaaagacggactggctgcccatgacagttgccgctatgggggtgcctcccctccctctgtttatcttctctcttaaggatacccccaaacgcagaagctggcctctgaacgagggagtgatggccgtcggcctggtgtccatcctcgcctctagcctgcttcggaacgacgttcccatggctgggccgctggtggcgggaggcctcctgattgcctgttatgtcatcaccgggacatccgctgatctcaccgtggagaaggccgccgacgttacatgggaagaggaagctgagcagacgggagtgagccataatctgatgattaccgtcgacgatgacggcacaatgcgcatcaaagatgacgaaaccgagaacattcttacagtgctgctgaagaccgccctcctgatcgtctctggcatctttccttactccattcccgcgacgcttctggtgtggcacacctggcagaaacagacacaaagaagcggggttctctgggatgtgccttctcccccggagacccagaaggctgaactggaggaaggagtctaccggatcaaacagcagggcattttcgggaagacacaagtgggagttggcgtgcagaaggagggggtctttcataccatgtggcacgtgacacgcggagccgtgctcacgcacaatggcaaaagactggagcctaactgggcctccgttaagaaagaccttatcagctatggcgggggatggcggctgtctgctcagtggcaaaagggcgaagaggtccaggtgattgccgtggaacccgggaaaaatcctaagaacttccagaccatgcccggaatcttccagacaaccaccggcgagattggggcgatcgctctggattttaagcccggaacatccggcagccctatcattaatcgcgaaggcaaagtcgtggggctctacggaaacggcgttgtgacgaagaatgggggatatgtctccggcatcgcccaaaccaacgccgagccggacgggcccacacctgagctggaagaggaaatgttcaaaaagagaaatcttaccattatggatctgcatcccggcagcggaaaaacacggaagtacctccctgctatcgtgcgcgaggccattaagagacggctgagaaccctcatcctggctcccacgcgcgttgtggccgcggaaatggaggaggcccttaaaggcctgcctatccggtatcagacaaccgctaccaagtctgaacacacagggagagagattgtcgacctgatgtgccatgccacctttacaatgcgcctcctgagcccggtgcgggttcccaactacaatcttatcattatggatgaagctcacttcaccgaccctgcctccatcgccgctagaggatatatttctacgcgcgtgggcatgggggaggcggccgctatctttatgacagccaccccccctggaacagccgaagctttcccccagagcaacgccccgatccaggatgaggagaaagacattcctgaacggtcctggaattctggcaacgagtggatcaccgactttgtcgggaagacggtgtggttcgtgcccagcattaaagcgggcaacgatatcgctaattgtctgagaaagaacggaaagaaagtcattcaactctcccgcaagacctttgacacagaataccagaaaacccggctgaatgattgggacttcgttgtgacaaccgatatctctgagatgggcgccaactttaaggccgacagagtgattgatccccggcgctgcctgaaacctgtcatcctcacagacgggcccgagagagtgatccttgctggacctatgccggttaccgccgcgagcgccgctcagcggcgcggcagagtggggcggaatccccagaaggaaaacgatcaatacattttcacgggacagcctctgaataacgacgaggatcatgcccactggacagaagctaagatgctgctcgacaatatcaacacccccgagggcattatccctgccctgttcgaacccgagagagagaaatccgctgccattgacggggaatatcgccttaagggcgagagccggaaaacctttgtcgaactgatgagacgcggagatctcccggtgtggctggcgcacaaggttgcctctgagggcatcaaatacacagaccggaagtggtgcttcgatggggaaagaaataaccagatcctggaggagaatatggacgtggaaatttggaccaaagagggagaacgcaagaagctccggcctagatggcttgatgctcgcacatattccgaccccctggccctgaaagagtttaaggatttcgctgccggcagaaaaagcatcgccctcgacctggtcacggaaattgggcgggtgccttctcatcttgcttaccgcaccagaaacgcgctggataatctcgtcatgctgcacacatccgagcatggaggccgggcctatcgccacgctgtggaggaactgcccgagaccatggaaacactccttctgctgggcctcatgatcctgcttaccgggggagccatgctgtttctcattagcggcaaggggatcggaaaaacgtccatcggcctgatttgtgttatcgtgtctagcgggatgctgtggatggccgacgtgcctctccagtggattgcttccgccatcgtccttgagttctttatgatggttctgctgattcccgagccggaaaagcaaagaacccctcaggataaccagctcgcgtacgtggtgatcggaattctgacacttgccgctatcgtcgccgctaatgagatgggcctgctcgaaaccacaaagcgggacctgggcatgagcaaagagcccggggtggtttctcccacctcctatctggatgtggacctccaccctgccagcgcgtggacgctttacgccgtcgctacaaccgtgatcacaccgatgctgagacataccattgaaaactctaccgccaacgtcagcctggctgccatcgctaatcaagccgtggttctcatgggactggacaagggctggcccatttccaaaatggatcttggggtgcctctgctcgcgctgggatgctactctcaggtcaaccccctgacactcacggccgctgtgcttctgctggttacccactatgccatcattggccctgggctccaggctaaggccacacgcgaggcccagaaacggaccgcggctggaatcatgaagaatcccacagtggacggcatcatgaccattgatctggaccctgtcatctacgatagcaagttcgagaaacaacttggccaggtgatgctgctcgtgctgtgtgccgttcagctgctccttatgagaacgtcctgggctctgtgcgaagccctgacactcgccaccgggccgattaccacactgtgggagggatctcccggcaagttttggaacaccacaatcgctgtcagcatggccaatattttccgcgggtcctatcttgcgggagccggcctggcttttagcatcatgaaatctgtggggacgggacggagaggcaccggctcccagggggaaacactcggagagaagtggaaaaagaagctgaaccaactgagccggaaagaattcgacctctacaagaaatccggcatcaccgaggtggatcgcacagaggccaaggaagggcttaaaagaggagagaccacgcatcacgctgtctctcggggcagcgccaagctgcagtggtttgttgaacgcaatatggtgattcctgaggggagagtgatcgacctgggatgtggccggggcgggtggtcctattactgcgcgggactcaaaaaggtcaccgaagtgcgcggctatacaaaggggggacccggccatgaggagcctgttcccatgtctacctacgggtggaacattgtgaaactgatgagcggaaaggatgtcttctaccttccgcctgaaaaatgtgacacactgctctgcgatatcggcgagtccagcccctctcccaccgtggaagagtccagaacaattcgggttctgaagatggtggagccttggctgaaaaataaccagttctgtatcaaggtcctcaatccctatatgcctaccgtgattgaacaccttgagcgcctgcagagaaagtacggcgggatgctggtgcggaacccgctcagcagaaattctacgcacgaaatgtattggatctccaacggaacaggcaatatcgtcagctctgttaacatggtgagccgcctgcttctgaaccggtttaccatgacccatagacgccccacaattgagaaagacgtggatctcggggccggaacgcggcacgtcaatgctgaacctgagacccccaacatggacgtgatcggcgagagaattaagcgcatcaaagaagagcattcctctacatggcactacgacgatgaaaatccttataagacctgggcctaccacgggagctatgaggttaaagctacaggatccgccagctccatgattaacggcgtggtcaagctgctgaccaagccctgggacgtggttccgatggtgacacaaatggctatgaccgatacgacccctttcggccagcagcgggtctttaaagaaaaggtggacacaagaaccccccgccctatgcccgggacacggaaagttatggagatcaccgccgagtggctctggagaacgctgggacgcaataagaaacctcggctttgcacaagagaagagttcaccaagaaggtgcgcacaaacgcggccatgggcgctgtctttaccgaagagaatcaatgggattctgccagagctgccgtggaagacgaggagttctggaaactggtcgatcgggaacgcgagctccataagctggggaaatgtggaagctgcgtgtacaacatgatgggcaagagagaaaaaaagcttggggagtttggcaaagccaagggatcccgggcgatctggtacatgtggctgggcgctagatatctcgagttcgaagccctggggtttctgaatgaggaccactggttctctcgggaaaacagctactccggagttgagggcgaagggctccataagctgggatatattcttcgcgatatctctaaaattcccggcggggccatgtacgctgacgatacggccggctgggacaccagaatcacagaggacgatctgcacaatgaggaaaagattacccagcagatggacccggagcatcggcagctcgctaacgccatctttaaactgacatatcaaaataaggtggtcaaagtgcagcgccctacccccaagggaacagtgatggatatcattagcagaaaggaccagcggggctccgggcaggttggaacctacggccttaacacgttcacaaatatggaagcgcaactggtgcgccagatggagggggaaggagtcctcagcaaagccgatctggagaacccccacctgctcgagaagaaaatcacccagtggctggaaaccaagggcgtggagagacttaaacggatggctatttctggggacgattgcgttgtgaagcctatcgacgatcgctttgccaacgctctgctcgccctgaatgacatgggcaaggtcagaaaagatattccgcagtggcaaccctccaagggatggcacgactggcagcaggtgcctttctgtagccatcacttccatgaacttatcatgaaagatggccggaagctggtcgtgccctgccgccctcaggacgagctcatcgggagagcgcggatttctcaaggagccggctggtccctgaaagaaacagcttgtctggggaaggcctatgctcagatgtggagcctcatgtactttcaccgcagagacctgcggcttgcctctaacgctatctgctccgccgttcccgtgcactggattcctaccagcagaacaacgtggtccatccatgcgcaccatcagtggatgaccacagaggatatgctgaccgtctggaatcgcgtgtggattgaggacaacccctggatggaagataagacaccggttaccacgtgggaggacatcccttacctcggaaaacgggaagatcaatggtgtggcagcctgattgggcttacctctagagccacatgggctcagaatatcctgaccgccatccagcaggtgcgcagcctcattggcgacgaggagttcctggattatatgccctccatgaagcggtttagaaaagaagaggaatctgagggagccatctggtga

SEQ ID NO: 20866 - RNA, 9873 nt, synthetic construct
  misc_feature 1..9873: note = derived and/or modified CDS sequence (opt5) from DENV-3__FJ898456__SS-prME
  source 1..9873: mol_type = other RNA
accagcctgtgcctcatgatgatgctgcccgccacacttgctttccacctgacgtccagagacggcgagcctcggatgatcgtggggaagaacgaacgcggaaaatctctcctgtttaagaccgccagcggcattaatatgtgtacacttatcgcgatggatctgggggagatgtgcgacgataccgtcacatacaaatgtccgctcattaccgaagttgagcccgaagacatcgattgctggtgtaacctgacatccacctgggtgacgtatggaacctgcaatcaggctggcgagcatagacgggacaagcgctctgtggccctggcccctcacgtcgggatgggactcgatacaagaacccaaacatggatgagcgctgagggcgcctggcggcaggtggaaaaagttgagacctgggctttccgccatcccggctttacgattctggcccttttcctggcgcactacatcgggacatccctcacccagaaggtggtcatctttattctgcttatgctggtgacaccttctatgaccatgagatgtgttggagtgggcaaccgggacttcgtcgaagggctcagcggagccacctgggtggatgtggtcctggagcatggcgggtgcgttacaacgatggctaagaataaacccaccctggacatcgagctccagaagacagaagccacccaactggctacacttcgcaaactgtgtattgagggaaagatcaccaacgtgacgacagattccagatgccctacccagggcgaagccattctcccggaggaacaggaccagaattatgtgtgtaaacacacctacgtcgatcggggctgggggaacggatgcggcctgtttgggaagggaagccttgtgacatgcgcgaagttccaatgtctggagtctatcgagggcaaagccgttcagcacgaaaatctcaagtataccgtgattatcacagtccatacgggggaccagcaccaggtgggaaacgagacccaaggcgttacagctgaaatcaccccccaggcctccacagtggaggctattctgcctgaatacggcaccctggggctcgagtgcagcccccgcacgggactggactttaatgagatgatccttctgaccatgaaaaacaaggcctggatggtccatagacagtggttctttgatctccctctgccctggacatctggcgccaccacagaaaccccgacgtggaataaaaaggagcttctggtgacattcaaaaacgctcacgcgaagaagcaagaagtcgtggttctcgggtcccaggagggagccatgcacaccgctctgacaggcgccaccgaaattcagaccagcgggggcacatctatctttgccggacatctgaaatgtcggctcaagatggacaaactggagcttaagggcatgtcctatgctatgtgcctgaatgccttcgtgctcaaaaaggaggtcagcgaaacgcagcacgggaccattctgatcaaggtggagtacaaaggagaagatgcgccttgtaagatccccttctccacagaggacggccaagggaaagctcataacggacgcctgattaccgccaaccctatcgttacaaagaaagaggaacccgtgaatattgaggccgaacccccttttggcgagtctaacatcgtcattgggatcggcgataaggctcttaagatcaattggtacaaaaagggaagctccattggcaaaatgttcgaagccaccgctagaggggcccggagaatggcgatcctcggagacacggcctgggattttggcagcgtggggggagtgctgaactctctgggcaagatggttcaccagattttcgggtccgcttatacagccctctttagcggcgtctcttggatcatgaaaattggaatcggcgtgctgcttacctggattgggctgaatagcaagaacacctccatgtctttcagctgcatcgtgatcggaattatcacactctacctgggcgctgtcgtgcaggccgacatggggtgtgttattaattggaagggaaaagagctgaagtgcggctccgggatctttgtgaccaacgaggtccatacatggacggaacagtataaattccaagcggatagcccgaagcgccttgccaccgctattgccggcgcttgggagaatggagtgtgtggcatccggtctacaaccagaatggaaaacctcctgtggaaacagatcgccaatgagctgaactacattctctgggaaaataacatcaagctgacaattgttgtgggggacgtcatcggaattcttgagcagggcaaacgcaccctgacgccccagcctatggagctcaagtattcctggaagacctgggggaaagccaagatcgtgacagctgaaacccaaaatagctcttttatcattgatggacccaacacacctgagtgcccctccgcgagccgggcctggaacgtttgggaagtggaggactacggcttcggcgtctttaccacaaatatctggctgaaactgagagaaatgtatacccagctttgtgaccaccgcctcatgtccgctgccgtgaaggatgagcgggccgtgcacgctgacatggggtactggattgagtctcagaaaaacggaagctggaagctggaaaaggcctccctgatcgaggtcaaaacgtgcacatggccgaagtctcataccctctggagcaatggcgttctggaatccgatatgattatccctaaaagccttgcggggcccatctctcagcacaactacagacctggatatcatacccaaacagctggcccctggcacctggggaagctcgagctggacttcaattactgcgagggaaccacggtggtgattacagaaaactgtggcacccgcggcccttccctgcggacaaccacagtcagcgggaaacttatccacgagtggtgctgtagatcttgcaccctccccccgctgcgctatatgggagaagatggctgttggtacgggatggagattcggcctatcaatgaaaaggaggagaacatggtgaagtccctggttagcgccggatctggcaaagccgacaattttacgatgggggtgctctgcctggctattttcttcgaagaggtcatgagaggaaagtttggcaaaaagcatatgatcgccggcgcgcttttcacctttgtgctgctcctgagcgggcagattacatggcgggatatggctcacaccctgatcatgatcggatccaacgccagcgaccgcatgggcatgggggttacatatcttgccctgattgctaccttcaaaatccagccctttctcgccctgggattctttctcagaaagctgacgtctcgggaaaatcttctgctcggcgtggggctggctatggccacaaccctgcaacttcccgaggatattgaacagatggcgaacggaatcgccctgggcctcatggctctgaagctcattacacagttcgagacctaccagctgtggaccgcccttgtctccctgatgtgtagcaatacaatctttacgctcaccgtggcttggagaacagccaccctgatcctggccgttatttcccttctgcctgtgtgccaatctagctccatgcgcaaaacagactggctcccgatgaccgtcgctgcgatgggcgtgccctctctgcctctcttcatctttagcctgaaggatacgcttaaacggagatcctggcccctgaacgagggggtgatggccgtcggactggtttctattctcgctagctccttcctgcgcaatgacgtgcctatggccggcccccttgtggccgggggactgctcatcgcttgttatgtcattacaggcaccagcgccgatctgaccgtggaaaaggcggctgacgttacatgggaggaagaggccgaacagaccggggtgtctcataacctcatgatcacagtcgacgatgacggaacgatgagaatcaaagatgacgagaccgagaacattctgacagtgcttctgaagaccgccctgctcatcgtttccggcatttttccttacagcatccccgctacactgcttgtgtggcacacctggcagaaacagacgcaacggtctggcgtcctgtgggatgtgccgtcccctcccgaaacccagaaggccgagctcgaagagggggtctaccgcattaagcagcagggaatcttcggcaaaacacaagtgggggttggagtgcagaaggagggcgtcttccataccatgtggcacgtgacaagaggggcggttctgacccacaatggaaaacggctcgaacctaactgggctaatgtgaagaaagacctgattagctatggcggcgggtggaagctttctgcccagtggcaaaagggagaggaagtccaggtgatcgccgtggagcccggcaaaaacccgaagtcctttcagacaatgcctgggatcttccagacgaccacaggagaaattggcgctatcgccctggattttaaacccgggaccagcggatcccctattatcaatcgcgagggcaaggttgtcggcctgtacgggaacggagtggtgaccaaaaatggcgggtatgtcagcggaattgctcaaacaaacgccgagcccgacggccccacgcctgaactcgaggaagagatgttcaagaagagaaatctgaccatcatggatcttcatccggggtctggcaaaacacggaagtacctgcccgcgatcgtgcgcgaagccattaaaagacggctccgcaccctgatcctcgctcctacaagagttgtggccgctgagatggaggaagccctgaagggacttcccattcggtatcagaccacggccacaaaaagcgagcacaccggcagagaaatcgtcgacctgatgtgccatgctacctttacaatgcgcctgctctcccctgtgcgggttcccaactacaatctgattgtgatggatgaggcgcacttcaccgaccctgcctctatcgctgccagagggtatatcagcacacgcgtcggaatgggcgaagccgctgccatttttatgaccgcgacgccgcccgggacagctgatgccttccctcagtccaacgcccccatccaggacgaggagcgggacattcctgaaagatcttggaatagcggaaacgagtggatcaccgattttgctggcaagacagtgtggttcgttccctccattaaggccgggaatgacatcgcgaactgtcttcgcaaaaacggcaagaaagtgattcaactgtctcggaagacctttaatacggaataccagaaaaccaagctcaacgattgggacttcgtcgtgacaaccgatatcagcgagatgggagccaatttcaaggctgacagagtgatcgatccgcgccggtgcctgaaacctgtcattctgacagacggccccgagagagttatcctcgccgggcccatgcctgtgaccgtggcttccgccgctcagcggcgcggaagagtcggccggaacccccagaaggaaaatgatcaatacatttttacagggcagcctcttaacaatgacgaggatcatgcccactggaccgaagcgaaaatgctgctggacaacatcaatacgccggagggaattatccccgccctcttcgaacctgagcgcgagaagagcgctgccatcgacggcgaatatagactgaaaggggagtctcggaagacatttgtggaacttatgagacgcggcgatctgcccgtttggctcgctcacaaagtggcctccgagggaattaagtacaccgaccggaagtggtgcttcgatggcgaaagaaacaatcagatcctggaggagaacatggacgtcgaaatttggaccaaagagggggaaaagaaaaagctgcgccctcggtggctcgatgccagaacatatagcgacccccttgctctgaaagagtttaaggatttcgcggccggacgcaagtctatcgctctggacctcgtgaccgaaattggccgggttccgtcccatctggcccacagaacacgcaatgcccttgataacctggtgatgctccatacgagcgagcacgggggaagagcttaccggcacgccgtcgaggaactgcctgagaccatggaaacactgctccttctgggcctgatgatcctcctgaccggcggggcgatgctttttctgatctccggaaaaggcattgggaagacatctatcggactcatttgtgtggtcgccagctccggcatgctgtggatggctgacgtgcccctgcagtggatcgccagcgctattgttctcgagttctttatgatggtgcttctgatccctgagcccgaaaaacaacgcacccctcaggataatcagctggcctatgtggtcattgggatcctcacgctggcggccatcgttgctgccaacgagatgggacttctggaaaccacaaagagagacctcggcatgtctaaagagcccggcgtggtgtccccgaccagctacctggatgtcgacctgcatcctgcttctgcctggacactctatgctgtggccaccacggttattacacccatgcttcggcacaccatcgaaaatagcacagcgaacgtgtccctggccgctattgccaaccaagctgtcgtgctgatggggctcgacaagggatggcccatctctaagatggatctgggcgtccctcttctggccctcgggtgctacagccaggtgaatccgctgaccctgaccgccgcggttctccttctggtgacacattacgctattatcggacccggcctgcaggccaaagctacgcgcgaggcccagaagagaaccgccgctgggatcatgaaaaaccctacagtcgacggaattatgaccatcgatctcgaccccgtgatttatgattccaagttcgagaaacaactgggccaggttatgcttctggtgctctgtgccgtccagctgctgctcatgcggacatcttgggcgttttgcgaagcccttaccctggctacgggccctatcacaaccctgtgggaggggagccccggaaagttctggaataccacaattgccgtgtccatggctaacatctttagaggcagctacctcgccggggcgggactggccttctctatcatgaagtccgtgggcaccgggaaacgcggaacaggcagccagggcgaaacgcttggggagaagtggaaaaagaaactgaatcaactctcccggaaggaattcgacctgtataaaaagtctggaattaccgaggttgagagaacagaagctaaggagggcctgaaacgcggggaaatcacccaccatgccgtcagccggggatccgctaagctccagtggtttgtggagagaaacatggtgattcctgaaggccgggtcatcgatcttgggtgtggacgcggcggctggtcttactattgcgccgggctgaaaaaggttacagaggtgagaggatacaccaaaggcgggccgggacacgaggaacccgtgcctatgagcacgtatggctggaatattgtcaagctgatgtccgggaaggacgtgttctacctcccccctgagaaatgtgataccctgctttgcgacatcggagaaagctctccctccccgacagttgaggagagccggaccattcgcgtgctgaagatggtcgaaccttggctcaaaaacaatcagttttgtatcaaggtgctgaacccctacatgcccacagttatcgagcacctggaaagactccagcggaaacatggcggcatgcttgtgcgcaatcctctgtctagaaactccacccacgagatgtattggattagcaatgggacaggaaacatcgtctctagcgtgaatatggtgtcccggctgctcctgaaccgcttcaccatgacgcatagacggcccacaattgaaaaggatgtcgaccttggcgctgggaccagacacgttaacgccgagcctgagaccccgaatatggatgtgatcggagaacgcattcggagaatcaaggaggaacactctagcacatggcattacgacgacgagaacccctataaaacgtgggcgtaccacggctcctatgaagtgaaggccaccgggagcgcttcctctatgatcaatggagtcgtgaaactgctcacaaagccttgggatgttgtgcccatggtcacccaaatggccatgacagacaccacaccttttggccagcagcgcgtgttcaaagagaaggttgatacccggacgcccagaccgatgcctggcacccgcaaggtgatggagattacagctgaatggctgtggcggaccctggggagaaacaaacgcccccggctctgcacaagagaggaatttatcaagaaagtccgcaccaatgccgccatgggagcggtgttcacggaggaaaaccaatgggacagcgctcgggccgccgttgaggatgaggaattttggaagctggtggacagagagcgcgaacttcataaactgggcaagtgtgggtcctgcgtctacaatatgatgggaaaaagagagaagaagctcggcgagttcgggaaagctaagggctctcgggccatttggtatatgtggctgggagctcgctaccttgaatttgaggccctgggcttcctcaacgaagatcactggtttagcagagagaattcctactctggggtggaaggagagggcctgcataaactggggtatatcctccgggacattagcaagatccctggaggcgcgatgtacgccgatgacacagctgggtgggataccagaatcacagaggacgacctgcacaacgaagagaaaattacccagcagatggatcccgaacaccggcgccttgccaatgctatcttcaagctgacgtatcagaacaaggtcgtgaaagttcaaagacctacccccaagggcacagtgatggacattatctcccggaaagatcagcgcggaagcggccaggtcgggacctacggactcaatacattcaccaacatggaggcccagctgattagacaaatggaaggcgagggggtgctttctaaggcggacctggagaatccgcatctcctggaaaaaaaggtgacacagtggctggagaccaagggagttgaacggctcaaacgcatggccatctccggcgatgactgcgtggtcaagcctatcgatgacagatttgctaacgccctgcttgctctgaacgatatggggaaagtgcggaaggacattccccagtggcagcccagcaaaggctggcacgattggcaacaggttcctttctgttctcatcactttcacgagctcatcatgaaggacggacgcaagctggtggtcccgtgcagaccccaggatgaacttattggccgggcccgcatctcccagggggctggatggagcctgagagagacggcctgtctcggcaaagcgtatgcccaaatgtgggctctgatgtacttccatcggcgcgacctgagactcgcctctaatgccatttgctccgctgtgcctgtccactgggtgcccacaagccggaccacctggtccatccatgcccaccatcagtggatgacaaccgaggacatgctgacagtttggaacagagtgtggattgaagataatccttggatggaggacaagacgcccgtcaccacatgggaagatgtgccttatcttgggaaacgcgaggaccagtggtgtggaagcctgatcggcctcgcgtctcgggctacctgggcccaaaacatcctgacagccattcagcaggttagaagccttatcgggaatgaggaatttctggattacatgccctccatgaagcgcttccggaaagaggaagagtctgaaggcgctatttggtga

SEQ ID NO: 20867 - RNA, 9873 nt, synthetic construct
  misc_feature 1..9873: note = derived and/or modified CDS sequence (opt5) from DENV-3__JN697379__SS-prME
  source 1..9873: mol_type = other RNA
acaagcctgtgcctcatgatgatgctgcccgccacacttgctttccacctgacgtccagagacggcgagcctcggatgatcgtggggaagaacgaacgcggaaagtctctcctgtttaagacagccagcggcattaatatgtgtacacttatcgcgatggatctgggggagatgtgcgacgataccgtgacatacaagtgtccccatattaccgaagttgagcccgaagacatcgattgctggtgtaacctcacatccacctgggtgacgtatggaacctgcaatcaggctggcgagcacagacgggacaagcgctctgtggccctggcccctcatgtcgggatgggactggatacaagaacccagacatggatgagcgctgagggcgcctggcggcaagtggaaaaagttgagacctgggctctccgccaccccggcttcacgattctggccctttttctggcgcattacatcgggacatccctcacccagaaggtggtcatcttcattctgcttatgctggtgacaccttctatgaccatgagatgtgttggagtgggcaaccgggactttgtcgaagggctcagcggagccacctgggtggatgtggtcctggagcacggcgggtgcgttacaacgatggctaagaataaacccaccctggacatcgagctccagaagacagaagccacccaactggctacacttcgcaaactgtgtattgagggaaagatcaccaacattacgacagattccagatgccctacccagggcgaagccatcctcccggaggaacaggaccagaattatgtgtgtaaacacacctacgtggatcggggctgggggaacggatgcggcctgttcgggaagggaagccttgtcacatgcgcgaagtttcaatgtctggagtctattgagggcaaagtggttcagcatgaaaatctcaagtataccgtgatcatcacagtccacacgggggaccagcatcaggtgggaaacgagacccaaggcgttacagccgaaattacctcccaggctagcacagccgaggtgatcctgcccgaatacggcaccctggggctcgagtgctctcctcgcacgggactggacttcaatgagatgattcttctgaccatgaaaaacaaggcttggatggtccacagacagtggtttttcgatctccccctgccttggacatccggcgccaccacagaaacccccacgtggaatcggaaagagcttctggtgacatttaagaacgcccacgctaaaaagcaagaagtcgtggttctcgggagccaggagggagcgatgcataccgccctgacaggcgctaccgaaatccagacctctgggggcacatccattttcgccggacacctgaagtgtcgcctcaaaatggacaagctgaaacttaagggcatgagctatgccatgtgcctgaatacgtttgtgctcaaaaaggaggtctccgagacccagcatgggacaatcctgatcaaggtggaatacaaaggagaggatgctccgtgtaagattcctttctctaccgaagacggccaagggaaagcccacaacggaagactgatcacagcgaaccccgttgtgaccaagaaagaggagcctgtcaatattgaagctgagccgcccttcggcgaaagcaacatcgtgattgggatcggcgataaggcccttaagatcaattggtaccggaaaggatccagcattggcaagatgtttgaggccacggctagaggggcccgccggatggctatcctcggagacacagcctgggatttcggctctgtcggcggggttctgaactccctggggaaaatggtccatcagatttttgggagcgcgtataccgccctcttctctggcgtgagctggatcatgaagattggaatcggcgtgctgcttacctggattgggctcaattccaaaaacacatctatgagcttttcctgcatcgctatcggaattatcaccctctacctgggcgtcgtggttcaggccgacatggggtgtgtgattaattggaagggaaaggaactgaaatgcggcagcgggatcttcgtcacaaacgaggtgcacacgtggaccgagcagtataagtttcaagctgattctcctaaaagacttgccacagcgattgccggcgcttgggaaaatggagtttgtggcatccgctccaccacacggatggagaacctcctgtggaagcagatcgccaatgaactgaactacattctctgggagaataacatcaaactgaccgtggtcgtgggggacattacgggagttcttgaacagggcaagagaaccctgacaccgcagcccatggagctcaaatatagctggaagacctgggggaaggctaaaatcgtgacagccgagacccaaaattcttccttcattatcgatggacctagcacacccgaatgcccttccgcctctcgcgcttggaacgtctgggaggtggaagactacggctttggcgtgttcaccacgaacatctggctgaagctgcgggaggtctatacacagctttgtgaccacagactcatgagcgcggccgttaaagatgaacgcgctgtgcatgccgacatggggtactggattgagtcccagaagaatggatcttggaaactggagaaggccagcctgatcgaagtgaagacctgcacctggcccaaatcccacacactctggagcaacggcgtcctggagtctgatatgattatcccgaagtcccttgctgggcctattagccagcataatcaccggcccggataccacacccaaacggccggcccttggcatctggggaaactcgaactggactttaactattgcgagggaacaaccgtggttatctctgagaattgtggcacaagaggcccctccctgcgcaccacaaccgtgagcgggaaacttatccacgaatggtgctgtcggtcttgcacgctccctcccctgagatacatgggagaggatggctgttggtatgggatggaaattcggccgatcaacgagaaagaagagaatatggtcaagagcctggcgtccgctggaagcggcaaggtggacaacttcaccatgggggttctctgcctggccattctttttgaggaagtgatgcgcggaaaattcggcaagaaacatatgatcgccggcgtcctgttcacatttgtgctcctgctgtctgggcagattacctggagagatatggctcacacacttatcatgattggatccaatgttagcgaccggatgggcatgggggtgacctacctggccctcatcgcgacgttcaagatccagccttttctggctctcggattctttctgagaaaacttacatcccgcgagaacctgctcctgggcgtcgggctggccatggccgctacccttcggctgcccgaagatattgagcaaatggccaatggaatcgctctcggcctgatggccctcaagctgattacacagttcgaaacctatcagctttggaccgcgctggtgtctctcacatgtagcaacacgatctttaccctgacagtggcctggagaaccgctacactgattcttgccggcatctccctgctccccgtctgccagtctagctccatgcgcaagaccgactggctgcctatgacggttgctgccatgggggtgccgcccctccctctgttcatcttttctcttaaagatacactgaagagacggagctggcccctgaatgagggagtgatggccgtcggcctcgtgtccattctggctagctctcttctgcgcaacgacgttcctatggcggggcccctcgtggccggaggcctgctcatcgcttgttacgtcattaccgggacctccgccgatctgacagtggagaaagccgctgacgttacctgggaagaggaagccgagcaaacaggagtgagccataatcttatgatcacggtcgacgatgacggcaccatgagaattaaggatgacgaaacagagaacatcctgaccgtgctgctcaaaacagcgctgcttatcgtctctggcattttcccttattccatccccgctaccctgctcgtgtggcacacgtggcagaagcagacccagcggagcggggttctgtgggatgtgccgtctcctcccgagacacaaaaagccgaactcgaggaaggagtctaccgcattaagcagcagggcatctttgggaagacccaggtgggagttggcgtgcaaaaagagggggtcttccacacaatgtggcatgtgaccagaggagccgtgctgacacacaacggcaagcggcttgagcctaattgggcttccgttaaaaaggacctgattagctacggcgggggatggcgcctgtccgcccagtggcagaaaggcgaagaggtccaagtgatcgcggtggaacccgggaagaacccgaagaattttcagacgatgcctggaattttccagaccacaaccggcgagatcggggctatcgccctcgatttcaaacccggaaccagcggctctcctattatcaacagagaaggcaaggtcgtggggctgtatggaaatggcgttgtgaccaagaacgggggatacgtcagcggcattgcccagacgaatgctgagcccgacgggcccacccctgagcttgaagaggaaatgtttaagaaacggaacctgacaatcatggatctccatccgggctccggaaagacccgcaagtatctgcccgccattgtgagagaggctatcaaacggagactccgcacactgatccttgcccctacccgggttgtggcggccgaaatggaggaggctctgaagggcctgcccattagataccaaacgacagccaccaaatctgaacacaccgggcgcgagatcgtcgacctcatgtgccatgctacattcaccatgcggctgcttagccctgtgagagttcccaattataacctgattatcatggatgaagcccactttacagaccctgcctccattgctgcgcgcggatacatctctacccgggtgggcatgggggaggccgctgccatcttcatgacggccacaccgcccggaaccgctgatgcctttcctcagagcaatgcgcccattcaggacgaagagagagacatccctgagcgctcctggaactctggcaatgaatggattacagatttcgtcgggaagaccgtgtggtttgtgcccagcatcaaagctggcaacgacattgccaattgtctccggaagaacggaaagaaagtcatccagctgtccagaaagacgttcgataccgagtatcagaagacaaagctgaacgactgggattttgttgtgaccacagacattagcgaaatgggcgccaatttcaaagctgatcgggtgatcgacccgcgcagatgcctcaagcctgtcatccttaccgatgggcccgagcgggtgattctggccggacccatgcctgttacagtggcgtctgccgctcagcgcagaggccgggtcgggagaaacccccagaaggagaatgaccagtacatctttatgggacaacctctgaacaatgatgaagaccacgcccattggaccgaggctaaaatgctcctggacaacattaatacgccggaaggcatcattcccgcccttttcgagcctgaacgcgagaagtccgctgccatcgatggggagtaccggctgaaaggcgaaagcagaaagacattcgtggagctcatgcgccggggagacctgcccgtttggctggcgcacaaagtggcctctgaaggcatcaagtataccgatagaaaatggtgctttgacggggagcgcaacaatcagattctcgaagagaacatggatgtcgagatctggaccaaggaaggagagaagaagaaacttcggcctagatggctggacgctcgcacatactccgatcccctggccctcaaagagttcaaagactttgctgccggcagaaaaagcattgccctggatcttgtgaccgagatcgggcgggtcccgtcccatctggctcaccgcacaagaaatgcgctcgacaacctggtgatgctgcacacgtctgaacatggaggccgggcctatcgccacgctgttgaggagctccctgaaaccatggagacacttctgctgctcggcctgatgattcttctgaccgggggagccatgctgttcctgatcagcggcaaggggatcggaaagacatccattggcctgatctgtgtgattgccagctctgggatgctctggatggctgatgtgccccttcagtggatcgcctccgcgattgtcctggaatttttcatgatggttctgctcatccctgagcccgagaaacagagaacccctcaagacaatcagctggcctacgtggtgattggaatccttacgctggctgccatcgtcgctgccaacgaaatgggcctcctggagaccacaaagcgggatctgggcatgagcaaagaacccggggtggtttctccgaccagctatctcgacgtggaccttcatcctgcgtccgcctggacactgtacgctgtcgccaccacggtgattacacccatgctgagacacaccatcgaaaattctacagctaacgtcagcctcgccgctattgccaatcaggcggtggttctgatgggacttgataagggctggcccatctccaaaatggacctgggggtgcctctcctggccctgggatgctattctcaagtcaacccgctcacccttgctgccgctgtgctgctgctcgttacccattacgccattatcggccccgggctgcaggccaaggcgacacgcgaagctcagaagcggacggccgctggaatcatgaaaaaccctaccgtggatggcattatgacaatcgaccttgatcccgtcatttacgacagcaagtttgagaaacagctgggccaagtgatgctcctggtgctgtgtgccgttcagctccttctgatgagaacctcctgggccctgtgcgaggtcctcacactggctaccgggcctatcacgacactttgggaaggaagccccggcaagttctggaataccaccattgccgtgtctatggcgaacatctttcgcgggtcctatctggccggagctggcctcgccttcagcatcatgaaatccgtggggacaggaaagcggggcaccggctctcagggggagacactgggagaaaagtggaaaaagaaactgaatcagctcagcagaaaggagtttgatctttacaaaaagtccggcattacggaagtcgaccggaccgaggctaaagaggggctgaagcgcggagaaatcacacaccacgccgtttctagaggcagcgcgaagctgcaatggttcgtggagcggaacatggtgattcctgaagggcgcgtcatcgatctcggatgtggcagaggcgggtggtcctattactgcgccggactgaaaaaggtgaccgaggttcggggctatacaaaagggggaccgggccatgaagaacccgtgcctatgagcacctacgggtggaatattgtcaaacttatgtctggaaaagacgtgttttatctgccccctgagaagtgtgatacgctcctgtgcgacatcggcgaatccagcccctctccgaccgttgaggaatcccgcacaattagagtgctgaagatggtcgagccttggctcaaaaacaatcagttctgtatcaaggtgcttaacccctacatgcccaccgtgatcgagcacctggaacggctgcagcgcaaacatggcgggatgctcgtcagaaatcctctgagccggaactctacacacgagatgtactggattagcaatggaaccggcaacatcgtttcctctgtgaatatggtgagcagacttctgctcaaccgcttcacaatgacccaccggagacccacgattgaaaaggatgtcgacctgggggctggaacacgccatgtgaatgccgagcctgaaaccccgaacatggacgttatcggcgagcggattaaaagaatcaaggaggaacactccagcacctggcattatgatgacgagaacccctacaagacatgggcttatcacgggtcctacgaagtgaaagccacgggatctgctagctccatgatcaatggcgtcgtgaagctgctcaccaaaccttgggatgttgtgcccatggtcacacagatggccatgaccgacacaaccccttttggccaacagcgcgtgttcaaggagaaagttgatacacggacccccagaccgatgcctgggacgcgcaaggtgatggaaattaccgcggagtggctgtggcggacacttggaagaaacaagcgcccccggctgtgcaccagagaggaatttaccaagaaggtccgcaccaatgccgctatgggcgccgtgttcacggaggaaaaccagtgggactctgctagagccgccgtcgaggatgaagagttttggaaactcgtggaccgggagcgcgaactgcataaacttgggaaatgtggaagctgcgtttataatatgatgggcaagagagagaaaaagctgggggagttcggcaaggcgaaaggatcccgggctatctggtacatgtggctcggcgccagatatctggagtttgaggccctggggttcctcaacgaagatcactggttttctcgggagaatagctactccggagtggaaggcgaggggctgcacaaacttggatacattctgcgcgacatcagcaaaattcctggcggggctatgtatgccgatgacacagctggctgggacaccagaatcacagaagatgacctccataacgaggagaagatcacccaacagatggatcccgaacaccggcagctggccaatgcgattttcaaacttacgtaccagaacaaggtcgtgaaggtgcaacgccctacccccaaaggaacagttatggacatcatttctagaaaggatcagcggggctccggacaggtgggaacctatggcctgaatacatttaccaacatggaggcccagctcatccgccaaatggaaggggagggagtcctgagcaaagctgacctggaaaatccgcatcctctcgagaagaaaattacacagtggctggagaccaagggcgtggaaagacttaagcggatggccatctctggggatgactgcgttgtgaaacccatcgatgaccgcttcgctaacgccctgctcgcgctgaatgatatgggcaaggtcagaaaagacattccccagtggcagccttccaagggatggcacgattggcaacaggtgccgttttgtagccaccatttccacgagcttatcatgaaagacggccggaagctggtcgtgccctgccgccctcaggacgaactcattgggagagcccggatctctcagggagctggctggtccctgcgcgagacggcctgtctggggaaggcttacgcccaaatgtggacactcatgtatttccatagacgggatctgagacttgctagcaacgccatttgctccgcggttcccgtgcactgggtccctaccagccgcaccacatggtctatccatgcccaccaccagtggatgaccacagaagacatgctgacggtgtggaaccgggtttggattgaggataatccctggatggaggacaaaacccctgtgacaacctgggaagatgtcccctacctcggaaagagagaggaccagtggtgtggcagcctgatcgggcttacatcccgcgctacctgggcccaaaacatcctgacggccattcaacaggtgcggtctctcatcggcaatgaagagtttctggattatatgccgagcatgaaaagattccgcaaggaggaagagtccgaaggagctatttggtga

SEQ ID NO: 20868 - RNA, 9873 nt, synthetic construct
  misc_feature 1..9873: note = derived and/or modified CDS sequence (opt5) from DENV-3__JQ045687__SS-prME
  source 1..9873: mol_type = other RNA
accagcctgtgcctcatgatgatgctgcccgccacacttgctttccacctgacgtccagagacggagaacctcggatgatcgtggggaagaacgaacgcggaaaatctctcctgtttaagaccgccagcggcattaatatgtgtacccttatcgcgatggatctgggggaaatgtgcgacgataccgtgacatacaaatgtccgctcgttgctgaagtggagcccgaagacattgattgctggtgtaacctgacctccacatgggtgacctatggaacgtgcaatcaggccggcgagcatagacgggacaagcgctctgtggccctggctcctcacgtggggatgggactcgataccagaacacagacctggatgagcgccgagggcgcttggcggcaggttgaaaaagtggagacatgggccctgcgccatcccggcttcaccatccttgcgctgtttctcgcccactacattgggacgtccctgacacagaaggtcgtgatcttcatccttctgatgctcgttaccccttctatgacaatgagatgtgtgggagtcggcaaccgggactttgtggaagggctgagcggagctacctgggtggatgtcgttctggagcatggcgggtgcgtgaccacaatggccaagaataaacccacgctcgacattgagctgcagaagaccgaagctacacagcttgccaccctgcgcaaactctgtatcgagggaaagattacaaacatcaccacggattccagatgccctacacagggcgaagcgattctgccggaggaacaggaccagaattatgtgtgtaaacacacctacgtcgatcggggctgggggaacggatgcggccttttcgggaagggaagcctggtgacctgcgccaagtttcaatgtctcgagcccatcgagggcaaagttgtgcagtatgaaaatctgaagtacacagtcattatcaccgtgcacacaggggaccagcatcaggttggaaacgacacgcaaggcgtgaccgtcgagatcacacctcaggcttctaccgtggaagccgtcctgcccgagtatggcacactcgggctggaatgctcccctcgcaccggacttgatttcaatgagatgattctgctcacgatgaaaaacaaggcttggatggtgcacagacagtggtttttcgacctgccccttccgtggaccagcggcgccacaaccgagacacctacctggaataaaaaggaactgctcgttacgtttaaaaacgcccatgctaagaagcaagaggtggtcgtgctggggtctcaggaaggagcgatgcacacagccctgaccggcgctacagagatccaaaattccgggggcaccagcattttcgccggacacctcaaatgtcggctgaagatggataaacttgaactgaagggcatgtcttacgccatgtgcctcaacacctttgttctgaaaaaggaggtgtccgagacacagcatgggacgatcctgattaaggtcgaatacaaaggagaggacgctccctgtaagatccctttcagcaccgaagatggccaagggaaagcccacaacggacgccttatcacagcgaatcccgtggtgaccaagaaagaggagcccgttaacattgaagctgagcctccgttcggcgaatccaatatcgtcattgggatcggcgacaaggccctcaagattaactggtataaaaagggatctagcatcggcaaaatgtttgaggccacagctagaggggcccggagaatggctatcctgggagataccgcctgggacttcggctccgtcggcggggtgctgaatagcctcgggaagatggtccatcagatttttgggtctgcgtacacggccctgttctccggcgtgagctggatcatgaaaattggaatcggcgttcttctgacatggattgggctcaactctaagaataccagcatgtccttttcttgcatcgtgattggaatcatcaccctgtatctgggcgctgtcgtgcaggccgatatggggtgtgctattaactggaagggaaaagaacttaagtgcggcagcgggatcttcgttacaaatgaggtgcacacctggacagagcagtacaaatttcaagccgactcccccaagcgcctcgcgacggccattgctggcgcctgggaaaacggagtctgtggcatccggagcaccacaagaatggagaatctgctgtggaaacagattgctaacgaactcaattatatcctgtgggagaacaatatcaaacttaccgtggttgtgggggatattatcggagtcctggaacagggcaaacgcacactcacccctcagcccatggagctgaagtactcttggaagacgtgggggaaagccaagattgtgaccgccgagacacaaaactccagcttcatcattgacggacctaacacccccgaatgcccgtctgcttcccgggcgtggaatgtgtgggaggtcgaagactatggctttggcgttttcacaaccaacatctggctgaaacttagagaggtgtacacacagagctgtgatcatcgcctcatgtccgccgctatcaaggacgaacgggccgtgcacgccgatatggggtactggattgagtctcagaaaaatggaagctggaagctggagaaggcttcctttatcgaagtcaaaacctgcacgtggcctaagtctcacacactgtggagcaacggcgtgctcgagtccgacatgattatccccaaaagcctggccgggcctatttctcagcataatcacagacccggatatcatacccaaaccgcgggcccttggcaccttgggaagctggaactcgatttcaactactgcgagggaacaaccgttgtgatcacggagaattgtggcacacgcggcccctccctgcggaccacaaccgtcagcgggaaactgatccacgaatggtgctgtagatcttgcacacttccgcctctccgctatatgggagaggacggctgttggtacgggatggaaattcggcccatcaacgagaaggaagagaatatggtgaagtccctggttagcgctggatctggcaaagtggataactttaccatgggggtcctgtgcctcgccattctgttcgaggaagtgatgagaggaaagttcggcaaaaagcatatgatcgccggcgttctttttacgttcgtgctgctcctgagcgggcagattacctggcgggacatggctcacacactgatcatgattggatccaatgccagcgatcgcatgggcatgggggtcacctatcttgcgctgatcgctacatttaaaatccagcccttcctcgccctgggatttttcctcagaaagctgacctctcgggagaaccttctgctcggcgtggggctggccatggctacgacactgcaacttcctgaagacattgagcagatggccaatggaatcgctctgggcctcatgaccctgaagctcattacacagtttgaaacctaccagctgtggaccgcccttgtgtccctgacatgtagcaacacgatcttcaccctcacagtcgcgtggagaaccgccacactgattctggctggcgtttcccttctgccgctctgccaatctagctccatgcgcaaaaccgattggctgcccatgacggtggccgctatgggggtgcctcccctccctctgtttatcttctctcttaaggacacacccaaacggagaagctggcctctgaatgagggagtcatggccgtgggcctggtttccatcctcgcctctagcctgcttcgcaacgatgtgcccatggctgggccgctggtcgcgggaggcctcctgattgcctgttatgtgatcaccgggacctccgctgacctcacagttgagaaggccgccgacgtgacctgggaagaggaagctgagcagacaggagtcagccataacctgatgattacggtggatgacgatggcaccatgagaatcaaagacgatgaaacagagaatattcttaccgtcctgctgaagacagccctcctgatcgtgtctggcatctttccttactccattcccgcgacccttctggtttggcacacgtggcagaaacagacccaacggagcggggtgctctgggacgtcccttctcccccggagacacagaaggctgaactggaggaaggagtgtaccgcatcaagcagcagggcattttcgggaaaacccaagttggagtgggcgtccagaaggagggggtgtttcatacaatgtggcacgtgaccagaggagccgttctcacacacaacggcaaacggctggagcctaattgggcctccgtcaagaaagatcttatcagctatggcgggggatggcgcctgtctgctcagtggcaaaagggcgaagaggtccaggtgattgccgtcgaacccgggaagaaccctaaaaatttccagacgatgcccggaatcttccagaccacaaccggcgagattggggcgatcgctctggactttaagcccggaacctccggcagccctatcattaacagagaaggcaaagtggttgggctctacggaaatggcgtggtcacaaagaacgggggatatgtgtccggcatcgcccaaacgaatgccgagccggatgggcccacccctgagctggaagaggaaatgttcaaaaagcggaaccttacaaccatggacctgcatcccggcagcggaaagacacgcaaatacctccctgctattgttagagaggccatcaagcggcgcctgagaaccctcattctggctcccacgcgggtggtcgccgcggaaatggaggaggcccttaaaggcctgcctatcagatatcagacaaccgctaccaagtctgaacacacagggcgcgagatcgtggatctgatgtgccatgccacctttacaatgcggctcctgagcccggttagagtgcccaattacaaccttattatcatggacgaagctcacttcaccgatcctgcctccattgccgctcgcggatatatctctacgcgggtcggcatgggggaggcggccgctatttttatgacagccacaccccctggaacagccgaggctttcccccagagcaatgccccgatccaggacgaggagagagacatccctgaacgctcctggaactctggcaatgagtggattaccgattttgtggggaaaacggtgtggttcgtccccagcatcaaggcgggcaacgacattgctaactgtctgcggaagaatggcaagaaggttatccaactctccagaaaaacctttgatacagaataccagaagacccgcctgaacgactgggatttcgtggtgacaaccgacatttctgagatgggcgccaattttaaagccgatcgggtcatcgaccccagacggtgcctgaagcctgtgattctcacagatgggcccgagcgcgttatccttgctggacctatgccggtgaccgccgcgagcgccgctcagagacggggccgcgtcgggagaaacccccagaaggaaaatgaccaatacatcttcacgggacagcctctgaacaatgatgaggaccatgcccactggacagaagctaaaatgctgctcgacaacattaatacccccgagggcatcattcctgccctgttcgaacccgagcgggagaagtccgctgccatcgatggggaatatagacttaaaggcgagagccgcaagacctttgtggaactgatgcggagaggagacctcccggtttggctggcgcacaaagtggcctctgagggcattaagtacacagatcgcaaatggtgcttcgacggggaacggaacaatcagatcctggaggagaacatggatgtcgaaatctggaccaaggagggagaaagaaagaaactccgccctcggtggcttgacgctagaacatattccgatcccctggccctgaaggagtttaaagacttcgctgccggccgcaagagcattgccctcgatctggtgacggaaatcgggagagtcccttctcatcttgcttaccggacccgcaatgcgctggacaacctcgtgatgctgcacacatccgagcatggaggcagagcctatcggcacgctgttgaggaactgcccgagaccatggaaacactccttctgctgggcctcatgattctgcttaccgggggagccatgctgtttctcatcagcggcaaagggattggaaagacgtccatcggcctgatctgtgtgattgtgtctagcgggatgctgtggatggccgatgtccctctccagtggatcgcttccgccattgttcttgagttctttatgatggtgctgctgatccccgagccggaaaagcaacgcacccctcaggacaatcagctcgcgtacgtggtcattggaatcctgacacttgccgctattgtggccgctaacgagatgggcctgctcgaaaccacaaaaagagatctgggcatgagcaaggagcccggggttgtgtctcccacctcctatctggacgtcgacctccaccctgccagcgcgtggacgctttacgccgtggctacaaccgtcatcacaccgatgctgcggcataccatcgaaaattctaccgccaacgtgagcctggctgccattgctaaccaagccgttgtgctcatgggactggataaaggctggcccatctccaagatggaccttggggtccctctgctcgcgctgggatgctactctcaggtgaatcccctgacactcacggccgctgttcttctgctggtgacccactatgccattatcggccctgggctccaggctaaagccacaagagaggcccagaagcgcaccgcggctggaattatgaagaaccccacagtcgatggcatcatgaccatcgacctggatcctgtgatttacgacagcaaattcgagaagcaacttggccaggtgatgctgctcgttctgtgtgccgtccagctgctccttatgcggacgtcctgggctctgtgcgaagccctgacactcgccaccgggccgatcaccacactgtgggagggatctcccggcaaattttggaataccacaattgctgtgagcatggccaacatcttcagagggtcctatcttgcgggagccggcctggcttttagcattatgaagtctgtggggacgggacgccggggcaccggctcccagggggaaacactcggagagaaatggaagaagaaactgaatcaactgagcagaaaggagttcgatctctacaaaaagtccggcatcaccgaggtcgaccggacagaggccaaagaagggcttaagcgcggagagaccacgcatcacgctgtttctagaggcagcgccaaactgcagtggtttgtggaacggaacatggtgatccctgaggggcgcgtcattgatctgggatgtggcagaggcgggtggtcctattactgcgcgggactcaagaaggtgaccgaagttcggggctatacaaaagggggacccggccatgaggagcctgtgcccatgtctacctacgggtggaatatcgtcaagctgatgagcggaaaagacgtgttctaccttccgcctgaaaagtgtgatacactgctctgcgacattggcgagtccagcccctctcccaccgttgaagagtcccgcacaatcagagtgctgaaaatggtcgagccttggctgaagaacaatcagttctgtattaaggtgctcaacccctatatgcctaccgtgatcgaacaccttgagcggctgcagcgcaaatacggcgggatgctggtcagaaatccgctcagccggaactctacgcacgaaatgtattggatttccaatggaacaggcaacatcgttagctctgtgaatatggtgagcagactgcttctgaaccgctttaccatgacccatcggagacccacaatcgagaaggatgtcgacctcggggccggaacgcgccacgtgaacgctgaacctgagacccccaatatggacgttattggcgagcggatcaaaagaattaaggaagaacactcctctacatggcactacgatgacgaaaacccttataaaacctgggcctaccacgggagctatgaggtgaaggctacaggatccgccagctccatgatcaatggcgtcgtgaagctgctgaccaaaccctgggatgttgtgccgatggtcacacaaatggctatgaccgacacgacccctttcggccagcagcgcgtgtttaaggaaaaagttgatacacggacccccagacctatgcccgggacacgcaaggtgatggagattaccgccgagtggctctggcggacgctgggaagaaacaaaaagcctcgcctttgcacacgggaagagttcaccaagaaagtcagaacaaatgcggccatgggcgctgtgtttaccgaagagaaccaatgggactctgcccgcgctgccgtcgaagatgaggagttctggaagctggtggacagagaacgggagctccataaactggggaagtgtggaagctgcgtttacaatatgatgggcaaacgcgaaaagaaacttggggagtttggcaaggccaagggatccagagcgatctggtacatgtggctgggcgctcggtatctcgagttcgaagccctggggtttctgaacgaggatcactggttctctagagaaaatagctactccggagtggagggcgaagggctccataaactgggatatatccttcgggacatttctaagatccccggcggggccatgtacgctgatgacacggccggctgggacacccgcattacagaggatgacctgcacaacgaggagaaaatcacccagcagatggatccggagcatagacagctcgctaatgccatttttaagctgacatatcaaaacaaagtcgtgaaggtgcagcggcctacccccaagggaacagttatggacatcatcagccgcaaagatcagagaggctccggacaggtgggaacctacggccttaatacgttcacaaacatggaagcgcaactggtccggcagatggagggggaaggagtgctcagcaaggccgacctggagaatccccatctgctcgagaaaaagattacccagtggctggaaaccaaaggcgttgagcgccttaagagaatggctatctctggggatgactgcgtggtcaagcctattgatgaccggtttgccaacgctctgctcgccctgaacgatatgggcaaagtgcgcaaggacatcccgcagtggcaaccctccaaaggatggcacgattggcagcaggtccctttctgtagccatcacttccatgaacttattatgaaggacggcagaaaactggtggttccctgccggcctcaggacgagctcatcgggcgcgcgagaatctctcaaggagccggctggtccctgaaggaaacagcttgtctggggaaggcctatgctcagatgtggagcctcatgtactttcaccggcgcgatctgagacttgcctctaatgctatttgctccgccgtgcccgtccactggatccctaccagccggacaacgtggtccattcatgcgcaccatcagtggatgaccacagaggacatgctgaccgtgtggaacagagtttggatcgaggataatccctggatggaagacaaaacaccggtgaccacgtgggaggatgtcccttacctcggaaagcgcgaagaccaatggtgtggcagcctgattgggcttacctctcgggccacatgggctcagaacatcctgaccgccattcaacaggtgagaagcctcatcggcgatgaggagttcctggactatatgccctccatgaaacgctttcggaaggaagaggaatctgagggagccatctggtga

SEQ ID NO: 20869 - RNA, 9873 nt, synthetic construct
  misc_feature 1..9873: note = derived and/or modified CDS sequence (opt5) from DENV-3__JQ045689__SS-prME
  source 1..9873: mol_type = other RNA
accagcctgtgcctcatgatgatgctgcccgccacacttgctttccacctgacgtcccgggacggcgaacctcggatgatcgtggggaagaacgaacgcggaaagtctctcctgtttaagaccgccagcggcattaatatgtgtacacttatcgcgatggatctgggggagatgtgcgacgataccgtcacatacaagtgtccgctcattgctgaagttgagcccgaagacatcgattgctggtgtaacctgacctccacatgggtgacctatggaacgtgcaatcaggccggcgagcacagacgggacaagcgctctgtggccctggctcctcacgtcgggatgggactcgataccagaacacagacctggatgagcgccgagggcgcttggcggcagttcgaaaaagtggagacatgggccctgcgccatcccggctttaccattcttgcgctgttcctcgcccactacatcgggacgtccctgacacagaaggttgtgatctttattcttctgatgctcgtcaccccttctatgacaatgagatgtgtgggagttggcaaccgggacttcgtggaagggctgagcggagctacctgggtcgatgtggtgctggagcatggcgggtgcgtcaccacaatggccaagaataaacccacgctcgacatcgagctgcagaagaccgaagctacacaacttgccaccctgcgcaaactctgtattgagggaaagatcacaaacattaccacggattccagatgccctacacagggcgaagcgatcctgccggaggaacaggaccagaattatgtttgtaaacacacctacgtggatcggggctgggggaacggatgcggcctttttgggaagggaagcctggtgacctgcgccaagttccaatgtctcgagcccattgagggcaaagtcgtgcagtatgaaaatctgaagtacacagttatcatcaccgtgcacacaggggaccagcatcaggtcggaaacgacacgcaaggcgtgaccgttgagattacacctcaggcttctaccgtggaagccgtcctgcccgagtatggcacactcgggctggaatgctcccctcgcaccggacttgattttaatgagatgatcctgctcacgatgaaaaacaaggcttggatggtgcacagacagtggttctttgacctgccccttccgtggaccagcggcgccacaaccgagacacctacctggaatcggaaagaactgctcgtcacgttcaagaacgcccatgctaaaaagcaagaggtggttgtgctggggtctcaggaaggagcgatgcacacagccctgaccggcgctacagagattcaaaattccgggggcaccagcatctttgccggacacctcaagtgtcgcctgaaaatggataaacttgaactgaaaggcatgtcttacgccatgtgcctcaacaccttcgtcctgaagaaagaggtgtccgagacacagcatgggacgattctgatcaaggttgaatacaagggagaggacgctccctgtaaaatccctttcagcaccgaagatggccaagggaaggcccacaacggaagacttattacagcgaatcccgtggtcaccaaaaaggaggagcccgtgaacatcgaagctgagcctccgtttggcgaatccaatattgtgatcgggattggcgacaaagccctcaagatcaactggtataagaaaggatctagcatcggcaagatgttcgaggccacagctagaggggccagacgcatggctattctgggagataccgcctgggactttggctccgttgggggagtcctgaatagcctcggcaaaatggtgcatcagatcttcgggtctgcgtacacggccctgttttccggcgtgagctggattatgaagatcggaattggcgtccttctgacatggatcgggctcaactctaaaaataccagcatgtccttctcttgcattgtgatcggaatcattaccctgtatctgggcgctgttgtgcaggccgatatggggtgtgctatcaactggaagggaaaggaacttaaatgcggcagcgggatttttgtcacaaatgaggtgcacacctggacagagcagtacaagttccaagccgactcccccaaacggctcgcgacggccatcgctggcgcctgggaaaacggagtttgtggcattagaagcaccacacgcatggagaatctgctgtggaagcagatcgctaacgaactcaattatatcctgtgggagaacaatattaaacttaccgtggtcgtgggggatatcattggagttctggaacagggcaagcggacactcacccctcagcccatggagctgaaatactcttggaagacgtgggggaaggccaaaatcgtgaccgccgagacacaaaactccagctttattatcgacggacctaacacccccgaatgcccgtctgcttccagagcgtggaatgtctgggaggtggaagactatggcttcggcgtgtttacaaccaacatctggctgaaacttcgcgaggtctacacacagagctgtgatcatcggctcatgtccgccgctattaaagacgaaagagccgttcacgccgatatggggtactggatcgagtctcagaagaatggaagctggaaactggagaaggcttccttcattgaagtgaagacctgcacgtggcctaaatctcacacactgtggagcaacggcgtgctcgagtccgacatgatcattcccaagagcctggccgggcctatctctcagcataatcaccgccccggatatcatacccaaaccgcgggcccttggcaccttgggaaactggaactcgattttaactactgcgagggaacaaccgtcgtgatcacggagaattgtggcacacggggcccctccctgagaaccacaaccgttagcgggaagctgattcacgaatggtgctgtcgctcttgcacacttccgcctctccggtatatgggagaggacggctgttggtacgggatggaaatcagacccattaacgagaaagaagagaatatggtgaagtccctggtcagcgctggatctggcaaggtggataacttcaccatgggggttctgtgcctcgccatcctgttcgaggaagtgatgcggggaaaatttggcaagaaacatatgattgccggcgtccttttcacgtttgtgctgctcctgagcgggcagatcacctggcgcgacatggctcacacactgattatgatcggatccaatgccagcgatagaatgggcatgggggttacctatcttgcgctgatcgctacattcaagattcagccctttctcgccctgggattctttctccggaaactgacctctagagagaaccttctgctcggcgtggggctggccatggctacgacactgcaacttcctgaagacatcgagcagatggccaatggaattgctctgggcctcatgaccctgaagctcatcacacagttcgaaacctaccagctgtggaccgcccttgtctccctgacatgtagcaacacgatttttaccctcacagtggcgtggcgcaccgccacactgatcctggctggcgtgtcccttctgccgctctgccaatctagctccatgcggaagaccgattggctgcccatgacggtcgccgctatgggggttcctcccctccctctgttcatcttttctcttaaagacacacccaagagacgcagctggcctctgaatgagggagtgatggccgtgggcctggtctccattctcgcctctagcctgcttagaaacgatgtgcccatggctgggccgctggttgcgggaggcctcctgatcgcctgttatgtgattaccgggacctccgctgacctcacagtcgagaaagccgccgacgtgacctgggaagaggaagctgagcagacaggagttagccataacctgatgatcacggtggatgacgatggcaccatgcggattaaggacgatgaaacagagaatatccttaccgtcctgctgaaaacagccctcctgatcgtgtctggcattttcccttactccatccccgcgacccttctggtctggcacacgtggcagaagcagacccaacgcagcggggtgctctgggacgttccttctcccccggagacacagaaagctgaactggaggaaggagtgtacagaattaagcagcagggcatctttgggaagacccaagtcggagtgggcgttcagaaagagggggtgttccatacaatgtggcacgtcacccggggagccgtgctcacacacaacggcaagcgcctggagcctaattgggcctccgtgaaaaaggatcttattagctatggcgggggatggagactgtctgctcagtggcaaaaaggcgaagaggttcaggtcatcgccgtggaacccgggaagaaccctaagaatttccagacgatgcccggaatttttcagaccacaaccggcgagatcggggcgatcgctctggacttcaaacccggaacctccggcagccctattatcaaccgggaaggcaaggtggtcgggctctacggaaatggcgtggttaccaagaacgggggatatgtgtccggcattgcccaaacgaatgccgagccggatgggcccacccctgagctggaagaggaaatgtttaagaaacgcaaccttacaatcatggacctgcatcccggcagcggaaagaccagaaagtacctccctgctattgtccgggaggccatcaaacgcagactgcggacactcatcctggctcccaccagagtggttgccgcggaaatggaggaggcccttaagggcctgcctattcgctatcagacgacagctaccaaatctgaacacaccgggcgggagatcgtggatctgatgtgccatgccacattcaccatgagactcctgagcccggtccgcgtgcccaattacaaccttattatcatggacgaagctcactttacagatcctgcctccattgccgctcggggatatatctctaccagagttggcatgggggaggcggccgctatcttcatgacggccacaccccctggaaccgccgaggcttttccccagagcaatgccccgattcaggacgaggagcgcgacatccctgaacggtcctggaactctggcaatgagtggattacagatttcgtggggaagaccgtctggtttgtgcccagcatcaaagcgggcaacgacattgctaactgtctgagaaagaatggaaagaaagtgatccaactctcccgcaagacgttcgataccgaataccagaaaacacggctgaacgactgggattttgtcgttaccacagacatttctgagatgggcgccaatttcaaggccgatagagtgatcgacccccggcgctgcctgaaacctgtgatcctcaccgatgggcccgagagagtcattcttgctggacctatgccggtgacagccgcgagcgccgctcagcggcgcggcagagttgggcggaacccccagaaggaaaatgaccaatacatcttcaccggacagcctctgaacaatgatgaggaccatgcccactggacggaagctaagatgctgctcgacaacattaatacacccgagggcatcattcctgccctgtttgaacccgagagagagaaatccgctgccatcgatggggaatatcgccttaagggcgagagccggaaaaccttcgtggaactgatgagacgcggagacctcccggtctggctggcgcacaaggtggcctctgagggcatcaaatacaccgatcggaagtggtgctttgacggggaaagaaacaatcagattctggaggagaacatggatgttgaaatctggacaaaagagggagaacgcaagaagctccggcctagatggcttgacgctcgcacctattccgatcccctggccctgaaagagttcaaggactttgctgccggcagaaaaagcattgccctcgatctggtgacagaaatcgggcgggtcccttctcatcttgctcaccgcacgagaaatgcgctggacaacctcgtgatgctgcatacctccgagcacggaggccgggcctaccgccacgctgtcgaggaactgcccgagacaatggaaaccctccttctgctgggcctcatgattctgcttacagggggagccatgctgttcctcatcagcggcaaggggatcggaaaaacctccattggcctgatctgtgtgattgtttctagcgggatgctgtggatggccgatgtgcctctccagtggatcgcttccgccattgtgcttgagtttttcatgatggtcctgctgatccccgagccggaaaagcaaagaacgcctcaggacaatcagctcgcgtatgttgtgattggaatcctgacccttgccgctatcgtggccgctaacgagatgggcctgctcgaaacaaccaagcgggatctgggcatgagcaaagagcccggggtcgtgtctcccacatcctacctggacgttgacctccatcctgccagcgcgtggaccctttatgccgtggctacgacagtcattaccccgatgctgagacacacaatcgaaaattctaccgccaacgtgagcctggctgccattgctaaccaagccgtcgtgctcatgggactggataagggctggcccatctccaaaatggaccttggggttcctctgctcgcgctgggatgctactctcaggtgaatcccctgaccctcacagccgctgtccttctgctggtgacgcattacgccattatcggccctgggctccaggctaaggccacccgcgaggcccagaaacggacagcggctggaatcatgaagaaccccaccgttgatggcattatgacaatcgacctggatcctgtgatttatgacagcaagtttgagaaacaacttggccaggtcatgctgctcgtgctgtgtgccgtgcagctgctccttatgagaacctcctgggctctgtgcgaagccctgacgctcgccacagggccgatcaccaccctgtgggagggatctcccggcaagttctggaatacaaccattgctgttagcatggccaacatctttcgcgggtcctaccttgcgggagccggcctggctttcagcatcatgaaatctgtcgggacaggacggagaggcacgggctcccagggggaaaccctcggagagaagtggaaaaagaagctgaatcaactgagccggaaagaatttgatctctataagaaatccggcattacagaggtggaccgcaccgaggccaaggaagggcttaaaagaggagagacaacccaccatgctgtgtctcggggcagcgccaagctgcagtggttcgtcgaacgcaacatggttacgcctgaggggagagtgatcgatctgggatgtggccggggcgggtggtcctactattgcgcgggactcaaaaaggtgaccgaagtccgcggctacacaaaaggcgggcccgggcacgaggagcctgtgcccatgtctacctatgggtggaatattgttaaactgatgagcggaaaggacgtgttctaccttccgcctgaaaaatgtgatacactgctctgcgacatcggcgagtccagcccctctcccaccgtcgaagagtccagaacaattcgggtgctgaagatggttgagccttggctgaaaaacaatcagttttgtatcaaggtgctcaacccctacatgcctaccgtcattgaacaccttgagcgcctgcagagaaagtatggcgggatgctggtgcggaatccgctcagcagaaactctacgcatgaaatgtactggatctccaatggaacaggcaacatcgtgagctctgtcaatatggttagccgcctgcttctgaaccggttcaccatgacccacagacgccccacaattgagaaagatgtggacctcggggccggaacgcggcatgtgaacgctgaacctgagacccccaatatggacgtcatcggcgagagaattaagcgcatcaaagaagaacactcctctacatggcactatgatgacgaaaacccttacaagacctgggcctatcatgggagctacgaggtgaaagctacaggatccgccagctccatgattaatggcgttgtgaagctgctgaccaagccctgggatgtcgtgccgatggttacacaaatggctatgaccgacacgaccccttttggccagcagcgggtgttcaaagaaaaggtcgatacaagaacaccccgccctatgcccgggacacggaaagtgatggagatcaccgccgagtggctctggagaacgctgggacgcaacaagaaacctcggctttgcacaagagaagagtttaccaagaaggttcgcacaaatgcggccatgggcgctgtgttcaccgaagagaaccaatgggactctgccagagctgccgtcgaagatgaggagttttggaaactggtggaccgggaacgcgagctccacaagctggggaaatgtggaagctgcgtctataatatgatgggcaagagagagaagaaacttggggagttcggcaaagccaagggatcccgggcgatctggtacatgtggctgggcgctagatacctcgagtttgaagccctggggttcctgaacgaggatcattggttttctcgggaaaatagctattccggagtggagggcgaagggctccacaagctgggatacattcttcgcgacatctctaaaattcccggcggggccatgtatgctgatgacacggccggctgggacaccagaatcacagaggatgacctgcataacgaggaaaagattacccagcagatggatccggagcaccggcagctcgctaatgccatcttcaaactgacataccaaaacaaggttgtgaaagtccagcgccctacccccaagggaacagtgatggacatcattagcagaaaggatcagcggggctccggacaggtgggaacctatggccttaatacgtttacaaacatggaagcgcaactggttcgccagatggagggggaaggagtgctcagcaaagccgacctggagaatccccatctgctcgagaagaaaatcacccagtggctggaaaccaagggcgtcgagagacttaaacggatggctatttctggggatgactgcgtggttaagcctatcgatgaccgcttcgccaacgctctgctcgccctgaacgatatgggcaaggtgagaaaagacattccgcagtggcaaccctccaagggatggcatgattggcagcaggtccctttctgtagccaccattttcacgaacttatcatgaaagacggccggaagctggtggtcccctgccgccctcaggacgagctcatcgggagagcgcggatttctcaaggagccggctggtccctgaaagaaacagcttgtctggggaaggcctacgctcagatgtggagcctcatgtatttccaccgcagagatctgcggcttgcctctaatgctatctgctccgccgtgcccgttcattggattcctaccagcagaacaacgtggtccatccacgcgcatcaccagtggatgaccacagaggacatgctgaccgtgtggaaccgcgtctggattgaggataatccctggatggaagacaagacaccggtgaccacgtgggaggatatcccttacctcggaaaacgggaagaccaatggtgtggcagcctgattgggcttacctctagagccacatgggctcagaacatcctgaccgccatccagcaggttcgcagcctcattggcgatgaggagtttctggactacatgccctccatgaagcggttcagaaaagaagaggaatctgagggagccatctggtga

SEQ ID NO: 20870 - RNA, 9873 nt, synthetic construct
  misc_feature 1..9873: note = derived and/or modified CDS sequence (opt5) from DENV-3__JQ045691__SS-prME
  source 1..9873: mol_type = other RNA
accagcctgtgcctcatgatgatgctgcccgccacacttgctttccacctgacgtcccgggacggagaacctcggatgatcgtggggaagaatgaacgcggaaagtctctcctgtttaagaccgccagcggcattaatatgtgtacacttatcgcgatggatctgggggaaatgtgcgacgataccgtgacatacaaatgtccgctcattgctgaagttgagcccgaagacatcgattgctggtgtaacctgacctccacatgggtgacctatggaacgtgcaatcaggccggcgagcaccggcgggacaagcgctctgtggccctggctcctcacattgggatgggactcgataccagaacacagacctggatgagcgccgagggcgcttggcggcaggtcgaaaaagtggagacatgggccctgcgccatcccggcttcaccatccttgcgctgtttctcgcccactacatcgggacgtccctgacacagaaggttgtgattttcatccttctgatgctcgtcaccccttctatgacaatgagatgtgtgggagttggcaaccgggactttgtggaagggctgagcggagctacctgggtcgatgtggtgctggagcatggcgggtgcgtcaccacaatggccaagaataaacccacgctcgacattgagctgcagaagaccgaagctacacaacttgccaccctgcgcaaactctgtatcgagggaaagattacaaacatcaccacggattccagatgccctacacagggcgaagcgattctgccggaggaacaggaccagaattatgtttgtaaacacacctacgtggatcggggctgggggaacggatgcggccttttcgggaagggaagcctggtgacctgcgccaagtttcaatgtctcgagcccatcgagggcaaagtcgtgcagtatgaaaatctgaagtacacagttatcattaccgtgcacacaggggaccagcatcaggtcggaaacgacacgcaaggcgtgaccgttgagatcacacctcaggcttctaccgtggaagccattctgcccgagtatggcacactcgggctggaatgctcccctcgcaccggacttgatttcaatgagatgatcctgctcacgatgaaaaacaaggcttggatggtccacagacagtggtttttcgacctgccccttccgtggaccagcggcgccacaaccgagacacctacctggaatcggaaagaactgctcgtgacgtttaagaacgcccatgctaaaaagcaagaggtcgtggttctggggtctcaggaaggagcgatgcacacagccctgaccggcgctacagagattcagatctccgggggcaccagcatcttcgccggacacctcaagtgtcgcctgaaaatggataaacttgaactgaaaggcatgtcttacgccatgtgcctcaatacctttgtgctgaagaaagaggtctccgagacacagcatgggacgattctgatcaaggtggaatacaagggagaggacgctccctgtaaaattcctttcagcaccgaagatggccaagggaaggcccacaacggaagacttatcacagcgaaccccgttgtgaccaaaaaggaggagcccgtcaatattgaagctgagcctccgttcggcgaatccaacatcgtgatcgggattggcgacaaagccctcaagatcaattggtataagaaaggatctagcattggcaagatgtttgaggccacagctagaggggccagacgcatggctatcctgggagataccgcctgggacttcggctccgtcggaggggttctgaacagcctcggcaaaatggtccatcagatttttgggtctgcgtacacggccctgttctccggcgtgagctggatcatgaagattggaatcggcgtgcttctgacatggatcgggctcaattctaaaaacaccagcatgtccttttcttgcattgtcatcggaattatcaccctgtatctgggcgctgtggttcaggccgatatggggtgtgctattaattggaagggaaaggaacttaaatgcggcagcgggatcttcgtgacaaacgaggtccacacctggacagagcagtacaagtttcaagccgactcccccaaacggctcgcgacggccatcgctggcgcctgggaaaatggagtgtgtggcattagaagcaccacacgcatggagaacctgctgtggaagcagatcgctaatgaactcaactatattctgtgggagaataacatcaaacttaccgttgtggtcggggatattatcggagtgctggaacagggcaagcggacactcacccctcagcccatggagctgaaatactcttggaagacgtgggggaaggccaaaatcgttaccgccgagacacaaaattccagcttcattatcgacggacctaacacccccgaatgcccgtctgcttccagagcgtggaacgtgtgggaggtcgaagactatggctttggcgtgttcacaaccaatatttggctgaaacttcgcgaggtgtacacacagagctgtgatcatcggctcatgtccgccgctatcaaagacgaaagagccgtccacgccgatatggggtactggattgagtctcagaagaacggaagctggaaactggagaaggcttcctttatcgaagttaagacctgcacgtggcctaaatctcacacactgtggagcaatggcgtgctcgagtccgacatgatcattcccaagagcctggccgggcctatctctcagcataaccaccgccccggatatcatacccaaaccgcgggcccttggcaccttgggaaactggaactcgatttcaattactgcgagggaacaaccgtggtcattacggagaactgtggcacacggggcccctccctgagaaccacaaccgtgagcgggaagctgatccacgaatggtgctgtcgctcttgcacacttccgcctctccggtatatgggagaggacggctgttggtacgggatggaaattagacccatcaatgagaaagaagagaacatggttaagtccctggtgagcgctggatctggcaaggtcgataattttaccatgggggtgctgtgcctcgccattctgttcgaggaagttatgcggggaaaattcggcaagaaacatatgatcgccggcgtgctttttacgttcgtcctgctcctgagcgggcagatcacctggcgcgacatggctcacacactgattatgatcggatccaacgccagcgatagaatgggcatgggggtgacctatcttgcgctgattgctacatttaagatccagcccttcctcgccctgggatttttcctccggaaactgacctctagagagaatcttctgctcggcgttgggctggccatggctacgacactgcaacttcctgaagacattgagcagatggccaacggaatcgctctgggcctcatgaccctgaagctcatcacacagtttgaaacctaccagctgtggaccgcccttgtgtccctgacatgtagcaatacgattttcaccctcacagtcgcgtggcgcaccgccacactgatcctggctggcgtgtcccttctgccgctctgccaatctagctccatgcggaagaccgattggctgcccatgacggtggccgctatgggggtccctcccctccctctgtttattttctctcttaaagacacacccaagaaaagaagctggcctctgaacgagggagttatggccgtgggcctggtgtccatcctcgcctctagcctgcttcgcaatgatgtccccatggctgggccgctggtggcgggaggcctcctgattgcctgttatgttatcaccgggacctccgctgacctcacagtggagaaggccgccgacgtcacctgggaagaggaagctgagcagacaggagtgagccataacctgatgatcacggttgatgacgatggcaccatgagaattaaagacgatgaaacagagaacatccttaccgtgctgctgaagacagccctcctgattgtctctggcatctttccttactccattcccgcgacccttctggtgtggcacacgtggcagaaacagacccaacggagcggggtcctctgggacgtgccttctcccccggagacacagaaggctgaactggaggaaggagtttaccgcatcaagcagcagggcattttcgggaaaacccaagtgggagtcggcgtgcagaaggagggggtttttcatacaatgtggcacgtgaccagaggagccgtcctcacacacaatggcaaacggctggagcctaactgggcctccgtgaagaaagatcttatcagctatggcgggggatggcgcctgtctgctcagtggcaaaagggcgaagaggtgcaggttatcgccgtcgaacccgggaagaatcctaaaaacttccagacgatgcccggaattttccagaccacaaccggcgagatcggggcgattgctctggactttaagcccggaacctccggcagccctatcattaatagagaaggcaaagtggtggggctctacggaaacggcgtcgtgacaaagaatgggggatatgtttccggcatcgcccaaacgaacgccgagccggatgggcccacccctgagctggaagaggaaatgttcaaaaagcggaatcttacaatcatggacctgcatcccggcagcggaaagacccgcaaatacctccctgctattgtgagagaggccatcaagcggcgcctgagaacactcattctggctcccacccgggtcgtggccgcggaaatggaggaggcccttaaaggcctgcctatcagatatcagacgacagctaccaagtctgaacacaccgggcgcgagattgttgatctgatgtgccatgccacatttaccatgcggctcctgagcccggtgagagtccccaactacaatcttatcatcatggacgaagctcacttcacagatcctgcctccattgccgctcgcggatatatctctacccgggtgggcatgggggaggcggccgctatttttatgacggccacaccccctggaaccgccgaggctttcccccagagcaacgccccgatccaggacgaggagagagacattcctgaacgctcctggaactctggcaacgagtggatcacagattttgttgggaaaaccgtgtggttcgtccccagcattaaggcgggcaatgacatcgctaactgtctgcggaagaacgggaaaaaggtgatccaactctccagaaaaacgtttgataccgaataccagaagacacgcctgaatgactgggatttcgtggtcaccacagacatttctgagatgggcgccaactttaaagccgatcgggttatcgaccccagacggtgcctgaagcctgtgattctcaccgatgggcccgagcgcgtgatccttgctggacctatgccggtcacagccgcgagcgccgctcagagacggggccgcgtggggagaaatccccagaaggaaaacgaccaatacattttcaccggacagcctctgaataacgatgaggaccatgcccactggacggaagctaaaatgctgctcgacaatatcaacacacccgagggcatcattcctgccctgttcgaacccgagcgggagaagtccgctgccatcgatggggaatatagacttaaaggcgagagccgcaagacctttgttgaactgatgcggagaggagacctcccggtgtggctggcgcacaaagtcgcctctgagggcattaagtacaccgatcgcaaatggtgcttcgacggggaacggaataaccagatcctggaggagaatatggatgtggaaatttggacaaaggagggagaaagaaagaaactccgccctcggtggcttgacgctagaacctattccgatcccctggccctgaaggagtttaaagacttcgctgccggccgcaagagcatcgccctcgatctggttacagaaatcgggagagtgccttctcatcttgctcaccggacgcgcaacgcgctggacaatctcgtcatgctgcatacctccgagcacggaggcagagcctaccggcacgctgtggaggaactgcccgagacaatggaaaccctccttctgctgggcctcatgattctgcttacagggggagccatgctgtttctcctgagcggcaaagggatcggaaagacctccattggcctgatctgtgtcattgtgtctagcgggatgctctggatggccgatgttcctcttcagtggatcgcttccgccattgtgctggagttctttatgatggtgctgctcatccccgagccggaaaagcaacgcacgcctcaggacaaccagctggcgtatgtcgttatcggcattcttaccctggccgctatcgtggccgctaatgagatgggcctcctggaaacaaccaaaagagatctgggcatgagcaaggagcccggggtggtctctcccacatcctacctcgacgtggaccttcatcctgccagcgcgtggaccctgtatgccgttgctacgacagtgattaccccgatgctgcggcacacaatcgaaaactctaccgccaatgtcagcctcgctgccattgctaaccaagccgtggtcctgatgggacttgataaaggctggcccatctccaagatggacctgggggtgcctctcctggcgctgggatgctactctcaggttaaccccctcacccttacagccgctgtgctgctgctcgtcacgcattacgccatcattggccctgggctgcaggctaaagccaccagagaggcccagaagcgcacagcggctggaatcatgaagaatcccaccgtggatggcattatgacaatcgaccttgatcctgttatttatgacagcaaattcgagaagcaactgggccaggtgatgctcctggtcctgtgtgccgtgcagctccttctgatgcggacctcctgggctctgtgcgaagccctcacgctggccacagggccgatcaccaccctttgggagggatctcccggcaaattttggaacacaaccatcgctgtgagcatggccaatattttcagagggtcctacctggcgggagccggcctcgcttttagcatcatgaagtctgttgggacaggacgccggggcacgggctcccagggggaaaccctgggagagaaatggaagaagaaactgaaccaactcagcagaaaggagttcgatctttataaaaagtccggcattacagaggtcgaccggaccgaggccaaagaagggctgaagcgcggagagacaacccaccatgctgtgtctagaggcagcgccaaactgcagtggtttgtggaacggaatatggtcatccctgaggggcgcgttattgatctcggatgtggcagaggcgggtggtcctactattgcgcgggactgaagaaggtgacggaagtgcggggctacaccaaagggggacccggccacgaggagcctgtccccatgtctacatatgggtggaaccttgtgaagctgatgagcggaaaagacgttttctacctcccgcctgaaaagtgtgataccctgctgtgcgacatcggcgagtccagcccctcttccacagtggaagagagccgcaccattagagtcctcaaaatggtggagccctggcttaagaataaccagttctgtatcaaggttctgaatccttacatgcccacagtgatcgaacacctggagcggctccagcgcaaatatggcgggatgctggtcagaaaccctctttctagaaattccacccatgaaatgtactggattagcaacggaacgggcaatatcgtgtctagcgtgaacatggtctccagactgctcctgaatcgctttacaatgacccaccggagaccgaccattgagaaggatgttgacctgggggccggaacacgccatgtgaacgctgaacccgagacgcctaacatggacgtgatcggcgagcggattaaaagaatcaaggaagaacactctagcacctggcactatgatgacgaaaatccctacaaaacatgggcctatcatgggtcctacgaggtcaaggctaccggaagcgcctcctctatgatcaacggcgtggttaagctcctgacaaaaccttgggatgtggtccccatggtgacccaaatggctatgacagacaccacgccgttcggccagcagcgcgtttttaaggaaaaagtggatacccggacacctagagccatgcccgggacccgcaaggtcatggagattacagcggagtggctttggcggaccctgggaagaaataaaaagcctcgcctctgcacgcgggaagagttcacaaagaaagtgagaaccaacgccgctatgggcgccgtttttacagaagagaatcaatgggacagcgctcgcgccgccgtggaagatgaggagttctggaagctggtcgacagagaacgggagcttcacaaactggggaagtgtggatcctgcgtgtataacatgatgggcaaacgcgaaaagaaactcggggagtttggcaaggcgaagggatctagagctatctggtacatgtggctgggcgcccggtacctggagttcgaagccctcgggtttctgaatgaggatcattggttcagcagagaaaactcctattctggagtcgagggcgaagggcttcacaaactgggatacattctccgggacatcagcaagattcccggcggggctatgtatgccgatgacaccgctggctgggacacgcgcatcaccgaggatgacctgcataatgaggagaagatcacacagcagatggatcctgagcacagacagcttgccaacgcgatttttaagctgacctaccaaaataaagtggttaaggtgcagcggcccacaccgaagggaaccgtcatggacatcatttcccgcaaagatcagagaggcagcggacaggtgggaacatatggcctcaacaccttcacgaatatggaagcccaactggtgcggcagatggagggggaaggagttctgtctaaggctgacctcgagaactcccatctgcttgagaaaaagatcacacagtggctggaaaccaaaggcgtggagcgcctcaagagaatggccattagcggggatgactgcgtcgtgaagcctatcgatgaccggtttgctaatgccctgcttgcgctgaacgatatgggcaaagttcgcaaggacatcccccagtggcaaccctctaaaggatggcatgattggcaacaggtgcctttctgttcccaccatttccacgaactcattatgaaggacggcagaaaactggtcgtgccgtgccggccccaggacgagctgatcgggcgcgccagaattagccaaggagctggctggtctctcaaggaaaccgcctgtctggggaaggcttacgcccagatgtggtcccttatgtattttcaccggcgcgatctgagactcgctagcaacgccatctgctccgcggtccctgtgcattggattcccacaagccggaccacatggtctatccacgcccatcaccagtggatgacgaccgaggacatgctgacagtttggaatagagtgtggattgaggataacccttggatggaagacaaaacccccgtcacaacctgggaggatgtgccttaccttggaaagcgcgaagaccaatggtgtggcagcctgatcgggctcacgtcccgggctacctgggcccagaatatcctgacagccattcagcaggttagatctctgatcggcgatgaggagttcctcgactacatgcccagcatgaaacgctttcggaaggaagaggaatccgagggagctatttggtga

SEQ ID NO: 20871 - RNA, 9873 nt, synthetic construct
  misc_feature 1..9873: note = derived and/or modified CDS sequence (opt5) from DENV-3__JQ045692__SS-prME
  source 1..9873: mol_type = other RNA
accagcctgtgcctcatgatgatgctgcccgccacacttgctttccacctgacgtcccgggacggcgaacctcggatgatcgtggggaagaatgaacgcggaaagtctctcctgtttaagaccgccagcggcattaatatgtgtacacttatcgcgatggatctgggggagatgtgcgacgataccgtcacatacaagtgtccgctcattgctgaagttgagcccgaagacatcgattgctggtgtaacctgacctccacatgggtgacctatggaacgtgcaatcaggccggcgagcatagacgggacaagcgctctgtggccctggctcctcacgtcgggatgggactcgataccagaacacagacctggatgagcgccgagggcgcttggcggcaggtcgaaaaggttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagaataagcccacgctcgacatcgagctgcagaagaccgaagctacacaacttgccaccctgcgcaaactctgtattgagggaaagatcacaaacattaccacggattccagatgccctacacagggcgaagcgatcctgccggaggaacaggaccagaattatgtgtgtaaacacacctacgtggatcggggctgggggaacggatgcggccttttcgggaagggaagcctggtgacctgcgccaagtttcaatgtctcgagcccattgagggcaaagtggttcagtatgaaaatctgaagtacacagtgatcatcaccgtccacacaggggaccagcatcaggtgggaaacgacacgcaaggcgttaccgtggagattacacctcaggcttctaccgtcgaagccatcctgcccgagtatggcacactcgggctggaatgctcccctcgcaccggacttgatttcaatgagatgattctgctcacgatgaaaaacaaggcttggatggtgcacagacagtggtttttcgacctgccccttccgtggaccagcggcgccacaaccgagacacctacctggaatcggaaagaactgctcgtcacgtttaagaacgcccatgctaaaaagcaagaggtggttgtgctggggtctcaggaaggagcgatgcacacagccctgaccggcgctacagagatccagatttccgggggcaccagcatcttcgccggacacctcaagtgtcgcctgaaaatggataaacttgaactgaaaggcatgtcttacgccatgtgcctcaatacctttgtcctgaagaaagaggtgtccgagacacagcatgggacgatcctgattaaggttgaatacaagggagaggacgctccctgtaaaatccctttcagcaccgaagatggccaagggaaggcccacaacggaagacttattacagcgaaccccgtggtcaccaaaaaggaggagcccgtgaatatcgaagctgagcctccgttcggcgaatccaacattgtgatcgggatcggcgacaaagccctcaagattaattggtataagaaaggatctagcatcggcaagatgtttgaggccacagctagaggggccagacgcatggctattctgggagataccgcctgggacttcggctccgttgggggagtcctgaacagcctcggcaaaatggtgcatcagatctttgggtctgcgtacacggccctgttctccggcgtgagctggattatgaagatcggaattggcgtccttctgacatggatcgggctcaattctaaaaacaccagcatgtccttttcttgcatcgtgattggaatcattaccctgtatctgggcgctgttgtgcaggccgatatggggtgtgctatcaattggaagggaaaggaacttaaatgcggcagcgggattttcgtcacaaacgaggtgcacacctggacagagcagtacaagtttcaagccgactcccccaaacggctcgcgacggccatcgctggcgcctgggaaaatggagtttgtggcatcagaagcaccacacgcatggagaacctgctgtggaagcagattgctaatgaactcaactatatcctgtgggagaataacattaaacttaccgtggtcgtgggggatatcattggagttctggaacagggcaagcggacactcacccctcagcccatggagctgaaatactcttggaagacgtgggggaaggccaaaatcgtgaccgccgagacacaaaattccagcttcatcattgacggacctaacacccccgaatgcccgtctgcttccagagcgtggaacgtctgggaggtggaagactatggctttggcgtgttcacaaccaatatctggctgaaacttcgcgaggtctacacacagagctgtgatcatcggctcatgtccgccgctattaaagacgaaagagccgttcacgccgatatggggtactggatcgagtctcagaagaacggaagctggaaactggagaaggcttcctttattgaagtgaagacctgcacgtggcctaaatctcacacactgtggagcaatggcgtgctcgagtccgacatgatcatccccaagagcctggccgggcctatttctcagcataaccaccgccccggatatcatacccaaaccgcgggcccttggcaccttgggaaactggaactcgatttcaattactgcgagggaacaaccgtcgtgatcacggagaactgtggcacacggggcccctccctgagaaccacaaccgttagcgggaagctgattcacgaatggtgctgtcgctcttgcacacttccgcctctccggtatatgggagaggacggctgttggtacgggatggaaatcagacccattaatgagaaagaagagaacatggtgaagtccctggtcagcgctggatctggcaaggtggataattttaccatgggggttctgtgcctcgccatcctgttcgaggaagtgatgcggggaaaattcggcaagaaacatatgattgccggcgtcctttttacgttcgtgctgctcctgagcgggcagatcacctggcgcgacatggctcacacactgatcatgattggatccaacgccagcgatagaatgggcatgggggttacctatcttgcgctgatcgctacatttaagattcagcccttcctcgccctgggatttttcctccggaaactgacctctagagagaatcttctgctcggcgtggggctggccatggctacgacactgcaacttcctgaagacatcgagcagatggccaacggaattgctctgggcctcatgaccctgaagctcatcacacagtttgaaacctaccagctgtggaccgcccttgtctccctgacatgtagcaatacgatcttcaccctcacagtggcgtggcgcaccgccacactgattctggctggcgtgtcccttctgccgctctgccaatctagctccatgcggaagaccgattggctgcccatgacggtcgccgctatgggggttcctcccctccctctgtttatcttctctcttaaagacacacccaagagacgcagctggcctctgaacgagggagtgatggccgtgggcctggtctccattctcgcctctagcctgcttagaaatgatgtgcccatggctgggccgctggttgcgggaggcctcctgatcgcctgttatgtgattaccgggacctccgctgacctcacagtcgagaaagccgccgacgtgacctgggaagaggaagctgagcagacaggagttagccataacctgatgatcacggtggatgacgatggcaccatgcggatcaaggacgatgaaacagagaacattcttaccgtcctgctgaaaacagccctcctgatcgtgtctggcatttttccttactccatccccgcgacccttctggtctggcacacgtggcagaagcagacccaacgcagcggggtgctctgggacgttccttctcccccggaggctcagaaagccgaactggaggaaggagtgtacagaattaagcagcagggcatcttcgggaagacacaagtcggagtgggcgttcagaaagagggggtgtttcataccatgtggcacgtcacacggggagccgtgctcacccacaatggcaagcgcctggagcctaactgggcttccgtgaaaaaggatcttattagctatggcgggggatggagactgtctgcccagtggcaaaaaggcgaagaggttcaggtcatcgcggtggaacccgggaagaatcctaagaacttccagacaatgcccggaatcttccagacgaccacaggcgagattggggctatcgccctggactttaaacccggaacctccggcagccctattatcaatcgggaaggcaaggtggtcgggctctacggaaacggcgtggttaccaaaaatgggggatatgtgtccggcattgcccaaacaaacgctgagccggatgggcccacgcctgagctggaagaggaaatgttcaagaaacgcaatcttaccatcatggacctgcatcccggcagcggaaagacaagaaagtacctccctgccatcgtccgggaggctattaaacgcagactgcggaccctcatcctggcccccacaagagtggttgcggccgaaatggaggaggctcttaagggcctgcctattcgctatcagaccacggccacaaaatctgaacacaccgggcgggagatcgtggatctgatgtgccatgctacctttacaatgagactcctgagcccggtccgcgtgcccaactacaatcttattatcatggacgaagcccacttcaccgatcctgcctccatcgctgcgcggggatatatttctacaagagttggcatgggggaggccgctgccatctttatgaccgccacgccccctggaacagctgaagccttcccccagagcaacgcgccgattcaggacgaggagcgcgacatccctgaacggtcctggaactctggcaacgagtggattaccgattttgtggggaagacagtctggttcgtgcccagcatcaaagctggcaatgacattgccaactgtctgagaaagaacggaaagaaagtgatccaactctcccgcaagacctttgatacggaataccagaaaacccggctgaatgactgggatttcgtcgttacaaccgacatctctgagatgggcgccaactttaaggctgatagagtgattgacccccggcgctgcctgaaacctgtgatcctcacagatgggcccgagagagtcattcttgccggacctatgccggtgaccgcggccagcgctgcccagcggcgcggcagagttgggcggaatccccagaaggaaaacgaccaatacatcttcacaggacagcctctgaataacgatgaggaccatgctcactggaccgaagccaagatgctgctcgacaatattaacacgcccgagggcatcatccctgctctgttcgaacccgagagagagaaatccgccgcgattgatggggaatatcgccttaagggcgagagccggaaaacatttgtggaactgatgagacgcggagacctcccggtctggctggcccacaaggtggcttctgagggcatcaaatacaccgatcggaagtggtgcttcgacggggaaagaaataaccagattctggaggagaatatggatgttgaaatctggaccaaagagggagaacgcaagaagctccggcctagatggcttgacgcccgcacatattccgatcccctggctctgaaagagtttaaggacttcgccgccggcagaaaaagcattgctctcgatctggtgaccgaaatcgggcgggtcccttctcatcttgcgcaccgcacaagaaacgccctggacaatctcgtgatgctgcatacgtccgagcacggaggccgggcttaccgccacgccgtcgaggaactgcccgagaccatggaaacatttctccttctgggcctgatgatcctcctgaccgggggagccatgcttttcctgctcagcggcaaggggattggaaaaacatccatcggcctgatttgtgtgatcgtttctagcgggatgctgtggatggctgatgtgcctctccagtggattgcctccgcgatcgtgcttgagtttttcatgatggtcctgctgattcccgagccggaaaagcaaagaacccctcaggacaaccagctcgcctatgttgtgatcggaatcctgacgcttgctgccattgtggctgccaatgagatgggcctgctcgaaaccacaaagcgggatctgggcatgagcaaagagcccggggtcgtgtctcccacctcctacctggacgttgacctccatcctgcgagcgcctggacactttatgctgtggccaccacggtcatcacaccgatgctgagacacaccattgaaaactctacagctaatgtgagcctggccgctatcgccaaccaagcggtcgtgctcatgggactggataagggctggcccatttccaaaatggaccttggggttcctctgctcgccctgggatgctactctcaggtgaaccccctgaccctcaccgctgccgtccttctgctggtgacacattacgctatcatcggccctgggctccaggccaaggccacgcgcgaggcgcagaaacggaccgctgccggaattatgaagaatcccacagttgatggcatcatgaccattgacctggatcctgtgatctatgacagcaagtttgagaaacaacttggccaggtcatgctgctcgtgctgtgtgctgtgcagctgctccttatgagaacatcctgggccctgtgcgaagccctgaccctcgctacggggccgattacaaccctgtgggagggatctcccggcaagttctggaacaccacaatcgccgttagcatggcgaatatctttcgcgggtcctaccttgccggagctggcctggccttcagcattatgaaatctgtcgggaccggacggagaggcacaggctcccagggggaaacgctcggagagaagtggaaaaagaagctgaaccaactgagccggaaagaatttgatctctataagaaatccggcatcaccgaggtggaccgcacagaggctaaggaagggcttaaaagaggagagaccacacaccatgccgtgtctcggggcagcgcgaagctgcagtggttcgtcgaacgcaatatggttattcctgaggggagagtgatcgatctgggatgtggccggggcgggtggtcctactattgcgccggactcaaaaaggtgaccgaagtccgcggctacacgaaaggcgggcccgggcacgaggagcctgtgcccatgtctacctatgggtggaacctggttaaacttatgagcggaaaggacgtgttctacctgccgcctgaaaaatgtgatacactcctgtgcgacattggcgagtccagcccctcttccaccgtcgaagagagcagaacaatccgggtgctgaagatggttgagccctggctcaaaaataaccagttttgtattaaggtgcttaatccttacatgcccaccgtcatcgaacacctggagcgcctgcagagaaagtatggcgggatgctcgtgcggaaccctctgtctagaaattccacacatgaaatgtactggatcagcaacggaaccggcaatattgtgtctagcgtcaacatggtttcccgccttctgctcaatcggttcacgatgacacacagacgcccgaccatcgagaaagatgtggacctgggggctggaacccggcatgtgaacgccgaacccgagacacctaacatggacgtcattggcgagagaatcaagcgcattaaagaggaacactctagcacgtggcactatgatgacgaaaatccctacaagacctgggcttatcatgggtcctacgaggtgaaagccacaggaagcgcttcctctatgatcaacggcgttgtgaagctgctcaccaagccttgggatgtcgtgcccatggttacacaaatggccatgaccgacacaaccccgtttggccagcagcgggtgttcaaagaaaaggtcgatacgagaacccctcgcgcgatgcccgggacacggaaagtgatggagatcaccgccgagtggctgtggagaacacttggacgcaataagaaacctcggctgtgcaccagagaagagtttacgaagaaggttcgcacaaacgctgccatgggcgctgtgttcaccgaagagaatcaatgggacagcgccagagccgcggtcgaagatgaggagttttggaaactcgtggaccgggaacgcgagctgcacaaacttgggaaatgtggatcctgcgtctataacatgatgggcaagagagagaagaagctgggggagttcggcaaagctaagggatctcgggccatttggtacatgtggctcggcgccagatacctggagtttgaagctctggggttcctcaatgaggatcattggtttagccgggaaaactcctattctggagtggagggcgaagggctgcacaaacttggatacatcctgcgcgacattagcaaaatccccggcggggccatgtatgctgatgacacagccggctgggacaccagaattacggaggatgacctccataatgaggaaaagatcacccagcagatggatcctgagcaccggcagctggcgaacgccatcttcaaacttacataccaaaataaggttgtgaaagtccagcgccccaccccgaagggaacagtgatggacattatctccagaaaggatcagcggggcagcggacaggtgggaacctatggcctgaacacatttaccaatatggaagctcaactcgttcgccagatggagggggaaggagtgctgtctaaagccgacctggagaaccctcacctcctggagaagaaaattacgcagtggcttgaaacaaagggcgtcgagagactgaaacggatggctatctccggggatgactgcgtggttaagcccattgatgaccgcttcgccaatgcgctcctggcccttaacgatatgggcaaggtgagaaaagacatcccccagtggcaacctagcaagggatggcatgattggcagcaggtcccgttctgttctcaccattttcacgaactgatcatgaaagacggccggaagctcgtggtcccctgccgccctcaggacgagctgattgggagagctcggatctcccaaggagccggctggagcctgaaagaaaccgcttgtctcgggaaggcctacgctcagatgtggtctctgatgtatttccaccgcagagatcttcggctggcctccaacgcgatttgcagcgccgtgcccgttcattggatccctacctccagaacaacctggagcattcacgctcatcaccagtggatgacaacggaggacatgctcaccgtgtggaatcgcgtctggatcgaggataacccctggatggaagacaagacacctgtgaccacatgggaggatgttccctacctgggaaaacgggaagaccaatggtgtggctctcttattgggctgaccagcagagccacgtgggcccagaatatcctcaccgctatccaacaggtgcgctccctgattggcgatgaggagtttctggactacatgccgtctatgaagcggttcagaaaagaagaggaaagcgagggagccatctggtga

SEQ ID NO: 20872 - RNA, 9873 nt, synthetic construct
  misc_feature 1..9873: note = derived and/or modified CDS sequence (opt5) from DENV-3__JQ045694__SS-prME
  source 1..9873: mol_type = other RNA
acaagcctgtgcctcatgatgatgctgcccgccacacttgctttccacctgacgtcccgggacggcgaacctcggatgatcgtggggaagaacgaacgcggaaagtctctcctgtttaagaccgccagcggcattaatatgtgtacacttatcgcgatggatctgggggaaatgtgcgacgataccgtcacatacaagtgtccgctcattgctgaagttgaacccgaagacatcgattgctggtgtaacctgacctccacatgggtgacctatggaacgtgcaatcaggccggcgagcatcggcgggacaagcgctctgtggccctggctcctcacgtcgggatgggactcgataccagaacacagacctggatgagcgccgagggcgcttggagacaggtggaaaaagttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagaataaacccacgctcgacatcgagctgcagaagaccgaagctacacagcttgccaccctgcgcaaactctgtattgagggaaagatcacaaacattaccacggattccagatgccctacacagggcgaagcgatcctgccggaggaacaggaccagaattatgtgtgtaaacacacctacgtggatcggggctgggggaacggatgcggccttttcgggaagggaagcctggtcacatgcgccaagtttcaatgtctcgagcccattgagggcaaagtggttcagtatgaaaatctgaagtacacagtgatcatcaccgtccacacaggggaccagcatcaggtgggaaacgacacgcaaggcgttaccgtggagattacacctcaggcttctaccgtcgaagccgtgctgcccgagtatggcacactcgggctggaatgctcccctcgcaccggacttgatttcaatgagatgatcctgctcacgatgaaaaacaaggcttggatggtccacagacagtggtttttcgacctgccccttccgtggaccagcggcgccacaaccgagacacctacctggaatcggaaagaactgctcgtgacgtttaagaacgcccatgctaaaaagcaagaggttgtggtcctggggtctcaggaaggagcgatgcacacagccctgaccggcgctacagagattcaaaattccgggggcaccagcatcttcgccggacacctcaagtgtcgcctgaaaatggataaacttgaactgaaaggcatgtcttacgccatgtgcctcaacacctttgtgctgaagaaagaggtttccgagacacagcatgggacgattctgatcaaggtggaatacaagggagaggacgctccctgtaaaatccctttcagcaccgaagatggccaagggaaggcccacaacggaagacttattacagcgaatcccgtcgtgaccaaaaaggaggagcccgtgaacatcgaagctgagcctccgttcggcgaatccaatattgttatcgggattggcgacaaagccctcaagatcaactggtataagaaaggatctagcatcggcaagatgtttgaggccacagctagaggggccagacgcatggctattctgggagataccgcctgggacttcggctccgtcgggggagtgctgaatagcctcggcaaaatggtgcatcagatctttgggtctgcgtacacggccctgttctccggcgtcagctggattatgaagatcggaattggcgtgcttctgacatggatcgggctcaactctaaaaataccagcatgtccttttcttgcattgttatcggaatcattaccctgtatctgggcgctgtggtccaggccgatatggggtgtgctatcaactggaagggaaaggaacttaaatgcggcagcgggattttcgtgacaaatgaggttcacacctggacagagcagtacaagtttcaagccgactcccccaaacggctcgcgacggccatcgctggcgcctgggaaaacggagtgtgtggcattagaagcaccacacgcatggagaatctgctgtggaagcagatcgctaacgaactcaattatatcctgtgggagaacaatattaaacttaccgtcgtggttggggatatcattggagtgctggaacagggcaagcggacactcacccctcagcccatggagctgaaatactcttggaagacgtgggggaaggccaaaatcgtcaccgccgagacacaaaactccagcttcattatcgacggacctaacacccccgaatgcccgtctgcttccagagcgtggaatgtgtgggaggtggaagactatggctttggcgtcttcacaaccaacatctggctgaaacttcgcgaggtttacacacagagctgtgatcatcggctcatgtccgccgctattaaagacgaaagagccgtgcacgccgatatggggtactggatcgagtctcagaagaatggaagctggaaactggagaaggcttcctttattgaagtgaagacctgcacgtggcctaaatctcacacactgtggagcaacggcgtcctcgagtccgacatgatcattcccaagagcctggccgggcctatctctcagcataatcaccgccccggatatcatacccaaaccgcgggcccttggcaccttgggaaactggaactcgatttcaactactgcgagggaacaaccgtggttatcacggagaattgtggcacacggggcccctccctgagaaccacaaccgtgagcgggaagctgattcacgaatggtgctgtcgctcttgcacacttccgcctctccggtatatgggagaggacggctgttggtacgggatggaaatcagacccattaacgagaaagaagagaatatggtcaagtccctggtgagcgctggatctggcaaggttgataactttaccatgggggtgctgtgcctcgccatcctgttcgaggaagtcatgcggggaaaattcggcaagaaacatatgattgccggcgtgctttttacgttcgttctgctcctgagcgggcagatcacctggcgcgacatggctcacacactgattatgatcggatccaatgccagcgatagaatgggcatgggggtgacctatcttgcgctgatcgctacatttaagattcagcccttcctcgccctgggatttttcctccggaaactgacctctagagagaaccttctgctcggcgtcgggctggccatggctacgacactgcaacttcctgaagacatcgagcagatggccaatggaattgctctgggcctcatgaccctgaagctcatcacacagtttgaaacctaccagctgtggaccgcccttgtgtccctgacatgtagcaacacgattttcaccctcacagtggcgtggcgcaccgccacactgatcctggctggcgtctcccttctgccgctctgccaatctagctccatgcggaagaccgattggctgcccatgacggttgccgctatgggggtgcctcccctccctctgtttatcttctctcttaaagacacacccaagagacgcagctggcctctgaatgagggagtgatggccgtcggcctggtgtccattctcgcctctagcctgcttagaaacgatgttcccatggctgggccgctggtggcgggaggcctcctgatcgcctgttatgtcattaccgggacctccgctgacctcacagtggagaaagccgccgacgttacctgggaagaggaagctgagcagacaggagtgagccataacctgatgatcacggtcgatgacgatggcaccatgcggattaaggacgatgaaacagagaatatccttaccgtgctgctgaaaacagccctcctgatcgtctctggcatttttccttactccatccccgcgacccttctggtgtggcacacgtggcagaagcagacccaacgcagcggggttctctgggacgtgccttctcccccggagacacagaaagctgaactggaggaaggagtctacagaattaagcagcagggcatcttcgggaagacccaagtgggagttggcgtgcagaaagagggggtctttcatacaatgtggcacgtgacccggggagccgtgctcacacacaacggcaagcgcctggagcctaattgggcctccgttaaaaaggatcttattagctatggcgggggatggagactgtctgctcagtggcaaaaaggcgaagaggtccaggtgatcgccgtggaacccgggaagaaccctaagaatttccagacgatgcccggaattttccagaccacaaccggcgagatcggggcgatcgctctggactttaaacccggaacctccggcagccctattatcaaccgggaaggcaaggtcgtggggctctacggaaatggcgttgtgaccaagaacgggggatatgtctccggcattgcccaaacgaatgccgagccggatgggcccacccctgagctggaagaggaaatgttcaagaaacgcaaccttacaatcatggacctgcatcccggcagcggaaagaccagaaagtacctccctgctattgtgcgggaggccatcaaacgcagactgcggacactcatcctggctcccaccagagttgtggccgcggaaatggaggaggcccttaagggcctgcctattcgctatcagacgacagctaccaaatctgaacacaccgggcgggagatcgtcgatctgatgtgccatgccacatttaccatgagactcctgagcccgattcgcgtgcccaattacaaccttatcattatggacgaagctcacttcacagatcctgcctccatcgccgctcggggatatatctctaccagagttggcatgggggaggcggccgctatttttatgacggccacaccccctggaaccgccgaggctttcccccagagcaatgccccgatccaggacgaggagcgcgacattcctgaacggtcctggaactctggcaatgagtggatcacagattttgtggggaagaccgtctggttcgtgcccagcattaaagcgggcaacgacatcgctaactgtctgagaaagaatggaaagaaagtgattcaactctcccgcaagacgtttgataccgaataccagaaaacacggctgaacgactgggatttcgtcgttaccacagacatctctgagatgggcgccaattttaaggccgatagagtgatcgacccccggcgctgcctgaaacctgtgattctcaccgatgggcccgagagagtcatccttgctggacctatgccggtgacagccgcgagcgccgctcagcggcgcggcagagttgggcggaacccccagaaggaaaatgaccaatacattttcaccggacagcctctgaacaatgatgaggaccatgcccactggacggaagctaagatgctgctcgacaacatcaatacacccgagggcattatccctgccctgttcgaacccgagagagagaaatccgctgccatcgatggggaatatcgccttaagggcgagagccggaaaacctttgtggaactgatgagacgcggagacctcccggtctggctggcgcacaaggtggcctctgagggcattaaatacaccgatcggaagtggtgcttcgacggggaaagaaacaatcagatcctggaggagaacatggatgttgaaatttggacaaaagagggagaacgcaagaagctccggcctagatggcttgacgctcgcacctattccgatcccctggccctgaaagagtttaaggacttcgctgccggcagaaaaagcatcgccctcgatctggtgacagaaattgggcgggtcccttctcatcttgcttaccgcacgagaaatgcgctggacaacctcgtgatgctgcacacctccgagcatggaggccgggcctatcgccacgctgtcgaggaactgcccgagacaatggaaaccctccttctgctgggcctcatgatcctgcttacagggggagccatgctgtttctcatgagcggcaaggggatcggaaaaacctccattggcctgatctgtgtgattgtttctagcgggatgctgtggatggccgatgtgcctctccagtggatcgcttccgccattgtgcttgagttctttatgatggtcctgctgatccccgagccggaaaagcaaagaacgcctcaggacaatcagctcgcgtacgttgtgattggaatcctgacccttgccgctatcgtggccgctaacgagatgggcctgctcgaaacaaccaagcgggatctgggcatgagcaaagagcccggggtcgtgtctcccacatcctatctggacgttgacctccaccctgccagcgcgtggaccctttacgccgtggctacgacagtcattaccccgatgctgagacatacaatcgaaaattctaccgccaacgtgagcctggctgccattgctaaccaagccgtcgtgctcatgggactggataagggctggcccatctccaaaatggaccttggggttcctctgctcgcgctgggatgctactctcaggtgaatcccctgaccctcacagccgctgtccttctgctggtgacgcactatgccattatcggccctgggctccaggctaaggccacccgcgaggcccagaaacggacagcggctggaatcatgaagaaccccaccgttgatggcattatgacaatcgacctggatcctgtgatttacgacagcaagttcgagaaacaacttggccaggtcatgctgctcgtgctgtgtgccgtgcagctgctccttatgagaacctcctgggctctgtgcgaagccctgacgctcgccacagggccgatcaccaccctgtgggagggatctcccggcaagttttggaatacaaccattgctgttagcatggccaacatcttccgcgggtcctatcttgcgggagccggcctggcttttagcatcatgaaatctgtcgggacaggacggagaggcacgggccctcagggggaaaccctcggagagaagtggaaaaagaagctgaatcaactgtcccggaaagagttcgatctctacaagaaaagcggcattacagaggtggaccgcaccgaggccaaggaagggcttaaaagaggagagacaacccatcacgctgtgtcccggggctctgccaagctgcagtggtttgtcgaacgcaacatggttatccccgaggggagagtgattgatctgggatgtggccggggcgggtggagctattactgcgcgggactcaaaaaggtgacggaagtccgcggctataccaaaggcgggcctgggcatgaggagcccgtgccgatgtccacatacgggtggaatctggttaaacttatgtctggaagagacgtgttctacctgcctcccgaaaagtgtgataccctcctgtgcgacatcggcgagagctcccccagccctacagtcgaagagtctcggaccattcgcgtgctgaaaatggttgagccctggctcaagaacaatcagttctgtatcaaagtgcttaacccttatatgccgacagtcattgaacacctggagagactgcagcggaagtacggcgggatgctcgtgagaaatcccctgtcccgcaacagcacccacgaaatgtattggatctctaatggaacgggcaacatcgtgtccagcgtcaatatggtttctcggcttctgctcaacagatttacaatgacccatcgccggcctaccattgagaaggatgtggacctgggggccggaacaagacacgtgaacgctgaacccgagacgcctaatatggacgtcatcggcgagcgcattaaacggatcaaggaagaacatagctccacctggcactacgatgacgaaaacccctataaaacatgggcctaccacgggtcttatgaggtgaaggctaccggaagcgcctccagcatgattaatggcgttgtgaaactgctcacaaagccgtgggatgtcgtgcctatggttacccaaatggctatgacagacaccacgcccttcggccagcagagagtgtttaaggaaaaagtcgatacccgcacacctcggcccatgcctgggaccagaaaggtgatggagatcacagccgagtggctgtggcgcacccttggacggaacaaaaagcccagactgtgcacgcgcgaagagttcaccaagaaggttagaaccaatgcggccatgggcgctgtgtttacagaagagaaccaatgggactccgcccgggctgccgtcgaagatgaggagttctggaagctcgtggaccgcgaaagagagctgcataaacttgggaagtgtggatcttgcgtctacaatatgatgggcaaacgggaaaagaaactgggggagtttggcaaggccaaaggaagcagagcgatctggtacatgtggctcggcgctcggtatctggagttcgaagccctggggtttctcaacgaggatcactggttctcccgcgaaaattcttacagcggagtggagggcgaagggctgcataaacttggatatattctgagagacatctccaagattccgggcggggccatgtacgctgatgacaccgccggctgggacacgcggatcaccgaggatgacctccacaacgaggagaagattacacagcagatggatcctgagcatcgccagctggctaatgccatctttaaacttacctatcaaaacaaagttgtgaaggtccagagacccacacccaaaggaaccgtgatggacatcatttctcggaaggatcagcgcggcagcggacaggtgggaacatacggcctgaataccttcacgaacatggaagcgcaactcgttagacagatggagggggaaggagtgctgtccaaggccgacctggagaatcctcacctcctggagaaaaagatcacacagtggcttgaaaccgagggcgtcgaacggctgaaacgcatggctattagcggggatgactgcgtggttaagccgatcgatgacagatttgccaacgctctcctggcccttaacgatatgggcaaagtgcggaaggacattccccagtggcaaccttctaagggatggcacgattggcagcaggtccccttctgttcccatcacttccatgagctgatcatgaaagacggccgcaagctcgtggtcccttgcagaccccaggacgaactgatcgggcgggcgcgcattagccaaggagccggctggtctctgaaagagaccgcttgtctcgggaaggcctatgctcagatgtggtccctgatgtactttcacagacgggatcttagactggccagcaatgctatctgctctgccgtgcctgttcactggattcccacatcccgcaccacatggagcatccatgcgcaccatcagtggatgacgaccgaggacatgctcacagtgtggaaccgggtctggattgaagataatccgtggatggaggacaaaacccctgtgacaacctgggaagatgttccctacctgggaaagagagaggaccaatggtgtggctcccttatcgggctgacgagccgcgccacctgggctcagaacattctcacagccatccaacaggtgcggtctctgatcggcgatgaggagttcctggactatatgcctagcatgaagagatttcgcaaagaggaagagtccgaaggagccatttggtga

SEQ ID NO: 20873 - RNA, 9873 nt, synthetic construct
  misc_feature 1..9873: note = derived and/or modified CDS sequence (opt5) from DENV-3__GU363549__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccagaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgccccctgtaaaattcctttcagcaccgaggacgagcaaggcaaggcgcataacgggagactgatcacagctaatcccgttgtgaccaaaaaggaagagcccgtcaacattgaagccgagcctccgttcggagaatccaatatcgtgattggcatcggggataacgccctgaaaatcaattggtataagaagggctctagcattggaaaaatgtttgaggctacggcccggggcgctagacgcatggccatccttggggacacagcgtgggatttcggatccgtgggcggggttctcaacagcctgggaaagatggtccaccagatttttggctctgcctacaccgctctgttctccggggtgagctgggtgatgaaaatcggcattggagtcctcctgacctggatcggccttaattctaagaacacaagcatgtccttttcttgcattgccatcgggatcattaccctgtatctcggagctgtggttcaggccgacatgggctgtgtgatcaattggaaagggaaggagctgaagtgcggaagcggcattttcgtcacaaacgaagtgcatacgtggaccgagcagtacaaatttcaagcggattcccccaagcggctggccacagctatcgccggggcttgggaaaatggcgtttgtggaattagaagcaccacacgcatggagaaccttctctggaaacagatcgccaatgaactgaactatatcctgtgggagaataacattaagctcaccgtggtcgtgggcgacacgatcggggttctggagcagggaaaacggacccttacacctcagcccatggaactgaagtactcttggaaaacctggggcaaggccaagattgtgacagctgagacccaaaactccagcttcatcattgatgggcctaatacacccgaatgcccgtctgcgtccagagcctggaacgtctgggaggtggaagactatggatttggcgtgttcaccacgaatatctggctcaaactgcgcgaggtctacacacagatgtgtgaccaccggctgatgagcgctgccgttaaggatgagagagccgtgcacgctgacatgggctactggatcgaatcccagaaaaacgggtcttggaagcttgagaaagccagcctcattgaagtgaagacctgcacctggcctaagtcccatacactgtggtctaatggagtcctggagagcgatatgatcattcccaaatccctcgcgggccctatcagccagcacaactatcgccccgggtaccatacccaaacggctggaccttggcacctgggcaagcttgagctggactttaattattgcgaagggacaaccgtggttattacagagaactgtggaacccggggcccctctctcagaacaaccacggtgtccggcaaactgatccacgaatggtgctgtcgcagctgcaccctgccgcctcttcggtacatgggggaggatggatgttggtatggcatggaaatcagacccatttctgagaaggaggaaaatatggtcaaatccctcgtgagcgccgggtctggaaaggttgacaacttcacaatgggcgtgctgtgcctggccatcctctttgaggaagtcatgcgggggaagttcggaaaaaagcatatgattgctggcgtgttcctgacctttatgcttctgctcagcggccagatcacatggcgcgatatggcccacaccctgattatgatcgggtccaatgcgagcgacagaatgggaatgggcgttacgtacctggctcttattgccacattcaaaatccagccctttctggccctcgggttctttctgcggaagctcacctctagagagaacctgcttctgggagtgggcctcgctatggccacaaccatccaactgcctgaagatattgagcagatggctaatgggatcgccctgggacttatggcgctgaaactcattacccagttcgagacatatcagctgtggacggccctcatctccctgacctgtagcaacacaatttttacccttacagtcgcttggcgcaccgccacgctgatcctcgctggcgtgtccctgctgccggtgtgccaatctagctccatgcggaagacagactggcttcccatgaccgtcgccgccatgggcgttcctcccctgcctctcttcatcttttctctgaaggataccctcaaaagacgcagctggcccctgaatgaaggggtgatggctgtgggacttgtctccattctggcgtctagcctgctcagaaacgacgtgcctatggccggccccctggttgctgggggacttctgatcgcctgttacgtgattacaggcacctccgccgatctcacagtcgagaaggctgccgacgtgacgtgggaagaggaagcggagcagaccggggttagccataacctgatgatcacagtggacgatgacggaaccatgcggattaaagatgacgagacagaaaatatcctcaccgtcctgcttaagacggctctgctgatcgtgtctggcattttcccgtactccatccctgccaccctcctggtctggcacacatggcagaaacagacccaacgcagcggcgtgctttgggatgttccctctcctcccgagacacagaaggccgaactggaggagggggtgtatagaattaaacagcagggaatcctcggcaagacccaagtcggggtgggagttcagaaggaaggcgtgtttcatacaatgtggcacgtcacgcggggggctgtgctgacccacaacggaaaacgcctcgagccgaattgggcctccgtgaagaaagacctgattagctacggcggcgggtggagactttctgcgcagtggcaaaagggagaagaggttcaggtcatcgctgtggaacctggcaaaaaccccaagaatttccagacaatgcctgggacctttcagaccacaacgggagagattggcgccatcgccctggatttcaagcccgggacctccggaagccccatcattaaccgggagggcaaagtggtcggcctgtatgggaatggagtggttacaaagaacggcgggtacgtgtccggaatcgctcaaaccaatgccgaacctgacggcccgacacccgagctcgaagaggaaatgttcaaaaagcgcaacctgaccattatggatcttcatcctgggagcggcaaaacgagaaagtatctgcccgctatcgtccgggaggccattaagcgcagactccggacactgatcctcgcgcctaccagagtggttgccgctgagatggaagaggccctgaaaggacttcccatccgctaccagaccacagctaccaagtctgaacacacaggccgggagattgtggacctgatgagacatgccacctttacgatgcgcctgctcagccctgtccgggtgccgaattataacctgatcattatggatgaagcccacttcacagaccccgcttccatcgcggccagagggtacatttctacccgcgttggaatgggcgaggctgccgccatctttatgacagctacccctcccgggacggccgatgcgttccctcagagcaatgctcccatccaggacgaggaacgggacattccggagagatcctggaactctggaaatgaatggatcaccgattttgccggcaaaacagtgtggttcgtccctagcattaaggccgggaacgacatcgctaactgccttcgcaaaaatggcaagaaggtgattcaactgtcccggaaaacctttgatacagagtaccagaagaccaaactcaacgactgggatttcgtggtcacaaccgacatctctgagatgggagccaattttaaggcggatagagttattgacccccggcgctgtctgaaacccgtgatcctgacggatggccctgaaagagtgatcctcgccgggcccatgcctgtcacagtggctagcgccgctcagcggcgcggaagagttggccggaacccgcagaaggagaatgaccaatatattttcaccgggcagccccttaacaatgatgaagaccatgcccactggaccgaggctaagatgctgctggacaacatcaatacacctgaaggaattatccccgccctctttgagcctgagagagaaaaatccgcggccattgatggcgagtaccgcctgaagggggaaagccggaaaaccttcgtggagcttatgagacgcggcgacctgcccgtctggctcgctcacaaggtggcctctgaaggaatcaaatatacagatcggaagtggtgcttcgacggccagagaaacaatcagatcctggaggagaacatggatgttgaaatttggacgaaagagggggaaaagaagaaactgcgcccgcggtggctcgacgctagaacctactccgatcctcttgccctgaaggagtttaaagacttcgccgctggacgcaagagcatcgcgctggatctcgtgacagaaattggcagagtcccctctcatctggcccaccggacccgcaatgctcttgacaacctggtgatgctccatacatccgagcacgggggaagagcctatcggcacgccgtcgaggaactgcctgagaccatggaaacgctgctccttctgggcctgatgatcctcctgaccggcggggctatgctttttctgattagcggaaaaggcatcgggaagacatccatcggactcatttgcgtgatcgcctctagcggcatgctgtggatggcggagattcccctgcaatggatcgcctccgctattgttctcgagttctttatgatggtgcttctgatccctgaacccgagaagcagcgcaccccgcaggataatcaactggcctacgtggtcattgggatcctcacactggctgccatcattgcggccaacgaaatgggacttctggagaccacgaaaagagacctcggcatgagcaaggaacctggcgttgtgtctcccacatcctatctggatgtggacctgcatcccgctagcgcctggaccctctacgctgtcgccacaaccgtgatcacccctatgcttcggcacacaattgagaattctacggctaacgttagcctggccgcgatcgccaaccaggctgtggtcctgatggggctcgacaaaggatggccgatttccaagatggatctgggcgtgccccttctggccctcgggtgttactctcaggtcaatcctctgaccctgacagctgccgtgctccttctggttacccattatgccatcatcggacccggcctgcaggcgaaagctacaagagaggcccaaaagcgcaccgctgccgggattatgaagaaccctacggtggacggaatcattacaatcgatctcgaccccgtcatttacgatagcaaattcgaaaagcagctgggccaggtgatgcttctggttctctgcgccgtgcagctgctgctcatgcggacctcctgggctctttgtgaggccctgaccctggcgacaggccctatcaccacactctgggaagggtctccgggaaaattttggaatacgaccatcgccgtcagcatggctaacattttcagaggctcctatctggccggggctggacttgcctttagcatcatgaagtctgtgggcacagggaaacgcggaaccggctcccaaggcgagacactgggggaaaagtggaagaaaaagctcaatcagctgagccggaaagagttcgacctgtacaagaaatccggaattaccgaggtggatagaacggaagcgaaggagggcctcaaacggggggaaaccacacaccatgccgtttctcgcggaagcgctaagcttcagtggtttgtcgagagaaacatggtgatccccgaaggccgggtgattgacctggggtgcggacgcggcggctggtcctattactgtgccgggctgaagaaagtcaccgaggttagaggatatacaaagggcgggcctggacacgaggaacccgtgcctatgtctacccacggctggaatatcgtgaaactcatgagcgggaaggatgtcttctacctgcccccggagaaatgcgacacacttctgtgtgatattggagaatccagcccttctcccaccgtggaggagtcccggacgatccgcgttctcaagatggtggaaccctggctgaagaacaatcagttttgcatcaaagtcctgaacccttacatgcccgctgtgattgagcatctcgaaagacttcaacggaagcacggcggcatgctggttcgcaatcctctgagcagaaactctacacatgagatgtattggatctccaatgggaccggaaacattgtgagctctgtcaatatggtgagccggctcctgcttaacagattcaccatgacacaccgccggccgacgatcgaaaaagacgtggatctgggcgccgggaccagacacgtcaacgctgagcccgagacacctaatatggacgttattggagaacgcatccggagaatcaaggaggaacataactccacctggcactacgacgatgagaatccctataaaacatgggcctaccatggctcttatgaagtgaaggcgaccgggagcgcctccagcatgattaacggagtggtcaagctcctgacaaaaccttgggacgtggttcccatggtgacccagatggctatgacggataccacaccgttcggccagcaacgcgtctttaaggagaaagtggacacccggacacctagacccatgcctggcacccgcaaggttatggagatcacggccgaatggctgtggcggacactcgggagaaataaacgcccccggctgtgtaccagagaggaattcacaaagaaggtgcgcaccaacgctgccatgggagccgtctttacggaggaaaatcagtgggattccgcgaaagctgccgtggaggacgaggaattctggaagcttgttgatagagagcgggaactgcacaaactcggcaagtgcgggtcttgtgtgtacaacatgatgggaaaacgcgagaagaaactgggcgagtttgggaaggccaagggcagcagagctatttggtatatgtggcttggagcccggtacctggaattcgaggctctcggctttctgaatgaagaccattggttctccagagagaactcttacagcggggtcgaaggagagggcctgcacaaactcgggtatatcctgcgggatatttccaagatccctggaggcgccatgtacgcggacgataccgccgggtgggacacacgcatcaccgaggacgatcttcacaatgaagagaaaattacacagcagatgaaccccgaacatagactgctcgctaatgccatctttaagctgacctatcaaaacaaagtggtcaaggtgcagcggccgacacctaccggcacggttatggacattatctctcgcaaggatcagagaggaagcggccaggtggggacatacggacttaataccttcaccaacatggaggctcaactggtccggcagatggaaggcgagggggtgctctccaaagccgacctggagaacccccacctgcccgaaaagaaaattacacagtggctcgagaccaagggagtggaacgcctgaaaagaatggcgatcagcggcgatgactgcgttgtgaagcctatcgatgaccggtttgccaatgctcttctggccctcaacgatatggggaaggtccgcaaagacattccgcagtggcaaccctctaagggctggcatgattggcagcaggtgcctttctgctcccaccactttcatgagctgatcatgaaagacggaagaaagcttgttgtgccctgtcggcctcaggatgaactgattggccgcgctagaatcagccaaggggccggatggtctctccgggagacagcttgcctgggcaaagcctatgcgcagatgtggtccctgatgtacttccaccgcagagacctccggctggccagcaatgctatttgttctgccgtccccgtgcattgggtccctacgtccagaaccacatggagcatccacgcccatcaccagtggatgaccacagaggacatgcttaccgtgtggaaccgcgtttggattgaagataatccctggatggaggacaagacgccggtgaccacatgggaaaacgtcccttatctggggaagcgggaggatcaatggtgcggatccctcatcggcctgaccagcagagctacatgggcccagaatatctctaccgcgattcagcaggtgcgcagccttatcgggaacgaggaattcctggactacatgccctccatgaaacggtttagaaaggaggaagagtctgaaggcgctatttggtga

SEQ ID NO: 20874 - RNA, 9873 nt, synthetic construct
  misc_feature 1..9873: note = derived and/or modified CDS sequence (opt5) from DENV-3__KJ622197__SS-prME
  source 1..9873: mol_type = other RNA
accagcctgtgcctcatgatgatgctgcccgccacccttgctttccacctgacgagccgggacggcgaacctcggatgatcgtggggaagaacgaacgcggaaagtctctcctgtttaagaccgccagcggcattaatatgtgtacccttatcgcgatggatctgggggaaatgtgcgacgataccgtcacatacaagtgtccgctcattgctgaagttgaacccgaagacatcgattgctggtgtaacctgacctccacatgggtgacctatggaacgtgcaatcaggccggcgagcatcggcgggacaagcgctctgtggccctggctcctcacgtcgggatgggactcgatacccggacacaaacctggatgagcgccgagggcgcttggagacaggtggaaaaagttgagacatgggccctgcgccatcccggcttcaccattcttgcgctgtttctcgcccactacatcgggacgtccctgacacagaaggtggtcatcttcattcttctgatgctcgtgaccccttctatggctatgagatgtgttggagtgggcaaccgggactttgtcgaagggctgagcggagccacatgggtggatgtggtcctggagcatggcgggtgcgttaccaccatggctaagaataaacccacactcgacatcgagctgcagaagacggaagccacccaacttgcgacactgcgcaaactctgtattgagggaaagatcaccaacattacaaccgattccagatgccctacgcagggcgaagccatcctgccggaggaacaggaccagaattatgtgtgtaaacacacatacgtggatcggggctgggggaacggatgcggccttttcgggaagggaagcctggtgacatgcgctaagtttcaatgtctcgagtctattgagggcaaagtggttcagcacgaaaatctgaagtataccgtgacaatcaccgtccatacaggggaccagcaccaggtgggaaacgacacgcaaggcgttaccgccgagatcacaccccaggcttccaccgtggaagccattctgcctgagtacggcacactcgggctggaatgcagcccccgcaccggacttgatttcaatgagatgatcctgctcacgatgaaaaacaaggcctggatggtccatagacagtggtttttcgacctgcctcttccctggacctctggcgctattacagagaccccgacatggaatcggaaagaactgctcgtgacctttaagaacgcgcacgccaaaaagcaagaggtcgtggttctggggtcccaggaaggagctatgcacacggccctgacaggcgccaccgagatccagaatagcgggggcacatctattttcgctggacatctcaagtgtcgcctgaaaatggataaacttgaactgaaaggcatgtcctatgccatgtgcctcaacacctttgtgctgaagaaagaggtcagcgagacccagcacgggacaatcctgatcaaggtggaatacaagggagaggacgcgccttgtaaaattcccttctccacggaagatggccaagggaaggctcataacggaagacttatcaccgccaatcctgttgtgaccaagaaggaggagcccgtcaacattgaagccgagccccctttcggcgaatctaatatcgtgattgggatcggcgacaaagctctcaagatcaactggtacaagaaaggaagctccattggcaagatgtttgaggccaccgctagaggggccagacgcatggcgatcctgggagatacagcctgggacttcggcagcgtcggcggggttctcaattctctcgggaaaatggtccaccagatttttgggtccgcttataccgccctgttcggcggagtgagctggatcatgaagattggcatcggggtgcttctgacgtggattggactcaactctaaaaatacaagcatgtccttttcttgcatcgtcatcggcattatcaccctgtacctggggaccgtggttcaggctgatatgggatgtgtgattaactggaagggcaaggaacttaaatgcgggagcggcatcttcgtcacaaatgaggtgcatacctggacagagcagtataagtttcaagccgactccccgaaacggctcgcgacggccattgctggagcctgggaaaacggcgtttgtgggatcagaagcaccacacgcatggagaatctgctgtggaagcagatcgctaacgaactcaattacattctgtgggagaacaatatcaaacttaccgtggtcgtgggagatattatcggcgttctggaacaggggaagcggacactcacaccccagcctatggagctgaaatattcttggaagacgtggggaaaggccaaaattgtgaccgccgagatccaaaactccagcttcatcattgacggccccaacacacctgaatgcccctctgcttccagagcgtggaatgtctgggaggtggaagactacggctttggggtgttcaccacaaacatctggctgaaacttcgcgaggtctatacccagacatgtgatcaccggctcatgagcgccgctattaaagacgaaagagccgttcacgccgatatgggatactggatcgagtcccagaagaatggctcttggaaactggagaaggctagctttattgaagtgaagacctgcacgtggccgaaatcccatacactgtggtctaacggggtgctcgagagcgacatgatcatccctaagtccctggccggacccattagccagcacaatcatcgccctggctaccacacccaaaccgcggggccctggcaccttggaaaactggaactcgatttcaactattgcgagggcacaaccgtcgtgatcacggagaattgtggcacacgggggccttctctgagaaccacaaccgtttccggaaagctgattcatgaatggtgctgtcgcagctgcacacttcccccgctccggtacatgggcgaggacgggtgttggtatggaatggaaatcagacctattaacgagaaagaagagaatatggtgaagtctctggtctccgctggcagcgggaaggtggataactttaccatgggagttctgtgcctcgccatcctgttcgaggaagtgatgcggggcaaattcggcaagaaacacatgattgccggggtccttctgacgtttatgctcctgctgtctggacagatcacctggcgcgacatggctcatacacttatcatgattggcagcaatgcctccgatagaatggggatgggagtgacctacctggcgctcatcgctacattcaagattcagccctttctggccctcggcttctttctgcggaaacttaccagcagagagaacctgctcctgggggttggactggccatggctacgacacttcaactgcccgaagacatcgagcagatggccaatggcattgctctcggcctgatggccctcaagctgatcacccagttcgaaacatatcagctttggaccgcgctggtgtctctcacctgttccaacacaatctttacgctgaccgtcgcctggcgcacagctaccctgattcttgccggggtgagcctgctccctgtgtgccaatcctctagcatgcggaagacagattggctgccggtcgctgttgccgccatgggagtgccccctctccccctgttcatcttttcccttaaagacaccctgaagagacgctcttggcctctgaatgagggcgtgatggctgtcgggctcgtgagcattctggcgtcctctcttctgagaaacgatgttcccatggccggacctctcgtggctggcgggctgctcatcgcctgttacgtcattacgggaacaagcgccgacctgaccgtggagaaagctgccgacgttacctgggaagaggaagcggagcagacaggcgtgtcccacaaccttatgatcaccgtcgatgacgatggcacaatgcggatcaaggacgatgaaacggagaatattctgaccgtgctgctcaaaacagctctgcttatcgtcagcgggattttcccctattctatcccggccaccctgctcgtgtggcatacatggcagaagcagacccaacgctccggagttctgtgggacgtgccttctccccctgagacgcagaaagccgaactcgaggaaggcgtctacagaattaagcagcaggggatctttggaaagacccaagtgggcgttggggtgcagaaagagggagtcttccacacaatgtggcacgtgacccggggcgctgtgctgacacataacggcaagcgccttgagcccaattgggcctccgttaaaaaggatctgatttcctacgggggaggctggagactgagcgcgcagtggcaaaaaggggaagaggtccaggtgatcgctgtggaaccgggacggaaccctaagaattttcagaccatgcccggcatcttccagacaacgaccggggagattggagccatcgccctcgacttcaagcctggcacatctggctcccccattatcaaccgcgaagggaaagtcgtgggactgtatggcaatggggttgtgaccaagaacggaggctacgtcagcgggattgctcaagccaatgctgagcccgatggccctaccccggagcttgaagaggaaatgtttaaaaagagaaacctgacaatcatggacctccaccccggatccggcaaaacgcggaagtatctgcctgccatcgtgcgcgaggcgattaagagacggctcagaaccctgatccttgcccccacacgcgttgtggctgccgaaatggaggaggctctgaaagggctgcctattcggtaccagaccacagccaccaagagcgaacatacgggaagagagatcgtcgatctcatgtgccacgccacattcaccatgcgcctgctttctcccgtgcgggttcctaattataacctgattatcatggacgaagctcattttaccgatccggcgagcatcgccgctagaggctacatttccacacgcgtggggatgggagaggccgccgctatcttcatgaccgccacaccccctggcaccgcggaggcttttccccagtctaatgcccctattcaggacgaggagcgggacatccccgaaagaagctggaactccgggaatgagtggattacggatttcgtcggcaaaacagtgtggtttgtgccgtctatcaaggccggaaacgacattgctaactgtctccgcaaaaatggcaagaaggtcatccaactgagccggaaaaccttcgatacagaatatcagaagaccaaactgaacgactgggattttgttgtgacgaccgacatctccgagatgggggccaatttcaaggcggatagagtgattgaccctcggcgctgcctcaaacccgtcatccttacagatggacccgagagagtgattctggccggccctatgcccgttaccgctgcctctgctgcccagcggcgcgggagagtgggacggaaccctcagaaggaaaatgaccaatacatctttacaggccagccgctgaacaatgatgaggaccacgctcactggaccgaagccaagatgctcctggacaacattaatacacccgaggggatcatccctgcgcttttcgaacccgagagagagaaaagcgccgctattgatggcgaataccgcctgaagggagagtcccggaaaaccttcgtcgaactcatgagacgcggcgacctgcctgtgtggctggcccataaggttgctagcgaggggatcaaatatacggatcggaagtggtgctttgacggagaaagaaacaatcagattctcgaggagaacatggatgtggaaatctggacaaaagagggcgaacgcaagaaacttcggcccagatggctggacgcccgcacctactctaatccgctggccctcaaagagttcaaggattttgctgcggggagaaaatccattgccctggaccttgtcaccgaaatcggacgggtgcctagccacctggctcatcgcacaagaaacgccctcgataatctggtcatgctgcacacctctgagcacggcggccgggcctatcgccatgctgtggaggaactccccgagacaatggaaacgcttctgctgctcgggctgatgatccttctgaccggaggcgccatgctgttcctgatttccgggaagggaatcggcaaaacaagcattgggctgatctgtgttattgtgtcctctggaatgctctggatggcggacgtgcctcttcagtggatcgccagcgctattgtcctggagtttttcatgatggttctgctcatccccgagcctgaaaagcaaagaacaccccaggataaccagctggcctacgtggtgatcggcattcttacactggctgccatcgtcgcggccaatgagatgggcctcctggaaaccacgaagcgggacctggggatgtccaaagagccgggagtggttagccctacctcttatctcgatgtggaccttcaccccgcttccgcctggacactgtacgctgtcgccaccacagtgattacccccatgctgagacatacgatcgaaaacagcacagctaacgtctctctcgccgcgattgccaatcaagctgtggttctgatgggccttgacaaggggtggcctatcagcaaaatggatctgggagtgccgctcctggccctgggctgctattcccaggtcaaccccctcacccttacagctgccgtgctgctgctcgttacccactacgccatcattgggcctggactgcaggcgaaggctacccgcgaggcccagaaacggacagctgccggcatcatgaagaatcccacggtggacggcattatgaccatcgatcttgaccctgtcatttacgattctaagtttgagaaacaactgggacaggtgatgctcctggtgctgtgtgccgttcagctccttctgatgagaacaagctgggctctgtgcgaagccctcaccctggcgacaggacccatcaccacgctttgggagggctcccctgggaagttctggaacacaaccatcgccgtctctatggctaatatttttcgcggaagctatctggccggcgctgggctcgccttctccatcatgaaaagcgtgggaaccggcaagcggggcacagggtctcagggagaaaccctgggcgagaaatggaagaagaaactgaaccaactctccagacgggaatttgagctttacaagaaaagcgggattacagaggtggaccgcacggaagcgaaggagggactgaaaagaggcgaaaccacacatcacgccgtctcccgggggtctgctaagctgcagtggttcgttgagcgcaatatggtgatcccggaaggaagagtgattgatctcggctgtggcagagggggatggagctattactgcgccggcctgaaaaaggtcaccgaggtgcgcgggtatacaaagggaggccccgggcacgaggaacctgttcccatgtccacctacggatggaacacggtgaaacttatgtctggcaaggacgtcttttatctgcctcccgagaaatgtgataccctcctgtgcgacatcggcgaaagctccccgagccctacagtggaggagtctagaaccattcgggttctgaagatggtggaaccctggctcaaaaataaccagttctgtatcaaggtccttaatccctacatgcctacagtgatcgagcatctggaacgcctgcagagaaagcacgggggaatgctcgtgcggaaccccctgtccagaaatagcacccatgagatgtactggatttctaacggcacagggaatatcgtctccagcgttaacatggtgtctcgccttctgctcaaccggttcaccatgacgcacagacgccctacaattgaaaaagatgtggacctgggagctggcacccggcacgtcaatgccgagccggagacccccaacatggatgtgatcggggaaagaattaagcgcatcaaagaggaacatagctccacatggcactatgacgacgagaatccttacaagacgtgggcttatcatggatcttacgaagttaaagccaccggcagcgcgtccagcatgatcaacggcgtggtcaagctgctcacaaagccctgggatgtggttcctatggtgacccaaatggccatgacagacaccacaccctttgggcagcagcgggtcttcaaagagaaggtggataccagaacgccgcgccctatgcccggaacccggaaagttatggagattacagctgaatggctgtggagaacccttggccgcaataagcggcctagactgtgcacacgcgaggaatttaccaaaaaggtgagaacgaacgccgctatgggggccgtcttcacagaggaaaatcaatgggagtccgcccgggcggctgtggaggacgaagagttttggaagctcgtcggacgcgaaagagagctgcacaaacttggcaagtgtgggtcttgcgtgtataacatgatgggcaaacgggagaagaaactgggagagttcggcaaggccaaagggagcagagccatctggtacatgtggctcggagctcggtatctggagtttgaagccctgggcttcctcaatgaggatcattggttttcccgcgaaaactcttacagcggggttgagggagagggcctgcacaaacttgggtacattctgagagacatctccaagattcccggcggagctatgtatgccgatgacaccgcgggctgggatacacggatcaccgaagacgatctccacaatgaggagaagatcacgcagcagatggaccctgagcatcgccagctggccaacgctattttcaaacttacctaccaaaataaagtggtcaaggtgcagagacccacaccgaaagggaccgtgatggacatcatttctcggaaggatcagcgcggaagcggccaggttgggacatatggactgaacacctttacaaatatggaagcccaactcatcagacagatggagggcgagggggtgctgtccaaggctgacctggaaaaccctcacctcctggagaaaaagattacccagtggcttgaaacgaaaggcgtcgagcggctgaagcgcatggccatcagcggagatgactgcgtggttaaacccatcgatgacagattcgcgaacgccctcctggctcttaatgatatgggcaaggtgcggaaggacattccccagtggcaaccttctaaagggtggcatgattggcagcaggtcccgttttgttcccaccacttccatgaactgatcatgaaggacggacgcaaactcgtggtcccctgcagacctcaggatgagctgattggccgggcccgcatcagccaaggggctggatggtctctgaaggagacagcctgtctcggcaaggcttacgcccagatgtggtccctgatgtatttccacagacgggaccttagactggcgagcaacgccatttgctctgctgtgcccgttcattgggtgcctacctcccgcaccacatggagcatccacgcccatcaccagtggatgaccacagaagatatgctcacggtctggaatcgggtgtggattgaggacaacccctggatggaagacaagacccctgttacaacctgggaggatgtgccctacctggggaagagagaggaccaatggtgtggctcccttatcggactgacaagccgcgccacctgggctcagaatatcctcacggccattcagcaggtccggtctctgatcggcgatgaagagtttctggactatatgccgagcatgaaaagattccgcaaggaagaggaatccgagggggcgatttggtga

SEQ ID NO: 20875 - RNA, 9873 nt, synthetic construct
  misc_feature 1..9873: note = derived and/or modified CDS sequence (opt5) from DENV-3__KJ622198__SS-prME
  source 1..9873: mol_type = other RNA
accagcctgtgcctcatgatgatgctgcccgccacccttgctttccacctgacgagccgggacggcgaacctcggatgatcgtggggaagaacgaacgcggaaaatctctcctgtttaagaccgccagcggcattaatatgtgtacccttatcgcgatggatctgggggaaatgtgcgacgataccgtcacatacaaatgtccgctcattgctgaagttgaacccgaagacatcgattgctggtgtaacctgacctccacatgggtgacctatggaacgtgcaatcaggccggcgagcaccggcgggacaagcgctctgtggccctggctcctcacgtcgggatgggactcgatacccggacacaaacctggatgagcgccgagggcgcttggagacaggtggaaaaagttgagacatgggccctgcgccatcccggcttcaccattcttgcgctgtttctcgcccactacatcgggacgtccctgacacagaaggtggtcatcttcattcttctgatgctcgtgaccccttctatggctatgagatgtgttggagtgggcaaccgggactttgtcgaagggctgagcggagccacatgggtggatgtggtcctggagcatggcgggtgcgttaccaccatggctaagaataaacccacactcgacatcgagctgcagaagacggaagccacccaacttgcgacactgcgcaaactctgtattgagggaaagatcaccaacattacaaccgattccagatgccctacgcagggcgaagccatcctgccggaggaacaggaccagaattatgtgtgtaaacacacatacgtggatcggggctgggggaacggatgcggccttttcgggaagggaagcctggtgacatgcgctaagtttcaatgtctcgagtctattgagggcaaagtggttcagcacgaaaatctgaagtataccgtgacaatcaccgtccatacaggggaccagcaccaggtgggaaacgacacgcaaggcgttaccgccgagatcacaccccaggcttccaccgtggaagccattctgcctgagtacggcacactcgggctggaatgcagcccccgcaccggacttgatttcaatgagatgatcctgctcacgatgaaaaacaaggcctggatggtccatagacagtggtttttcgacctgcctcttccctggacctctggcgctattacagagaccccgacatggaatcggaaagaactgctcgtgacctttaagaacgcgcacgccaaaaagcaagaggtcgtggttctggggtcccaggaaggagctatgcacacggccctgacaggcgccaccgagatccagaatagcgggggcacatctattttcgctggacatctcaagtgtcgcctgaaaatggataaacttgaactgaaaggcatgtcctatgccatgtgcctcaacacctttgtgctgaagaaagaggtcagcgagacccagcacgggacaatcctgatcaaggtggaatacaagggagaggacgcgccttgtaaaattcccttctccacggaagatggccaagggaaggctcataacggaagacttatcaccgccaatcctgttgtgaccaagaaggaggagcccgtcaacattgaagccgagccccctttcggcgaatctaatatcgtgattgggatcggcgacaaagctctcaagatcaactggtacaagaaaggaagctccattggcaagatgtttgaggccaccgctagaggggccagacgcatggcgatcctgggagatacagcctgggacttcggcagcgtcggcggggttctcaattctctcgggaaaatggtccaccagatttttgggtccgcttataccgccctgttcggcggagtgagctggatcatgaagattggcatcggggtgcttctgacgtggattggactcaactctaaaaatacaagcatgtccttttcttgcatcgtcatcggcattatcaccctgtacctggggaccgtggttcaggctgatatgggatgtgtgattaactggaagggcaaggaacttaaatgcgggagcggcatcttcgtcacaaatgaggtgcatacctggacagagcagtataagtttcaagccgactccccgaaacggctcgcgacggccattgctggagcctgggaaaacggcgtttgtgggatcagaagcaccacacgcatggagaatctgctgtggaagcagatcgctaacgaactcaattacattctgtgggagaacaatatcaaacttaccgtggtcgtgggagatattatcggcgttctggaacaggggaagcggacactcacaccccagcctatggagctgaaatattcttggaagacgtggggaaaggccaaaattgtgaccgccgagatccaaaactccagcttcatcattgacggccccaacacacctgaatgcccctctgcttccagagcgtggaatgtctgggaggtggaagactacggctttggggtgttcaccacaaacatctggctgaaacttcgcgaggtctatacccagacatgtgatcaccggctcatgagcgccgctattaaagacgaaagagccgttcacgccgatatgggatactggatcgagtcccagaagaatggctcttggaaactggagaaggctagctttattgaagtgaagacctgcacgtggccgaaatcccatacactgtggtctaacggggtgctcgagagcgacatgatcatccctaagtccctggccggacccattagccagcacaatcatcgccctggctaccacacccaaaccgcggggccctggcaccttggaaaactggaactcgatttcaactattgcgagggcacaaccgtcgtgatcacggagaattgtggcacacgggggccttctctgagaaccacaaccgtttccggaaagctgattcatgaatggtgctgtcgcagctgcacacttcccccgctccggtacatgggcgaggacgggtgttggtatggaatggaaatcagacctattaacgagaaagaagagaatatggtgaagtctctggtctccgctggcagcgggaaggtggataactttaccatgggagttctgtgcctcgccatcctgttcgaggaagtgatgcggggcaaattcggcaagaaacacatgattgccggggtccttctgacgtttatgctcctgctgtctggacagatcacctggcgcgacatggctcatacacttatcatgattggcagcaatgcctccgatagaatggggatgggagtgacctacctggcgctcatcgctacattcaagattcagccctttctggccctcggcttctttctgcggaaacttaccagcagagagaacctgctcctgggggttggactggccatggctacgacacttcaactgcccgaagacatcgagcagatggccaatggcattgctctcggcctgatggccctcaagctgatcacccagttcgaaacatatcagctttggaccgcgctggtgtctctcacctgttccaacacaatctttacgctgaccgtcgcctggcgcacagctaccctgattcttgccggggtgagcctgctccctgtgtgccaatcctctagcatgcggaagacagattggctgccggtcgctgttgccgccatgggagtgccccctctccccctgttcatcttttcccttaaagacaccctgaagagacgctcttggcctctgaatgagggcgtgatggctgtcgggctcgtgagcattctggcgtcctctcttctgagaaacgatgttcccatggccggacctctcgtggctggcgggctgctcatcgcctgttacgtcattacgggaacaagcgccgacctgaccgtggagaaagctgccgacgttacctgggaagaggaagcggagcagacaggcgtgtcccacaaccttatgatcaccgtcgatgacgatggcacaatgcggatcaaggacgatgaaacggagaatattctgaccgtgctgctcaaaacagctctgcttatcgtcagcgggattttcccctattctatcccggccaccctgctcgtgtggcatacatggcagaagcagacccaacgctccggagttctgtgggacgtgccttctccccctgagacgcagaaagccgaactcgaggaaggcgtctacagaattaagcagcaggggatctttggaaagacccaagtgggcgttggggtgcagaaagagggagtcttccacacaatgtggcacgtgacccggggcgctgtgctgacacataacggcaagcgccttgagcccaattgggcctccgttaaaaaggatctgatttcctacgggggaggctggagactgagcgcgcagtggcaaaaaggggaagaggtccaggtgatcgctgtggaaccgggacggaaccctaagaattttcagaccatgcccggcatcttccagacaacgaccggggagattggagccatcgccctcgacttcaagcctggcacatctggctcccccattatcaaccgcgaagggaaagtcgtgggactgtatggcaatggggttgtgaccaagaacggaggctacgtcagcgggattgctcaagccaatgctgagcccgatggccctaccccggagcttgaagaggaaatgtttaaaaagagaaacctgacaatcatggacctccaccccggatccggcaaaacgcggaagtatctgcctgccatcgtgcgcgaggcgattaagagacggctcagaaccctgatccttgcccccacacgcgttgtggctgccgaaatggaggaggctctgaaagggctgcctattcggtaccagaccacagccaccaagagcgaacatacgggaagagagatcgtcgatctcatgtgccacgccacattcaccatgcgcctgctttctcccgtgcgggttcctaattataacctgattatcatggacgaagctcattttaccgatccggcgagcatcgccgctagaggctacatttccacacgcgtggggatgggagaggccgccgctatcttcatgaccgccacaccccctggcaccgcggaggcttttccccagtctaatgcccctattcaggacgaggagcgggacatccccgaaagaagctggaactccgggaatgagtggattacggatttcgtcggcaaaacagtgtggtttgtgccgtctatcaaggccggaaacgacattgctaactgtctccgcaaaaatggcaagaaggtcatccaactgagccggaaaaccttcgatacagaatatcagaagaccaaactgaacgactgggattttgttgtgacgaccgacatctccgagatgggggccaatttcaaggcggatagagtgattgaccctcggcgctgcctcaaacccgtcatccttacagatggacccgagagagtgattctggccggccctatgcccgttaccgctgcctctgctgcccagcggcgcgggagagtgggacggaaccctcagaaggaaaatgaccaatacatctttacaggccagccgctgaacaatgatgaggaccacgctcactggaccgaagccaagatgctcctggacaacattaatacacccgaggggatcatccctgcgcttttcgaacccgagagagagaaaagcgccgctattgatggcgaataccgcctgaagggagagtcccggaaaaccttcgtcgaactcatgagacgcggcgacctgcctgtgtggctggcccataaggttgctagcgaggggatcaaatatacggatcggaagtggtgctttgacggagaaagaaacaatcagattctcgaggagaacatggatgtggaaatctggacaaaagagggcgaacgcaagaaacttcggcccagatggctggacgcccgcacctactctaatccgctggccctcaaagagttcaaggattttgctgcggggagaaaatccattgccctggaccttgtcaccgaaatcggacgggtgcctagccacctggctcatcgcacaagaaacgccctcgataatctggtcatgctgcacacctctgagcacggcggccgggcctatcgccatgctgtggaggaactccccgagacaatggaaacgcttctgctgctcgggctgatgatccttctgaccggaggcgccatgctgttcctgatttccgggaagggaatcggcaaaacaagcattgggctgatctgtgttattgtgtcctctggaatgctctggatggcggacgtgcctcttcagtggatcgccagcgctattgtcctggagtttttcatgatggttctgctcatccccgagcctgaaaagcaaagaacaccccaggataaccagctggcctacgtggtgatcggcattcttacactggctgccatcgtcgcggccaatgagatgggcctcctggaaaccacgaagcgggacctggggatgtccaaagagccgggagtggttagccctacctcttatctcgatgtggaccttcaccccgcttccgcctggacactgtacgctgtcgccaccacagtgattacccccatgctgagacatacgatcgaaaacagcacagctaacgtctctctcgccgcgattgccaatcaagctgtggttctgatgggccttgacaaggggtggcctatcagcaaaatggatctgggagtgccgctcctggccctgggctgctattcccaggtcaaccccctcacccttacagctgccgtgctgctgctcgttacccactacgccatcattgggcctggactgcaggcgaaggctacccgcgaggcccagaaacggacagctgccggcatcatgaagaatcccacggtggacggcattatgaccatcgatcttgaccctgtcatttacgattctaagtttgagaaacaactgggacaggtgatgctcctggtgctgtgtgccgttcagctccttctgatgagaacaagctgggctctgtgcgaagccctcaccctggcgacaggacccatcaccacgctttgggagggctcccctgggaagttctggaacacaaccatcgccgtctctatggctaatatttttcgcggaagctatctggccggcgctgggctcgccttctccatcatgaaaagcgtgggaaccggcaagcggggcacagggtctcagggagaaaccctgggcgagaaatggaagaagaaactgaaccaactctccagacgggaatttgagctttacaagaaaagcgggattacagaggtggaccgcacggaagcgaaggagggactgaaaagaggcgaaaccacacatcacgccgtctcccgggggtctgctaagctgcagtggttcgttgagcgcaatatggtgatcccggaaggaagagtgattgatctcggctgtggcagagggggatggagctattactgcgccggcctgaaaaaggtcaccgaggtgcgcgggtatacaaagggaggccccgggcacgaggaacctgttcccatgtccacctacggatggaacacggtgaaacttatgtctggcaaggacgtcttttatctgcctcccgagaaatgtgataccctcctgtgcgacatcggcgaaagcctgccgtcccctacagtggaggagagcagaaccattcgggttctcaagatggtggaaccctggcttaaaaataaccagttctgtatcaaggtcctgaatccctacatgcctacagtgatcgagcatctggaacgcctccagagaaagcacgggggaatgctggtgcggaaccccctttctagaaattccacccatgagatgtactggattagcaacggcacagggaatatcgtctcttccgttaacatggtgagccgcctgctcctgaaccggttcaccatgacgcacagacgccctacaattgaaaaagatgtggacctgggagctggcacccggcacgtcaatgccgagccggagacccccaacatggatgtgatcggggaaagaattaagcgcatcaaagaggaacattctagcacatggcactatgacgacgagaatccttacaagacgtgggcttatcatggatcctacgaagttaaagccaccggctctgcgagctccatgatcaacggcgtggtcaagctcctgacaaagccctgggatgtggttcctatggtgacccaaatggccatgacagacaccacaccctttgggcagcagcgggtcttcaaagagaaggtggataccagaacgccgcgccctatgcccggaacccggaaagttatggagattacagctgaatggctttggagaaccctgggccgcaataagcggcctagactctgcacacgcgaggaatttaccaaaaaggtgagaacgaacgccgctatgggggccgtcttcacagaggaaaatcaatgggagagcgcccgggcggctgtggaggacgaagagttttggaagctggtcggacgcgaaagagagcttcacaaactgggcaagtgtgggtcctgcgtgtataacatgatgggcaaacgggagaagaaactcggagagttcggcaaggccaaagggtctagagccatctggtacatgtggctgggagctcggtatctggagtttgaagccctcggcttcctgaatgaggatcattggtttagccgcgaaaactcctactctggggttgagggagagggccttcacaagctggggtacattctcagagacatcagcaagattcccggcggagctatgtatgccgatgacaccgcgggctgggatacacggatcaccgaagacgatctgcacaatgaggagaagatcacgcagcagatggaccctgagcatcgccagcttgccaacgctattttcaagctgacctaccaaaataaagtggtcaaggtgcagagacccacaccgaaagggaccgtgatggacatcatttcccggaaggatcagcgcggatctggccaggttgggacatatggactcaacacctttacaaatatggaagcccaactgatcagacagatggagggcgagggggtgctgagcaaggctgacctcgaaaaccctcatctgcttgagaaaaagattacccagtggctggaaacgaaaggcgtcgagcggctcaagcgcatggccatctccggagatgactgcgtggttaaacccatcgatgacagattcgcgaacgccctgcttgctctgaatgatatgggcaaggtgcggaaggacattccccagtggcaacctagcaaagggtggcatgattggcagcaggtcccgttttgttctcaccacttccatgaactcatcatgaaggacggacgcaaactggtggtcccctgcagacctcaggatgagctgattggccgggcccgcatctcccaaggggctggatggagcctcaaggagacagcctgtctgggcaaggcttacgcccagatgtggtctcttatgtatttccacagacgggacctgagactcgcgtccaacgccatttgcagcgctgtgcccgttcattgggtgcctacctctcgcaccacatggtccatccacgcccatcaccagtggatgaccacagaagatatgctgacggtctggaatcgggtgtggattgaggacaacccctggatggaagacaagacccctgttacaacctgggaggatgtgccctaccttgggaagagagaggaccaatggtgtggcagcctgatcggactcacatcccgcgccacctgggctcagaatatcctgacggccattcagcaggtccggagcctgatcggcgatgaagagtttctcgactatatgccgtctatgaaaagattccgcaaggaagaggaaagcgagggggcgatttggtga

SEQ ID NO: 20876 - RNA, 9873 nt, synthetic construct
  misc_feature 1..9873: note = derived and/or modified CDS sequence (opt5) from DENV-3__KJ622191__SS-prME
  source 1..9873: mol_type = other RNA
accagcctgtgcctcatgatgatgctgcccgccacacttgctttccacctgacgagccgggacggcgaacctcggatgatcgtggggaagaacgaacgcggaaagtctctcctgtttaagaccgccagcggcattaatatgtgtacccttatcgcgatggatctgggggaaatgtgcgacgataccgtcacatacaaatgtccgctcattgctgaagttgaacccgaagacatcgattgctggtgtaacctgacctccacatgggtgacctatggaacgtgcaatcaggccggcgagcatcggcgggacaagcgctctgtggccctggctcctcacgtcgggatgggactcgatacccggacacagacctggatgagcgccgagggcgcttggagacaggtggaaaaagttgagacatgggccctgcgccatcccggcttcaccattcttgcgctgtttctcgcccactacatcgggacgtccctgacacagaaggtggtcatcttcattcttctgatgctcgtgaccccttctatggctatgagatgtgttggagtgggcaaccgggactttgtcgaagggctgagcggagccacatgggtggatgtggtcctggagcatggcgggtgcgttaccaccatggctaagaataaacccacactcgacatcgagctgcagaagacggaagccacccagcttgcgacactgcgcaaactctgtattgagggaaagatcaccaacattacaaccgattccagatgccctacgcagggcgaagccatcctgccggaggaacaggaccagaattatgtgtgtaaacacacatacgtggatcggggctgggggaacggatgcggccttttcgggaagggaagcctggtgacatgcgctaagtttcaatgtctcgagtctattgagggcaaagtggttcagcacgaaaatctgaagtataccgtgacaatcaccgtccatacaggggaccagcaccaggtgggaaacgacacgcaaggcgttaccgccgagatcacaccccaggcttccaccgtggaagccattctgcctgagtacggcacactcgggctggaatgcagcccccgcaccggacttgatttcaatgaggtcatcctgctcacgatgaaaaacaaggcctggatggtgcatagacagtggtttttcgacctgcctcttccctggacctctggcgctattacagagaccccgacatggaatcggaaagaactgctcgtcacctttaagaacgcgcacgccaaaaagcaagaggtggttgtgctggggtcccaggaaggagctatgcacacggccctgacaggcgccaccgagatccagaatagcgggggcacatctattttcgctggacatctcaagtgtcgcctgaaaatggataaacttgaactgaaaggcatgtcctatgccatgtgcctcaacacctttgtcctgaagaaagaggtgagcgagacccagcacgggacaatcctgatcaaggttgaatacaagggagaggacgcgccttgtaaaattcccttctccacggaagatggccaagggaaggctcataacggaagacttatcaccgccaatcctgtggtcaccaagaaggaggagcccgtgaacattgaagccgagccccctttcggcgaatctaatatcgtgattgggatcggcgacaaagctctcaagatcaactggtacaagaaaggaagctccattggcaagatgtttgaggccaccgctagaggggccagacgcatggcgatcctgggagatacagcctgggacttcggcagcgttgggggagtcctcaattctctcggcaaaatggtgcaccagatttttgggtccgcttataccgccctgttcggcggagtgagctggatcatgaagattggcatcggggtccttctgacgtggattggactcaactctaaaaatacaagcatgtccttttcttgcatcgtgatcggcattatcaccctgtacctggggaccgttgtgcaggctgatatgggatgtgtcattaactggaagggcaaggaacttaaatgcgggagcggcatcttcgtgacaaatgaggttcatacctggacagagcagtataagtttcaagccgactccccgaaacggctcgcgacggccattgctggagcctgggaaaacggcgtgtgtgggatcagaagcaccacacgcatggagaatctgctgtggaagcagatcgctaacgaactcaattacattctgtgggagaacaatatcaaacttaccgtcgtggttggagatattatcggcgtgctggaacaggggaagcggacactcacaccccagcctatggagctgaaatattcttggaagacgtggggaaaggccaaaattgtcaccgccgagatccaaaactccagcttcatcattgacggccccaacacacctgaatgcccctctgcttccagagcgtggaatgtgtgggaggtggaagactacggctttggggtcttcaccacaaacatctggctgaaacttcgcgaggtttatacccagacatgtgatcaccggctcatgagcgccgctattaaagacgaaagagccgtgcacgccgatatgggatactggatcgagtcccagaagaatggctcttggaaactggagaaggctagctttattgaagtgaagacctgcacgtggccgaaatcccatacactgtggtctaacggggtcctcgagagcgacatgatcatccctaagtccctggccggacccattagccagcacaatcatcgccctggctaccacacccaaaccgcggggccctggcaccttggaaaactggaactcgatttcaactattgcgagggcacaaccgtggttatcacggagaattgtggcacacgggggccttctctgagaaccacaaccgtgtccggaaagctgattcatgaatggtgctgtcgcagctgcacacttcccccgctccggtacatgggcgaggacgggtgttggtatggaatggaaatcagacctattaacgagaaagaagagaatatggtcaagtctctggtgtccgctggcagcgggaaggttgataactttaccatgggagtgctgtgcctcgccatcctgttcgaggaagtcatgcggggcaaattcggcaagaaacacatgattgccggggtgcttctgacgtttatgctcctgctgtctggacagatcacctggcgcgacatggctcatacacttatcatgattggcagcaatgcctccgatagaatggggatgggagttacctacctggcgctcatcgctacattcaagattcagccctttctggccctcggcttctttctgcggaaacttaccagcagagagaacctgctcctgggggtgggactggccatggctacgacacttcaactgcccgaagacatcgagcagatggccaatggcattgctctcggcctgatggccctcaagctgatcacccagttcgaaacatatcagctttggaccgcgctggtctctctcacctgttccaacacaatctttacgctgaccgtggcctggcgcacagctaccctgattcttgccggggtgagcctgctccctgtctgccaatcctctagcatgcggaagacagattggctgccggttgctgtggccgccatgggagtgccccctctccccctgttcatcttttcccttaaagacaccctgaagagacgctcttggcctctgaatgagggcgtcatggctgtggggctcgttagcattctggcgtcctctcttctgagaaacgatgtgcccatggccggacctctcgtcgctggcgggctgctcatcgcctgttacgtgattacgggaacaagcgccgacctgaccgttgagaaagctgccgacgtgacctgggaagaggaagcggagcagacaggcgtctcccacaaccttatgatcaccgtggatgacgatggcacaatgcggatcaaggacgatgaaacggagaatattctgaccgtcctgctcaaaacagctctgcttatcgtgagcgggattttcccctattctatcccggccaccctgctcgtttggcatacatggcagaagcagacccaacgctccggagtgctgtgggacgtcccttctccccctgagacgcagaaagccgaactcgaggaaggcgtgtacagaattaagcagcaggggatctttggaaagacccaagttggcgtgggggtccagaaagagggagtgttccacacaatgtggcacgtgacccggggcgctgttctgacacataacggcaagcgccttgagcccaattgggcctccgtcaaaaaggatctgatttcctacgggggaggctggagactgagcgcgcagtggcaaaaaggggaagaggtccaggtgatcgctgtcgaaccgggacggaaccctaagaattttcagaccatgcccggcatcttccagacaacgatgggggagattggagccatcgccctcgacttcaagcctggcacctctggctcccccattatcaaccgcgaagggaaagtggttggactgtatggcaatggggtggtcacaaagaacggaggctacgtgagcgggattgctcaagccaatgctgagcccgatggccctaccccggagcttgaagaggaaatgtttaaaaagagaaacctgaccatcatggacctccaccccggatccggcaaaacacggaagtatctgcctgccatcgttcgcgaggcgattaagagacggctcagaacgctgatccttgcccccacccgcgtggtcgctgccgaaatggaggaggctctgaaagggctgcctattcggtaccagacaaccgccacaaagagcgaacataccggaagagagatcgtggatctcatgtgccacgccacgttcacaatgcgcctgctttctcccgttcgggtgcctaattataacctgattatcatggacgaagctcattttaccgatccggcgagcatcgccgctagaggctacatttccacccgcgtcgggatgggagaggccgccgctatcttcatgacagccacaccccctggcacagcggaggcttttccccagtctaatgcccctattcaggacgaggagcgggacatccccgaaagaagctggaactccgggaatgagtggattaccgatttcgtgggcaaaacggtgtggtttgtcccgtctatcaaggccggaaacgacattgctaactgtctccgcaaaaatggcaagaaggttatccaactgagccggaaaacattcgataccgaatatcagaagacaaaactgaacgactgggattttgtggtgaccacggacatctccgagatgggggccaatttcaaggcggatagagtcattgaccctcggcgctgcctcaaacccgtgatccttaccgatggacccgagagagttattctggccggccctatgcccgtgacagctgcctctgctgcccagcggcgcgggagagtcggacggaaccctcagaaggaaaatgaccaatacatctttaccggccagccgctgaacaatgatgaggaccacgctcactggacagaagccaagatgctcctggacaacattaatacccccgaggggatcatccctgcgcttttcgaacccgagagagagaaaagcgccgctattgatggcgaataccgcctgaagggagagtcccggaaaacattcgtggaactcatgagacgcggcgacctgcctgtttggctggcccataaggtggctagcgaggggatcaaatataccgatcggaagtggtgctttgacggagaaagaaacaatcagattctcgaggagaacatggatgtcgaaatctggacgaaagagggcgaacgcaagaaacttcggcccagatggctggacgcccgcacatactctgatccgctggccctcaaagagttcaaggactttgctgcggggagaaaatccattgccctggatcttgtgaccgaaatcggacgggtccctagccacctggctcatcgcaccagaaatgccctcgacaacctggtgatgctgcacacatctgagcacggcggccgggcctatcgccatgctgttgaggaactccccgagaccatggaaacacttctgctgctcgggctgatgatccttctgacgggaggcgccatgctgttcctgatttccgggaagggaatcggcaaaaccagcattgggctgatctgtgtgattgtgtcctctggaatgctctggatggcggatgtccctcttcagtggatcgccagcgctattgttctggagtttttcatgatggtgctgctcatccccgagcctgaaaagcaaagaacaccccaggacaatcagctggcctacgtggtcatcggcattcttaccctggctgccatcgtggcggccaacgagatgggcctcctggaaacaaccaagcgggatctggggatgtccaaagagccgggagttgtgagccctacgtcttatctcgacgtcgaccttcaccccgcttccgcctggaccctgtacgctgtggccacaaccgtcattacacccatgctgagacataccatcgaaaatagcacggctaacgtgtctctcgccgcgattgccaaccaagctgttgtgctgatgggccttgataaggggtggcctatcagcaaaatggacctgggagtcccgctcctggccctgggctgctattcccaggtgaatcccctcacacttaccgctgccgttctgctgctcgtgacacactacgccatcattgggcctggactgcaggcgaaggctacccgcgaggcccagaaacggaccgctgccggcatcatgaagaaccccacagtcgatggcattatgacgatcgaccttgatcctgtgatttacgactctaagtttgagaaacaactgggacaggtgatgctcctggttctgtgtgccgtccagctccttctgatgagaaccagctgggctctgtgcgaagccctcacactggcgaccggacccatcacaaccctttgggagggctcccctgggaagttctggaatacgacaatcgccgtgtctatggctaacatttttcgcggaagctatctggccggcgctgggctcgccttctccatcatgaaaagcgtgggaaccggcaagcggggcaccgggtctcagggagaaacactgggcgagaaatggaagaagaaactgaatcaactctccagacgggaatttgagctttacaagaaaagcgggattaccgaggtcgatcgcacagaagcgaaggagggactgaaaagaggcgaaacgacccatcacgccgtttcccgggggtctgctaagctgcagtggttcgtggagcgcaacatggtgatcccggaaggaagagtcattgacctcggctgtggcagaggcgggtggagctattactgcgccgggctgaaaaaggtgacagaggttcgcgggtataccaagggaggccccgggcacgaggaacctgtgcccatgtccacatacggatggaataccgtcaaacttatgtctggcaaggatgtgttttatctgcctcccgagaaatgtgacacgctcctgtgcgatatcggcgaaagctccccgagccctaccgttgaggagtctagaacaattcgggtgctgaagatggtcgaaccctggctcaaaaacaatcagttctgtatcaaggtgcttaacccctacatgcctaccgtgatcgagcatctggaacgcctgcagagaaagcacgggggaatgctcgtccggaatcccctgtccagaaacagcacacatgagatgtactggatttctaatggcaccgggaacatcgtttccagcgtgaatatggtgtctcgccttctgctcaaccggttcacaatgacccacagacgccctacgattgaaaaagacgtcgatctgggagctggcacacggcacgtgaacgccgagccggagacccccaatatggacgttatcggggaaagaattaagcgcatcaaagaggaacatagctccacctggcactatgacgatgagaacccttacaagacatgggcttatcatggatcttacgaagtgaaagccacgggcagcgcgtccagcatgatcaatggcgtcgtgaagctgctcaccaagccctgggacgttgtgcctatggtcacacaaatggccatgaccgatacaaccccctttgggcagcagcgggtgttcaaagagaaggttgacacaagaaccccgcgccctatgcccggaacgcggaaagtgatggagattaccgctgaatggctgtggagaacacttggccgcaacaagcggcctagactgtgcacccgcgaggaatttaccaagaaggtcagaaccaatgccgctatgggggccgtgttcacggaggaaaaccaatgggagtccgcccgggcggctgtcgaggatgaagagttttggaagctcgtgggacgcgaaagagagctgcacaaacttggcaagtgtgggtcttgcgtttataatatgatgggcaaacgggagaagaaactgggagagttcggcaaggccaaagggagcagagccatctggtacatgtggctcggagctcggtatctggagtttgaagccctgggcttcctcaacgaggaccattggttttcccgcgaaaattcttacagcggggtggagggagagggcctgcacaaacttgggtacattctgagagatatctccaagattcccggcggagctatgtatgccgacgatacagcgggctgggacacccggatcacagaagatgacctccacaacgaggagaagatcacccagcagatggaccctgagcatcgccagctggccaatgctattttcaaacttacgtaccaaaacaaagtcgtgaaggtgcagagacccaccccgaaagggacagttatggatatcatttctcggaaggaccagcgcggaagcggccaggtggggacctatggactgaatacatttaccaacatggaagcccaactcatcagacagatggagggcgagggggtcctgtccaaggctgatctggaaaatcctcacctcctggagaaaaagattacacagtggcttgaaaccaaaggcgtggagcggctgaagcgcatggccatcagcggagacgattgcgttgtgaaacccatcgacgatagattcgcgaacgccctcctggctcttaacgacatgggcaaggtccggaaggatattccccagtggcaaccttctaaagggtggcatgactggcaacaggtgccgttttgttcccaccacttccatgaactgatcatgaaggatggacgcaaactcgtcgtgccctgcagacctcaggacgagctgattggccgggcccgcatcagccaaggggctggatggtctctgaaggagacggcctgtctcggcaaggcttacgcccagatgtggtccctgatgtatttccacagacgggatcttagactggcgagcaatgccatttgctctgctgttcccgtgcattgggtccctacatcccgcaccacctggagcatccacgcccatcaccagtggatgacaaccgaagacatgctcacagtgtggaaccgggtttggattgaggacaatccctggatggaagataagacgcctgtgaccacatgggaggacgtcccctacctggggaagagagaggatcaatggtgtggctcccttatcggactgaccagccgcgccacatgggctcagaacatcctcaccgccattcaacaggtgcggtctctgatcggcgacgaagagtttctggattatatgccgagcatgaaaagattccgcaaggaagaggaatccgagggggcgatttggtga

SEQ ID NO: 20877 - RNA, 9873 nt, synthetic construct
  misc_feature 1..9873: note = derived and/or modified CDS sequence (opt5) from DENV-3__KJ622192__SS-prME
  source 1..9873: mol_type = other RNA
accagcctgtgcctcatgatgatgctgcccgccacccttgctttccacctgacgagccgggacggcgaacctcggatgatcgtggggaagaacgaacgcggaaagtctctcctgtttaagaccgccagcggcattaatatgtgtacccttatcgcgatggatctgggggaaatgtgcgacgataccgtcacatacaagtgtccgctcattgctgaagttgaacccgaagacatcgattgctggtgtaacctgacctccacatgggtgacctatggaacgtgcaatcaggccggcgagcatcggcgggacaagcgctctgtggccctggctcctcacgtcgggatgggactcgatacccggacacaaacctggatgagcgccgagggcgcttggagacaggtggaaaaagttgagacatgggccctgcgccatcccggcttcaccattcttgcgctgtttctcgcccactacatcgggacgtccctgacacagaaggtggtcatcttcattcttctgatgctcgtgaccccttctatggctatgagatgtgttggagtgggcaaccgggactttgtcgaagggctgagcggagccacatgggtggatgtggtcctggagcatggcgggtgcgttaccaccatggctaagaataaacccacactcgacatcgagctgcagaagacggaagccacccaacttgcgacactgcgcaaactctgtattgagggaaagatcaccaacattacaaccgattccagatgccctacgcagggcgaagccatcctgccggaggaacaggaccagaattatgtgtgtaaacacacatacgtggatcggggctgggggaacggatgcggccttttcgggaagggaagcctggtgacatgcgctaagtttcaatgtctcgagtctattgagggcaaagtggttcagcacgaaaatctgaagtataccgtgacaatcaccgtccatacaggggaccagcaccaggtgggaaacgacacgcaaggcgttaccgccgagatcacaccccaggcttccaccgtggaagccattctgcctgagtacggcacactcgggctggaatgcagcccccgcaccggacttgatttcaatgagatgatcctgctcacgatgaaaaacaaggcctggatggtccatagacagtggtttttcgacctgcctcttccctggacctctggcgctattacagagaccccgacatggaatcggaaagaactgctcgtgacctttaagaacgcgcacgccaaaaagcaagaggtcgtggttctggggtcccaggaaggagctatgcacacggccctgacaggcgccaccgagatccagaatagcgggggcacatctattttcgctggacatctcaagtgtcgcctgaaaatggataaacttgaactgaaaggcatgtcctatgccatgtgcctcaacacctttgtgctgaagaaagaggtcagcgagacccagcacgggacaatcctgatcaaggtggaatacaagggagaggacgcgccttgtaaaattcccttctccacggaagatggccaagggaaggctcataacggaagacttatcaccgccaatcctgttgtgaccaagaaggaggagcccgtcaacattgaagccgagccccctttcggcgaatctaatatcgtgattgggatcggcgacaaagctctcaagatcaactggtacaagaaaggaagctccattggcaagatgtttgaggccaccgctagaggggccagacgcatggcgatcctgggagatacagcctgggacttcggcagcgtcggcggggttctcaattctctcgggaaaatggtccaccagatttttgggtccgcttataccgccctgttcggcggagtgagctggatcatgaagattggcatcggggtgcttctgacgtggattggactcaactctaaaaatacaagcatgtccttttcttgcatcgtcatcggcattatcaccctgtacctggggaccgtggttcaggctgatatgggatgtgtgattaactggaagggcaaggaacttaaatgcgggagcggcatcttcgtcacaaatgaggtgcatacctggacagagcagtataagtttcaagccgactccccgaaacggctcgcgacggccattgctggagcctgggaaaacggcgtttgtgggatcagaagcaccacacgcatggagaatctgctgtggaagcagatcgctaacgaactcaattacattctgtgggagaacaatatcaaacttaccgtggtcgtgggagatattatcggcgttctggaacaggggaagcggacactcacaccccagcctatggagctgaaatattcttggaagacgtggggaaaggccaaaattgtgaccgccgagatccaaaactccagcttcatcattgacggccccaacacacctgaatgcccctctgcttccagagcgtggaatgtctgggaggtggaagactacggctttggggtgttcaccacaaacatctggctgaaacttcgcgaggtctatacccagacatgtgatcaccggctcatgagcgccgctattaaagacgaaagagccgttcacgccgatatgggatactggatcgagtcccagaagaatggctcttggaaactggagaaggctagctttattgaagtgaagacctgcacgtggccgaaatcccatacactgtggtctaacggggtgctcgagagcgacatgatcatccctaagtccctggccggacccattagccagcacaatcatcgccctggctaccacacccaaaccgcggggccctggcaccttggaaaactggaactcgatttcaactattgcgagggcacaaccgtcgtgatcacggagaattgtggcacacgggggccttctctgagaaccacaaccgtttccggaaagctgattcatgaatggtgctgtcgcagctgcacacttcccccgctccggtacatgggcgaggacgggtgttggtatggaatggaaatcagacctattaacgagaaagaagagaatatggtgaagtctctggtctccgctggcagcgggaaggtggataactttaccatgggagttctgtgcctcgccatcctgttcgaggaagtgatgcggggcaaattcggcaagaaacacatgattgccggggtccttctgacgtttatgctcctgctgtctggacagatcacctggcgcgacatggctcatacacttatcatgattggcagcaatgcctccgatagaatggggatgggagtgacctacctggcgctcatcgctacattcaagattcagccctttctggccctcggcttctttctgcggaaacttaccagcagagagaacctgctcctgggggttggactggccatggctacgacacttcaactgcccgaagacatcgagcagatggccaatggcattgctctcggcctgatggccctcaagctgatcacccagttcgaaacatatcagctttggaccgcgctggtgtctctcacctgttccaacacaatctttacgctgaccgtcgcctggcgcacagctaccctgattcttgccggggtgagcctgctccctgtgtgccaatcctctagcatgcggaagacagattggctgccggtcgctgttgccgccatgggagtgccccctctccccctgttcatcttttcccttaaagacaccctgaagagacgctcttggcctctgaatgagggcgtgatggctgtcgggctcgtgagcattctggcgtcctctcttctgagaaacgatgttcccatggccggacctctcgtggctggcgggctgctcatcgcctgttacgtcattacgggaacaagcgccgacctgaccgtggagaaagctgccgacgttacctgggaagaggaagcggagcagacaggcgtgtcccacaaccttatgatcaccgtcgatgacgatggcacaatgcggatcaaggacgatgaaacggagaatattctgaccgtgctgctcaaaacagctctgcttatcgtcagcgggattttcccctattctatcccggccaccctgctcgtgtggcatacatggcagaagcagacccaacgctccggagttctgtgggacgtgccttctccccctgagacgcagaaagccgaactcgaggaaggcgtctacagaattaagcagcaggggatctttggaaagacccaagtgggcgttggggtgcagaaagagggagtcttccacacaatgtggcacgtgacccggggcgctgtgctgacacataacggcaagcgccttgagcccaattgggcctccgttaaaaaggatctgatttcctacgggggaggctggagactgagcgcgcagtggcaaaaaggggaagaggtccaggtgatcgctgtggaaccgggacggaaccctaagaattttcagaccatgcccggcatcttccagacaacgaccggggagattggagccatcgccctcgacttcaagcctggcacatctggctcccccattatcaaccgcgaagggaaagtcgtgggactgtatggcaatggggttgtgaccaagaacggaggctacgtcagcgggattgctcaagccaatgctgagcccgatggccctaccccggagcttgaagaggaaatgtttaaaaagagaaacctgacaatcatggacctccaccccggatccggcaaaacgcggaagtatctgcctgccatcgtgcgcgaggcgattaagagacggctcagaaccctgatccttgcccccacacgcgttgtggctgccgaaatggaggaggctctgaaagggctgcctattcggtaccagaccacagccaccaagagcgaacatacgggaagagagatcgtcgatctcatgtgccacgccacattcaccatgcgcctgctttctcccgtgcgggttcctaattataacctgattatcatggacgaagctcattttaccgatccggcgagcatcgccgctagaggctacatttccacacgcgtggggatgggagaggccgccgctatcttcatgaccgccacaccccctggcaccgcggaggcttttccccagtctaatgcccctattcaggacgaggagcgggacatccccgaaagaagctggaactccgggaatgagtggattacggatttcgtcggcaaaacagtgtggtttgtgccgtctatcaaggccggaaacgacattgctaactgtctccgcaaaaatggcaagaaggtcatccaactgagccggaaaaccttcgatacagaatatcagaagaccaaactgaacgactgggattttgttgtgacgaccgacatctccgagatgggggccaatttcaaggcggatagagtgattgaccctcggcgctgcctcaaacccgtcatccttacagatggacccgagagagtgattctggccggccctatgcccgttaccgctgcctctgctgcccagcggcgcgggagagtgggacggaaccctcagaaggaaaatgaccaatacatctttacaggccagccgctgaacaatgatgaggaccacgctcactggaccgaagccaagatgctcctggacaacattaatacacccgaggggatcatccctgcgcttttcgaacccgagagagagaaaagcgccgctattgatggcgaataccgcctgaagggagagtcccggaaaaccttcgtcgaactcatgagacgcggcgacctgcctgtgtggctggcccataaggttgctagcgaggggatcaaatatacggatcggaagtggtgctttgacggagaaagaaacaatcagattctcgaggagaacatggatgtggaaatctggacaaaagagggcgaacgcaagaaacttcggcccagatggctggacgcccgcacctactctgatccgctggccctcaaagagttcaaggactttgctgcggggagaaaatccattgccctggatcttgtcaccgaaatcggacgggtgcctagccacctggctcatcgcacaagaaatgccctcgacaacctggtcatgctgcacacctctgagcacggcggccgggcctatcgccatgctgtggaggaactccccgagacaatggaaacgcttctgctgctcgggctgatgatccttctgaccggaggcgccatgctgttcctgatttccgggaagggaatcggcaaaacaagcattgggctgatctgtgttattgtgtcctctggaatgctctggatggcggatgtgcctcttcagtggatcgccagcgctattgtcctggagtttttcatgatggttctgctcatccccgagcctgaaaagcaaagaacaccccaggacaatcagctggcctacgtggtgatcggcattcttacactggctgccatcgtcgcggccaacgagatgggcctcctggaaaccacgaagcgggatctggggatgtccaaagagccgggagtggttagccctacctcttatctcgacgtggaccttcaccccgcttccgcctggacactgtacgctgtcgccaccacagtgattacccccatgctgagacatacgatcgaaaatagcacagctaacgtctctctcgccgcgattgccaaccaagctgtggttctgatgggccttgataaggggtggcctatcagcaaaatggacctgggagtgccgctcctggccctgggctgctattcccaggtcaatcccctcacccttacagctgccgtgctgctgctcgttacccactacgccatcattgggcctggactgcaggcgaaggctacccgcgaggcccagaaacggacagctgccggcatcatgaagaaccccacggtggatggcattatgaccatcgaccttgatcctgtcatttacgactctaagtttgagaaacaactgggacaggtgatgctcctggtgctgtgtgccgttcagctccttctgatgagaacaagctgggctctgtgcgaagccctcaccctggcgacaggacccatcaccacgctttgggagggctcccctgggaagttctggaatacaaccatcgccgtctctatggctaacatttttcgcggaagctatctggccggcgctgggctcgccttctccatcatgaaaagcgtgggaaccggcaagcggggcacagggtctcagggagaaaccctgggcgagaaatggaagaagaaactgaatcaactctccagacgggaatttgagctttacaagaaaagcgggattacagaggtggatcgcacggaagcgaaggagggactgaaaagaggcgaaaccacacatcacgccgtctcccgggggtctgctaagctgcagtggttcgttgagcgcaacatggtgatcccggaaggaagagtgattgacctcggctgtggcagagggggatggagctattactgcgccggcctgaaaaaggtcaccgaggtgcgcgggtatacaaagggaggccccgggcacgaggaacctgttcccatgtccacctacggatggaatacggtgaaacttatgtctggcaaggatgtcttttatctgcctcccgagaaatgtgacaccctcctgtgcgatatcggcgaaagctccccgagccctacagtggaggagtctagaaccattcgggttctgaagatggtggaaccctggctcaaaaacaatcagttctgtatcaaggtccttaacccctacatgcctacagtgatcgagcatctggaacgcctgcagagaaagcacgggggaatgctcgtgcggaatcccctgtccagaaacagcacccatgagatgtactggatttctaatggcacagggaacatcgtctccagcgttaatatggtgtctcgccttctgctcaaccggttcaccatgacgcacagacgccctacaattgaaaaagacgtggatctgggagctggcacccggcacgtcaacgccgagccggagacccccaatatggacgtgatcggggaaagaattaagcgcatcaaagaggaacatagctccacatggcactatgacgatgagaacccttacaagacgtgggcttatcatggatcttacgaagttaaagccaccggcagcgcgtccagcatgatcaatggcgtggtcaagctgctcacaaagccctgggacgtggttcctatggtgacccaaatggccatgacagataccacaccctttgggcagcagcgggtcttcaaagagaaggtggacaccagaacgccgcgccctatgcccggaacccggaaagttatggagattacagctgaatggctgtggagaacccttggccgcaacaagcggcctagactgtgcacacgcgaggaatttaccaaaaaggtgagaacgaatgccgctatgggggccgtcttcacagaggaaaaccaatgggagtccgcccgggcggctgtggaggatgaagagttttggaagctcgtcggacgcgaaagagagctgcacaaacttggcaagtgtgggtcttgcgtgtataatatgatgggcaaacgggagaagaaactgggagagttcggcaaggccaaagggagcagagccatctggtacatgtggctcggagctcggtatctggagtttgaagccctgggcttcctcaacgaggaccattggttttcccgcgaaaattcttacagcggggttgagggagagggcctgcacaaacttgggtacattctgagagatatctccaagattcccggcggagctatgtatgccgacgataccgcgggctgggacacacggatcaccgaagatgacctccacaacgaggagaagatcacgcagcagatggaccctgagcatcgccagctggccaatgctattttcaaacttacctaccaaaacaaagtggtcaaggtgcagagacccacaccgaaagggaccgtgatggatatcatttctcggaaggaccagcgcggaagcggccaggttgggacatatggactgaatacctttacaaacatggaagcccaactcatcagacagatggagggcgagggggtgctgtccaaggctgatctggaaaatcctcacctcctggagaaaaagattacccagtggcttgaaacgaaaggcgtcgagcggctgaagcgcatggccatcagcggagacgattgcgtggttaaacccatcgacgatagattcgcgaacgccctcctggctcttaacgacatgggcaaggtgcggaaggatattccccagtggcaaccttctaaagggtggcatgactggcagcaggtcccgttttgttcccaccacttccatgaactgatcatgaaggatggacgcaaactcgtggtcccctgcagacctcaggacgagctgattggccgggcccgcatcagccaaggggctggatggtctctgaaggagacagcctgtctcggcaaggcttacgcccagatgtggtccctgatgtatttccacagacgggatcttagactggcgagcaatgccatttgctctgctgtgcccgttcattgggtgcctacctcccgcaccacatggagcatccacgcccatcaccagtggatgaccacagaagacatgctcacggtctggaaccgggtgtggattgaggacaatccctggatggaagataagacccctgttacaacctgggaggacgtgccctacctggggaagagagaggatcaatggtgtggctcccttatcggactgacaagccgcgccacctgggctcagaacatcctcacggccattcagcaggtccggtctctgatcggcgacgaagagtttctggattatatgccgagcatgaaaagattccgcaaggaagaggaatccgagggggcgatttggtga

SEQ ID NO: 20878 - RNA, 9873 nt, synthetic construct
  misc_feature 1..9873: note = derived and/or modified CDS sequence (opt5) from DENV-3__KJ622193__SS-prME
  source 1..9873: mol_type = other RNA
accagcctgtgcctcatgatgatgctgcccgccacccttgctttccacctgacgagccgggacggcgagcctcggatgatcgtggggaagaacgaacgcggaaagtctctcctgtttaagaccgccagcggcattaatatgtgtacccttatcgcgatggatctgggggagatgtgcgacgataccgtcacatacaagtgtccgctcattgctgaagttgagcccgaagacatcgattgctggtgtaacctgacctccacatgggtgacctatggaacgtgcaatcaggccggcgagcatagacgggacaagcgctctgtggccctggctcctcacgtcgggatgggactcgataccagaacacaaacctggatgagcgccgagggcgcttggagacaggtggaaaaagttgagacatgggccctgcgccatcccggcttcaccattcttgcgctgtttctcgcccactacatcgggacgtccctgacacagaaggtggtcatcttcattcttctgatgctcgtgaccccttctatggctatgagatgtgttggagtgggcaaccgggactttgtcgaagggctgagcggagccacatgggtggatgtggtcctggagcatggcgggtgcgttaccaccatggctaagaataaacccacactcgacatcgagctgcagaagacggaagccacccaacttgcgacactgcgcaaactctgtattgagggaaagatcaccaacattacaaccgattccagatgccctacgcagggcgaagccatcctgccggaggaacaggaccagaattatgtgtgtaaacacacatacgtggatcggggctgggggaacggatgcggccttttcgggaagggaagcctggtcacatgcgctaagtttcaatgtctcgagtctattgagggcaaagtggttcagcacgaaaatctgaagtataccgtgacaatcaccgtccatacaggggaccagcaccaggtgggaaacgacacgcaaggcgttaccgccgagatcacaccccaggcttccaccgtggaagccattctgcctgagtacggcacactcgggctggaatgcagcccccgcaccggacttgatttcaatgagatgatcctgctcacgatgaaaaacaaggcctggatggtccatagacagtggtttttcgacctgcctcttccctggacctctggcgctattacagagaccccgacatggaatcggaaagaactgctcgtgacctttaagaacgcgcacgccaaaaagcaaggggtcgtggttctgggatcccaggagggcgctatgcacacggccctgacaggggccaccgaaatccagaatagcggcggaacatctattttcgctggccatctcaagtgtcgcctgaaaatggataaacttgagctgaaagggatgtcctatgccatgtgcctcaacacctttgtgctgaagaaagaagtcagcgagacccagcacggaacaatcctgatcaaggtggagtacaagggcgaagacgcgccttgtaaaattcccttctccacggaggatgggcaaggaaaggctcataacggcagacttatcaccgccaatcctgttgtgaccaagaaggaggaacccgtcaacattgaggccgaaccccctttcggggagtctaatatcgtgattggcatcggagacaaagctctcaagatcaactggtacaagaaaggcagctccattgggaagatgtttgaagccaccgctcggggagccagacgcatggcgatcctgggcgatacagcctgggacttcgggagcgtgggaggcgttctcaattctctcgggaaaatggtccaccagatttttggctccgcttataccgccctgttcggaggcgtgagctggatcatgaagattgggatcggagtgcttctgacgtggattggcctcaactctaaaaatacaagcatgtccttttcttgcatcgtcatcgggattatcaccctgtacctgggaaccgtggttcaggctgatatgggctgtgtgattaactggaaggggaaggagcttaaatgcggcagcggaatcttcgtcacaaatgaagtgcatacctggacagagcagtataagtttcaagccgactccccgaaacggctcgcgacggccattgctggcgcctgggagaacggggtttgtggaatcagaagcaccacacgcatggaaaatctgctgtggaagcagatcgctaacgagctcaattacattctgtgggaaaacaatatcaaacttaccgtggtcgtgggcgatattatcggggttctggagcagggaaagcggacactcacaccccagcctatggaactgaaatattcttggaagacgtggggcaaggccaaaattgtgaccgccgagatccaaaactccagcttcatcattgacggccccaacacacctgagtgcccctctgcttccagagcgtggaatgtctgggaagtggaggactacgggtttggagtgttcaccacaaacatctggctgaaacttcgcgaagtctatacccagacatgtgatcaccggctcatgagcgccgctattaaagacgagagagccgttcacgccgatatgggctactggatcgaatcccagaagaatgggtcttggaaactggagaaggctagctttattgaggtgaagacctgcacgtggccgaaatcccatacactgtggtctaacggagtgctcgaaagcgacatgatcatccctaagtccctggccggccccattagccagcacaatcatcgccctgggtaccacacccaaaccgcgggaccctggcaccttggcaaactggagctcgatttcaactattgcgaaggcacaaccgtcgtgatcacggagaattgtgggacacggggaccttctctgagaaccacaaccgtttccggcaagctgattcatgagtggtgctgtcgcagctgcacacttcccccgctccggtacatgggggaagacggatgttggtatggcatggagatcagacctattaacgaaaaagaggaaaatatggtgaagtctctggtctccgctgggagcggaaaggtggataactttaccatgggcgttctgtgcctcgccatcctgttcgaggaggtgatgcggggcaaattcgggaagaaacacatgattgccggagtccttctgacgtttatgctcctgctgtctggccagatcacctggcgcgacatggctcatacacttatcatgattgggagcaatgcctccgatagaatgggaatgggcgtgacctacctggcgctcatcgctacattcaagattcagccctttctggccctcgggttctttctgcggaaacttaccagcagagaaaacctgctcctgggagttggcctggccatggctacgacacttcaactgcccgaggacatcgaacagatggccaatggcattgctctcgggctgatggccctcaagctgatcacccagttcgagacatatcagctttggaccgcgctggtgtctctcacctgttccaacacaatctttacgctgaccgtcgcctggcgcacagctaccctgattcttgccggagtgagcctgctccctgtgtgccaatcctctagcatgcggaagacagattggctgccggtcgctgttgccgccatgggcgtgccccctctccccctgttcatcttttcccttaaagacaccctgaagagacgctcttggcctctgaatgaaggggtgatggctgtcggactcgtgagcattctggcgtcctctcttctgagaaacgatgttcccatggccggccctctcgtggctgggggactgctcatcgcctgttacgtcattacgggcacaagcgccgacctgaccgtggagaaagctgccgacgttacctgggaggaagaggcggaacagacaggcgtgtcccacaaccttatgatcaccgtcgatgacgatgggacaatgcggatcaaggacgatgagacggaaaatattctgaccgtgctgctcaaaacagctctgcttatcgtcagcggaattttcccctattctatcccggccaccctgctcgtgtggcatacatggcagaagcagacccaacgctccggcgttctgtgggacgtgccttctccccctgagacgcagaaagccgagctcgaagagggggtctacagaattaagcagcagggaatctttggcaagacccaagtgggggttggagtgcagaaagaaggcgtcttccacacaatgtggcacgtgacccggggcgctgtgctgacacataacgggaagcgccttgagcccaattgggcctccgttaaaaaggatctgatttcctacggaggcgggtggagactgagcgcgcagtggcaaaaaggagaggaagtccaggtgatcgctgtggagccgggccggaaccctaagaattttcagaccatgcccgggatcttccagacaacgaccggagaaattggcgccatcgccctcgacttcaagcctggcacatctgggtcccccattatcaaccgcgagggaaaagtcgtgggcctgtatgggaatggagttgtgaccaagaacggcgggtacgtcagcggcattgctcaagccaatgctgaacccgatggacctaccccggagcttgaggaagagatgtttaaaaagagaaacctgacaatcatggacctccaccccggctccgggaaaacgcggaagtatctgcctgccatcgtgcgcgaagcgattaagagacggctcagaaccctgatccttgcccccacacgcgttgtggctgccgagatggaagaggctctgaaaggactgcctattcggtaccagaccacagccaccaagagcgagcatacgggcagagaaatcgtcgatctcatgtgccacgccacattcaccatgcgcctgctttctcccgtgcgggttcctaattataacctgattatcatggacgaggctcattttaccgatccggcgagcatcgccgctagagggtacatttccacacgcgtgggaatgggcgaagccgccgctatcttcatgaccgccacaccccctgggaccgcggaggcttttccccagtctaatgcccctattcaggacgaagaacgggacatccccgagagaagctggaactccggcaatgaatggattacggatttcgtcggaaaaacagtgtggtttgtgccgtctatcaaggccggcaacgacattgctaactgtctccgcaaaaatgggaagaaggtcatccaactgagccggaaaaccttcgatacagagtatcagaagaccaaactgaacgactgggattttgttgtgacgaccgacatctccgaaatgggagccaatttcaaggcggatagagtgattgaccctcggcgctgcctcaaacccgtcatccttacagatggccccgagagagtgattctggccgggcctatgcccgttaccgctgcctctgctgcccagcggcgcggaagagtgggccggaaccctcagaaggagaatgaccaatacatctttacagggcagccgctgaacaatgatgaagaccacgctcactggaccgaggccaagatgctcctggacaacattaatacacccgaaggcatcatccctgcgcttttcgagcccgaaagagagaaaagcgccgctattgatggagagtaccgcctgaagggcgaatcccggaaaaccttcgtcgagctcatgagacgcggggacctgcctgtgtggctggcccataaggttgctagcgaaggaatcaaatatacggatcggaagtggtgctttgacggcgagagaaacaatcagattctcgaagagaacatggatgtggagatctggacaaaagaaggggagcgcaagaaacttcggcccagatggctggacgcccgcacctactctgatccgctggccctcaaagagttcaaggactttgctgcgggaagaaaatccattgccctggatcttgtcaccgagatcggccgggtgcctagccacctggctcatcgcacaagaaatgccctcgacaacctggtcatgctgcacacctctgaacacggcgggcgggcctatcgccatgctgtggaggagctccccgaaacaatggagacgcttctgctgctcggactgatgatccttctgaccggcggggccatgctgttcctgatttccggaaagggcatcgggaaaacaagcattggactgatctgtgttattgtgtcctctggcatgctctggatggcggatgtgcctcttcagtggatcgccagcgctattgtcctggaatttttcatgatggttctgctcatccccgagcctgagaagcaaagaacaccccaggacaatcagctggcctacgtggtgatcggcattcttacactggctgccatcgtcgcggccaacgaaatggggctcctggagaccacgaagcgggatctgggaatgtccaaagaaccgggcgtggttagccctacctcttatctcgacgtggaccttcaccccgcttccgcctggacactgtacgctgtcgccaccacagtgattacccccatgctgagacatacgatcgagaatagcacagctaacgtctctctcgccgcgattgccaaccaagctgtggttctgatggggcttgataagggatggcctatcagcaaaatggacctgggcgtgccgctcctggccctggggtgctattcccaggtcaatcccctcacccttacagctgccgtgctgctgctcgttacccactacgccatcattggacctggcctgcaggcgaaggctacccgcgaagcccagaaacggacagctgccggcatcatgaagaaccccacggtggatgggattatgaccatcgaccttgatcctgtcatttacgactctaagtttgagaaacaactgggacaggtgatgctcctggtgctgtgtgccgttcagctccttctgatgagaacaagctgggctctgtgcgaggccctcaccctggcgacaggccccatcaccacgctttgggaagggtcccctggaaagttctggaatacaaccatcgccgtctctatggctaacatttttcgcggcagctatctggccggggctggactcgccttctccatcatgaaaagcgtgggcaccggcaagcgggggacaggatctcagggcgagaccctgggggaaaaatggaagaagaaactgaatcaactctccagacgggagtttgaactttacaagaaaagcggaattacagaggtggatcgcacggaggcgaaggaaggcctgaaaagaggggagaccacacatcacgccgtctcccggggatctgctaagctgcagtggttcgttgaacgcaacatggtgatcccggagggcagagtgattgacctcggctgtgggcggggaggctggagctattactgcgccgggctgaaaaaggtcaccgaagtgcgcggatatacaaagggcgggcccggacacgaggagcctgttcccatgtccacctacggctggaatacggtgaaacttatgtctggcaaggatgtcttttatctgcctcccgaaaaatgtgacaccctcctgtgcgatatcggggagagctccccgagccctacagtggaagagtctagaaccattcgggttctgaagatggtggagccctggctcaaaaacaatcagttctgtatcaaggtccttaacccctacatgcctacagtgatcgaacatctggagcgcctgcagagaaagcacggaggcatgctcgtgcggaatcccctgtccagaaacagcacccatgaaatgtactggatttctaatgggacaggaaacatcgtctccagcgttaatatggtgtctcgccttctgctcaaccggttcaccatgacgcacagacgccctacaattgagaaagacgtggatctgggcgctgggacccggcacgtcaacgccgaaccggagacccccaatatggacgtgatcggagagagaattaagcgcatcaaagaggaacatagctccacatggcactatgacgatgaaaacccttacaagacgtgggcttatcatggctcttacgaggttaaagccaccggcagcgcgtccagcatgatcaatggggtggtcaagctgctcacaaagccctgggacgtggttcctatggtgacccaaatggccatgacagataccacaccctttggacagcagcgggtcttcaaagaaaaggtggacaccagaacgccgcgccctatgcccggcacccggaaagttatggagattacagctgagtggctgtggagaacccttgggcgcaacaagcggcctagactgtgcacacgcgaagagtttaccaaaaaggtgagaacgaatgccgctatgggagccgtcttcacagaagagaaccaatgggaatccgcccgggcggctgtggaggatgaggaattttggaagctcgtcggccgcgagagagaactgcacaaacttgggaagtgtggctcttgcgtgtataatatgatgggaaaacgggagaagaaactgggcgagttcgggaaggccaaaggaagcagagccatctggtacatgtggctcggcgctcggtatctggaatttgaggccctggggttcctcaacgaagaccattggttttcccgcgaaaattcttacagcggagttgaaggcgaggggctgcacaaacttggctacattctgagagatatctccaagattcccggaggcgctatgtatgccgacgataccgcggggtgggacacacggatcaccgaggatgacctccacaacgaagagaaaatcacgcagcagatggaccctgaacatcgccagctggccaatgctattttcaaacttacctaccaaaacaaagtggtcaaggtgcagagacccacaccgaaaggaaccgtgatggatatcatttctcggaaggaccagcgcggcagcgggcaggttggaacatatggcctgaatacctttacaaacatggaggcccaactcatcagacagatggaaggggagggcgtgctgtccaaggctgatctggagaatcctcacctcctggagaagaagattacccagtggcttgagacgaaaggagtcgaacggctgaagcgcatggccatcagcggcgacgattgcgtggttaaacccatcgacgatagattcgcgaacgccctcctggctcttaacgacatggggaaggtgcggaaggatattccccagtggcaaccttctaaaggatggcatgactggcagcaggtcccgttttgttcccaccacttccatgagctgatcatgaaggatggccgcaaactcgtggtcccctgcagacctcaggacgaactgattgggcgggcccgcatcagccaaggagctggctggtctctgaaggagacagcctgtctcgggaaggcttacgcccagatgtggtccctgatgtatttccacagacgggatcttagactggcgagcaatgccatttgctctgctgtgcccgttcattgggtgcctacctcccgcaccacatggagcatccacgcccatcaccagtggatgaccacagaggacatgctcacggtctggaaccgggtgtggattgaagacaatccctggatggaggataagacccctgttacaacctgggaagacgtgccctacctgggcaagagagaggatcaatggtgtggatcccttatcggcctgacaagccgcgccacctgggctcagaacatcctcacggccattcagcaggtccggtctctgatcggggacgaggaatttctggattatatgccgagcatgaaaagattccgcaaggaggaagagtccgaaggagcgatttggtga

SEQ ID NO: 20879 - RNA, 9873 nt, synthetic construct
  misc_feature 1..9873: note = derived and/or modified CDS sequence (opt5) from DENV-3__KJ622194__SS-prME
  source 1..9873: mol_type = other RNA
accagcctgtgcctcatgatgatgctgcccgccacccttgctttccacctgacgagccgggacggcgaacctcggatgatcgtggggaagaatgaacgcggaaagtctctcctgtttaagaccgccagcggcattaatatgtgtacacttatcgcgatggatctgggggaaatgtgcgacgataccgtcacatacaagtgtccgctcattgctgaagttgaacccgaagacatcgattgctggtgtaacctgacctccacatgggtgacctatggaacgtgcaatcaggccggcgagcatcggcgggacaagcgctctgtggccctggctcctcacgtcgggatgggactcgatacccggacacaaacctggatgagcgccgagggcgcttggagacaggtggaaaaagttgagacatgggccctgcgccatcccggcttcaccattcttgcgctgtttctcgcccactacatcgggacgtccctgacacagaaggtggtcatcttcattcttctgatgctcgtgaccccttctatggctatgagatgtgttggagtgggcaaccgggactttgtcgaagggctgagcggagccacatgggtggatgtggtcctggagcatggcgggtgcgttaccaccatggctaagaataaacccacactcgacatcgagctgcagaagacggaagccacccaacttgcgacactgcgcaaactctgtattgagggaaagatcaccaacattacaaccgattccagatgccctacgcagggcgaagccatcctgccggaggaacaggaccagaattatgtgtgtaaacacacatacgtggatcggggctgggggaacggatgcggccttttcgggaagggaagcctggtgacatgcgctaagtttcaatgtctcgagtctattgagggcaaagtggttcagcacgaaaatctgaagtataccgtgacaatcaccgtccatacaggggaccagcaccaggtgggaaacgacacgcaaggcgttaccgccgagatcacaccccaggcttccaccgtggaagccattctgcctgagtacggcacactcgggctggaatgcagcccccgcaccggacttgatttcaatgagatgatcctgctcacgatgaaaaacaaggcctggatggtccatagacagtggtttttcgacctgcctcttccctggacctctggcgctattacagagaccccgacatggaatcggaaagaactgctcgtgacctttaagaacgcgcacgccaaaaagcaagaggtcgtggttctggggtcccaggaaggagctatgcacacggccctgacaggcgccaccgagatccagaatagcgggggcacatctattttcgctggacatctcaagtgtcgcctgaaaatggataaacttgaactgaaaggcatgtcctatgccatgtgcctcaacacctttgtgctgaagaaagaggtcagcgagacccagcacgggacaatcctgatcaaggtggaatacaagggagaggacgcgccttgtaaaattcccttctccacggaagatggccaagggaaggctcataacggaagacttatcaccgccaatcctgttgtgaccaagaaggaggagcccgtcaacattgaagccgagccccctttcggcgaatctaatatcgtgattgggatcggcgacaaagctctcaagatcaactggtacaagaaaggaagctccattggcaagatgtttgaggccaccgctagaggggccagacgcatggcgatcctgggagatacagcctgggacttcggcagcgtcggcggggttctcaattctctcgggaaaatggtccaccagatttttgggtccgcttataccgccctgttcggcggagtgagctggatcatgaagattggcatcggggtgcttctgacgtggattggactcaactctaaaaatacaagcatgtccttttcttgcatcgtcatcggcattatcaccctgtacctggggaccgtggttcaggctgatatgggatgtgtgattaactggaagggcaaggaacttaaatgcgggagcggcatcttcgtcacaaatgaggtgcatacctggacagagcagtataagtttcaagccgactccccgaaacggctcgcgacggccattgctggagcctgggaaaacggcgtttgtgggatcagaagcaccacacgcatggagaatctgctgtggaagcagatcgctaacgaactcaattacattctgtgggagaacaatatcaaacttaccgtggtcgtgggagatattatcggcgttctggaacaggggaagcggacactcacaccccagcctatggagctgaaatattcttggaagacgtggggaaaggccaaaattgtgaccgccgagatccaaaactccagcttcatcattgacggccccaacacacctgaatgcccctctgcttccagagcgtggaatgtctgggaggtggaagactacggctttggggtgttcaccacaaacatctggctgaaacttcgcgaggtctatacccagacatgtgatcaccggctcatgagcgccgctattaaagacgaaagagccgttcacgccgatatgggatactggatcgagtcccagaagaatggctcttggaaactggagaaggctagctttattgaagtgaagacctgcacgtggccgaaatcccatacactgtggtctaacggggtgctcgagagcgacatgatcatccctaagtccctggccggacccattagccagcacaatcatcgccctggctaccacacccaaaccgcggggccctggcaccttggaaaactggaactcgatttcaactattgcgagggcacaaccgtcgtgatcacggagaattgtggcacacgggggccttctctgagaaccacaaccgtttccggaaagctgattcatgaatggtgctgtcgcagctgcacacttcccccgctccggtacatgggcgaggacgggtgttggtatggaatggaaatcagacctattaacgagaaagaagagaatatggtgaagtctctggtctccgctggcagcgggaaggtggataactttaccatgggagttctgtgcctcgccatcctgttcgaggaagtgatgcggggcaaattcggcaagaaacacatgattgccggggtccttctgacgtttatgctcctgctgtctggacagatcacctggcgcgacatggctcatacacttatcatgattggcagcaatgcctccgatagaatggggatgggagtgacctacctggcgctcatcgctacattcaagattcagccctttctggccctcggcttctttctgcggaaacttaccagcagagagaacctgctcctgggggttggactggccatggctacgacacttcaactgcccgaagacatcgagcagatggccaatggcattgctctcggcctgatggccctcaagctgatcacccagttcgaaacatatcagctttggaccgcgctggtgtctctcacctgttccaacacaatctttacgctgaccgtcgcctggcgcacagctaccctgattcttgccggggtgagcctgctccctgtgtgccaatcctctagcatgcggaagacagattggctgccggtcgctgttgccgccatgggagtgccccctctccccctgttcatcttttcccttaaagacaccctgaagagacgctcttggcctctgaatgagggcgtgatggctgtcgggctcgtgagcattctggcgtcctctcttctgagaaacgatgttcccatggccggacctctcgtggctggcgggctgctcatcgcctgttacgtcattacgggaacaagcgccgacctgaccgtggagaaagctgccgacgttacctgggaagaggaagcggagcagacaggcgtgtcccacaaccttatgatcaccgtcgatgacgatggcacaatgcggatcaaggacgatgaaacggagaatattctgaccgtgctgctcaaaacagctctgcttatcgtcagcgggattttcccctattctatcccggccaccctgctcgtgtggcatacatggcagaagcagacccaacgctccggagttctgtgggacgtgccttctccccctgagacgcagaaagccgaactcgaggaaggcgtctacagaattaagcagcaggggatctttggaaagacccaagtgggcgttggggtgcagaaagagggagtcttccacacaatgtggcacgtgacccggggcgctgtgctgacacattccggcaagcgccttgagcccaactgggcctccgttaaaaaggatctgattagctacgggggaggctggagactgtctgcgcagtggcaaaaaggggaagaggtccaggtgatcgctgtggaaccgggacggaatcctaagaactttcagaccatgcccggcatcttccagacaacgaccggggagattggagccatcgccctcgacttcaagcctggcacatccggcagccccattatcaatcgcgaagggaaagtcgtgggactgtatggcaacggggttgtgaccaagaatggaggctacgtctccgggattgctcaagccaacgctgagcccgatggccctaccccggagcttgaagaggaaatgtttaaaaagagaaatctgacaatcatggacctccaccccggaagcggcaaaacgcggaagtatctgcctgccatcgtgcgcgaggcgattaagagacggctcagaaccctgatccttgcccccacacgcgttgtggctgccgaaatggaggaggctctgaaagggctgcctattcggtaccagaccacagccaccaagtctgaacatacgggaagagagatcgtcgatctcatgtgccacgccacattcaccatgcgcctgcttagccccgtgcgggttcctaactataatctgattatcatggacgaagctcattttaccgatccggcgtccatcgccgctagaggctacatttctacacgcgtggggatgggagaggccgccgctatcttcatgaccgccacaccccctggcaccgcggaggcttttccccagagcaacgcccctattcaggacgaggagcgggacatccccgaaagatcctggaactctgggaacgagtggattacggatttcgtcggcaaaacagtgtggtttgtgccgagcatcaaggccggaaatgacattgctaactgtctccgcaaaaacggcaagaaggtcatccaactgtcccggaaaaccttcgatacagaatatcagaagaccaaactgaatgactgggattttgttgtgacgaccgacatctctgagatgggggccaacttcaaggcggatagagtgattgaccctcggcgctgcctcaaacccgtcatccttacagatggacccgagagagtgattctggccggccctatgcccgttaccgctgccagcgctgcccagcggcgcgggagagtgggacggaatcctcagaaggaaaacgaccaatacatctttacaggccagccgctgaataacgatgaggaccacgctcactggaccgaagccaagatgctcctggacaatattaacacacccgaggggatcatccctgcgcttttcgaacccgagagagagaaatccgccgctattgatggcgaataccgcctgaagggagagagccggaaaaccttcgtcgaactcatgagacgcggcgacctgcctgtgtggctggcccataaggttgcttctgaggggatcaaatatacggatcggaagtggtgctttgacggagaaagaaataaccagattctcgaggagaatatggatgtggaaatctggacaaaagagggcgaacgcaagaaacttcggcccagatggctggacgcccgcacctactccgatccgctggccctcaaagagttcaaggactttgctgcggggagaaaaagcattgccctggatcttgtcaccgaaatcggacgggtgccttctcacctggctcatcgcacaagaaacgccctcgacaatctggtcatgctgcacacctccgagcacggcggccgggcctatcgccatgctgtggaggaactccccgagacaatggaaacgcttctgctgctcgggctgatgatccttctgaccggaggcgccatgctgttcctgattagcgggaagggaatcggcaaaacatccattgggctgatctgtgttattgtgtctagcggaatgctctggatggcggatgtgcctcttcagtggatcgcctccgctattgtcctggagtttttcatgatggttctgctcatccccgagcctgaaaagcaaagaacaccccaggacaaccagctggcctacgtggtgatcggcattcttacactggctgccatcgtcgcggccaatgagatgggcctcctggaaaccacgaagcgggatctggggatgagcaaagagccgggagtggtttctcctacctcctatctcgacgtggaccttcaccccgctagcgcctggacactgtacgctgtcgccaccacagtgattacccccatgctgagacatacgatcgaaaactctacagctaatgtcagcctcgccgcgattgccaaccaagctgtggttctgatgggccttgataaggggtggcctatctccaaaatggacctgggagtgccgctcctggccctgggctgctattctcaggtcaaccccctcacccttacagctgccgtgctgctgctcgttacccactacgccatcattgggcctggactgcaggcgaaggctacccgcgaggcccagaaacggacagctgccggcatcatgaagaatcccacggtggatggcattatgaccatcgaccttgatcctgtcatttacgacagcaagtttgagaaacaactgggacaggtgatgctcctggtgctgtgtgccgttcagctccttctgatgagaacatcctgggctctgtgcgaagccctcaccctggcgacaggacccatcaccacgctttgggagggctctcctgggaagttctggaacgccacaatcgctgtcagcatggccaatatttttcgcggatcctatctggctggcgccgggctcgcgttcagcatcatgaaatctgtgggaaccggcaagcggggcaccgggtcccagggagaaacactgggcgagaaatggaagaagaaactgaaccaactcagcagacgggaatttgagctttacaagaaatccgggattaccgaggtggatcgcacagaagccaaggagggactgaaaagaggcgaaacgacccatcacgctgtctctcgggggagcgccaagctgcagtggttcgttgagcgcaatatggtgatcccggaaggaagagtgattgacctcggctgtggcagagggggatggtcctattactgcgctggcctgaaaaaggtcacagaggtgcgcgggtataccaagggaggccccgggcacgaggaacctgttcccatgtctacatacggatggaacaccgtgaaacttatgagcggcaaggatgtcttttatctgcctcccgagaaatgtgacacgctcctgtgcgatatcggcgaatccagcccgtctcctaccgtggaggagtccagaacaattcgggttctgaagatggtggaaccctggctcaaaaataaccagttctgtatcaaggtccttaatccctacatgcctaccgtgatcgagcatctggaacgcctgcagagaaagcacgggggaatgctcgtgcggaaccccctgagcagaaattctacacatgagatgtactggatttccaacggcaccgggaatatcgtcagctctgttaacatggtgagccgccttctgctcaatcggttcacaatgacccacagacgccctacgattgaaaaagacgtggatctgggagccggcacacggcacgtcaacgctgagccggagacccccaacatggacgtgatcggggaaagaattaagcgcatcaaagaggaacattcctctacctggcactatgacgatgagaatccttacaagacatgggcctatcatggaagctacgaagttaaagcgacgggctccgccagctccatgatcaacggcgtggtcaagctgctcaccaagccctgggacgtggttcctatggtgacacaaatggctatgaccgatacaaccccctttgggcagcagcgggtcttcaaagagaaggtggacacaagaaccccgcgccctatgcccggaacgcggaaagttatggagattaccgccgaatggctgtggagaacacttggccgcaataagcggcctagactgtgcacccgcgaggaatttaccaagaaggtgagaaccaacgctgccatgggggccgtcttcacggaggaaaatcaatgggagtctgcgcgggctgccgtggaggatgaagagttttggaagctcgtcggacgcgaaagagagctgcacaaacttggcaagtgtgggagctgcgtgtataacatgatgggcaaacgggagaagaaactgggagagttcggcaaggccaaagggtccagagctatctggtacatgtggctcggagcccggtatctggagtttgaagctctgggcttcctcaatgaggaccattggttttctcgcgaaaacagctactccggggttgagggagagggcctgcacaaacttgggtacattctgagagatatctctaagattcccggcggagccatgtatgcggacgatacagccggctgggacacccggatcacagaagatgacctccacaatgaggagaagatcacccagcagatggaccctgagcatcgccagctggctaacgccattttcaaacttacgtaccaaaataaagtggtcaaggtgcagagacccaccccgaaagggacagtgatggatatcattagccggaaggaccagcgcggatccggccaggttgggacctatggactgaacacatttaccaatatggaagctcaactcatcagacagatggagggcgagggggtgctgagcaaggccgatctggaaaaccctcacctcctggagaaaaagattacacagtggcttgaaaccaaaggcgtcgagcggctgaagcgcatggcgatctctggagacgattgcgtggttaaacccatcgacgatagattcgccaatgctctcctggcccttaacgacatgggcaaggtgcggaaggatattccccagtggcaaccttccaaagggtggcatgactggcagcaggtcccgttttgtagccaccacttccatgaactgatcatgaaggatggacgcaaactcgtggtcccctgcagacctcaggacgagctgattggccgggctcgcatctctcaaggggccggatggtccctgaaggagacggcttgtctcggcaaagcctacgcgcagatgtggagcctgatgtatttccacagacgggatcttagactggcctctaacgctatttgctccgccgtgcccgttcattgggtgcctacaagccgcaccacctggtccatccacgcccatcaccagtggatgacaaccgaagacatgctcacagtctggaatcgggtgtggattgaggacaacccctggatggaagataagacgcctgttaccacatgggaggacgtgccctacctggggaagagagaggatcaatggtgtggcagccttatcggactgacctctcgcgctacatgggcccagaatatcctcaccgcgattcagcaggtccggagcctgatcggcgacgaagagtttctggattatatgccgtccatgaaaagattccgcaaggaagaggaatctgagggggctatttggtga

SEQ ID NO: 20880 - RNA, 9873 nt, synthetic construct
  misc_feature 1..9873: note = derived and/or modified CDS sequence (opt5) from DENV-3__KJ622195__SS-prME
  source 1..9873: mol_type = other RNA
accagcctgtgcctcatgatgatgctgcccgccacccttgctttccacctgacgtcccgggacggcgaacctcggatgatcgtggggaagaacgaacgcggaaagtctctcctgtttaagaccgccagcggcattaatatgtgtacccttatcgcgatggatctgggggaaatgtgcgacgataccgtcacatacaagtgtccgctcattgctgaagttgaacccgaagacatcgattgctggtgtaacctgacctccacatgggtgacctatggaacgtgcaatcaggccggcgagcatcggcgggacaagcgctctgtggccctggctcctcacgtcgggatgggactcgatacccggacacaaacctggatgagcgccgagggcgcttggagacaggtggaaaaagttgagacatgggccctgcgccatcccggcttcaccattcttgcgctgtttctcgcccactacatcgggacgtccctgacacagaaggtggtcatcttcattcttctgatgctcgtgaccccttctatggctatgagatgtgttggagtgggcaaccgggactttgtcgaagggctgagcggagccacatgggtggatgtggtcctggagcatggcgggtgcgttaccaccatggctaagaataaacccacactcgacatcgagctgcagaagacggaagccacccaacttgcgacactgcgcaaactctgtattgagggaaagatcaccaacattacaaccgattccagatgccctacgcagggcgaagccatcctgccggaggaacaggaccagaattatgtgtgtaaacacacatacgtggatcggggctgggggaacggatgcggccttttcgggaagggaagcctggtgacatgcgctaagtttcaatgtctcgagtctattgagggcaaagtggttcagcacgaaaatctgaagtataccgtgacaatcaccgtccatacaggggaccagcaccaggtgggaaacgacacgcaaggcgttaccgccgagatcacaccccaggcttccaccgtggaagccattctgcctgagtacggcacactcgggctggaatgcagcccccgcaccggacttgatttcaatgagatgatcctgctcacgatgaaaaacaaggcctggatggtccatagacagtggtttttcgacctgcctcttccctggacctctggcgctattacagagaccccgacatggaatcggaaagaactgctcgtgacctttaagaacgcgcacgccaaaaagcaagaggtcgtggttctggggtcccaggaaggagctatgcacacggccctgacaggcgccaccgagatccagaatagcgggggcacatctattttcgctggacatctcaagtgtcgcctgaaaatggataaacttgaactgaaaggcatgtcctatgccatgtgcctcaacacctttgtgctgaagaaagaggtcagcgagacccagcacgggacaatcctgatcaaggtggaatacaagggagaggacgcgccttgtaaaattcccttctccacggaagatggccaagggaaggctcataacggaagacttatcaccgccaatcctgttgtgaccaagaaggaggagcccgtcaacattgaagccgagccccctttcggcgaatctaatatcgtgattgggatcggcgacaaagctctcaagatcaactggtacaagaaaggaagctccattggcaagatgtttgaggccaccgctagaggggccagacgcatggcgatcctgggagatacagcctgggacttcggcagcgtcggcggggttctcaattctctcgggaaaatggtccaccagatttttgggtccgcttataccgccctgttcggcggagtgagctggatcatgaagattggcatcggggtgcttctgacgtggattggactcaactctaaaaatacaagcatgtccttttcttgcatcgtcatcggcattatcaccctgtacctggggaccgtggttcaggctgatatgggatgtgtgattaactggaagggcaaggaacttaaatgcgggagcggcatcttcgtcacaaatgaggtgcatacctggacagagcagtataagtttcaagccgactccccgaaacggctcgcgacggccattgctggagcctgggaaaacggcgtttgtgggatcagaagcaccacacgcatggagaatctgctgtggaagcagatcgctaacgaactcaattacattctgtgggagaacaatatcaaacttaccgtggtcgtgggagatattatcggcgttctggaacaggggaagcggacactcacaccccagcctatggagctgaaatattcttggaagacgtggggaaaggccaaaattgtgaccgccgagatccaaaactccagcttcatcattgacggccccaacacacctgaatgcccctctgcttccagagcgtggaatgtctgggaggtggaagactacggctttggggtgttcaccacaaacatctggctgaaacttcgcgaggtctatacccagacatgtgatcaccggctcatgagcgccgctattaaagacgaaagagccgttcacgccgatatgggatactggatcgagtcccagaagaatggctcttggaaactggagaaggctagctttattgaagtgaagacctgcacgtggccgaaatcccatacactgtggtctaacggggtgctcgagagcgacatgatcatccctaagtccctggccggacccattagccagcacaatcatcgccctggctaccacacccaaaccgcggggccctggcaccttggaaaactggaactcgatttcaactattgcgagggcacaaccgtcgtgatcacggagaattgtggcacacgggggccttctctgagaaccacaaccgtttccggaaagctgattcatgaatggtgctgtcgcagctgcacacttcccccgctccggtacatgggcgaggacgggtgttggtatggaatggaaatcagacctattaacgagaaagaagagaatatggtgaagtctctggtctccgctggcagcgggaaggtggataactttaccatgggagttctgtgcctcgccatcctgttcgaggaagtgatgcggggcaaattcggcaagaaacacatgattgccggggtccttctgacgtttatgctcctgctgtctggacagatcacctggcgcgacatggctcatacacttatcatgattggcagcaatgcctccgatagaatggggatgggagtgacctacctggcgctcatcgctacattcaagattcagccctttctggccctcggcttctttctgcggaaacttaccagcagagagaacctgctcctgggggttggactggccatggctacgacacttcaactgcccgaagacatcgagcagatggccaatggcattgctctcggcctgatggccctcaagctgatcacccagttcgaaacatatcagctttggaccgcgctggtgtctctcacctgttccaacacaatctttacgctgaccgtcgcctggcgcacagctaccctgattcttgccggggtgagcctgctccctgtgtgccaatcctctagcatgcggaagacagattggctgccggtcgctgttgccgccatgggagtgccccctctccccctgttcatcttttcccttaaagacaccctgaagagacgctcttggcctctgaatgagggcgtgatggctgtcgggctcgtgagcattctggcgtcctctcttctgagaaacgatgttcccatggccggacctctcgtggctggcgggctgctcatcgcctgttacgtcattacgggaacaagcgccgacctgaccgtggagaaagctgccgacgttacctgggaagaggaagcggagcagacaggcgtgtcccacaaccttatgatcaccgtcgatgacgatggcacaatgcggatcaaggacgatgaaacggagaatattctgaccgtgctgctcaaaacagctctgcttatcgtcagcgggattttcccctattctatcccggccaccctgctcgtgtggcatacatggcagaagcagacccaacgctccggagttctgtgggacgtgccttctccccctgagacgcagaaagccgaactcgaggaaggcgtctacagaattaagcagcaggggatctttggaaagacccaagtgggcgttggggtgcagaaagagggagtcttccacacaatgtggcacgtgacccggggcgctgtgctgacacataacggcaagcgccttgagcccaattgggcctccgttaaaaaggatctgatttcctacgggggaggctggagactgagcgcgcagtggcaaaaaggggaagaggtccaggtgatcgctgtggaaccgggacggaaccctaagaattttcagaccatgcccggcatcttccagacaacgaccggggagattggagccatcgccctcgacttcaagcctggcacatctggctcccccattatcgatcgcgaagggaaagtcgtgggactgtatggcaacggggttgtgaccaagaatggaggctacgtcagcgggattgctcaagccaacgctgagcccgacggccctaccccggagcttgaagaggaaatgtttaaaaagagaaatctgacaatcatggatctccaccccggatccggcaaaacgcggaagtatctgcctgccatcgtgcgcgaggcgattaagagacggctcagaaccctgatccttgcccccacacgcgttgtggctgccgaaatggaggaggctctgaaagggctgcctattcggtaccagaccacagccaccaagagcgaacatacgggaagagagatcgtcgacctcatgtgccacgccacattcaccatgcgcctgctttctcccgtgcgggttcctaactataatctgattatcatggatgaagctcattttaccgacccggcgagcatcgccgctagaggctacatttccacacgcgtggggatgggagaggccgccgctatcttcatgaccgccacaccccctggcaccgcggaggcttttccccagtctaacgcccctattcaggacgaggagcgggatatccccgaaagaagctggaatagcgggaacgagtggattacggacttcgtcggcaaaacagtgtggtttgtgccgtctatcaaggccggaaatgatattgctaactgtctccgcaaaaacggcaagaaggtcatccaactgagccggaaaaccttcgacacagaatatcagaagaccaaactgaatgattgggactttgttgtgacgaccgatatctccgagatgggggccaacttcaaggcggacagagtgattgatcctcggcgctgcctcaaacccgtcatccttacagacggacccgagagagtgattctggccggccctatgcccgttaccgctgcctctgctgcccagcggcgcgggagagtgggacggaatcctcagaaggaaaacgatcaatacatctttacaggccagccgctgaataacgacgaggaccacgctcactggaccgaagccaagatgctcctggataatattaacacacccgaggggatcatccctgcgcttttcgaacccgagagagagaaaagcgccgctattgacggcgaataccgcctgaagggagagtcccggaaaaccttcgtcgaactcatgagacgcggcgatctgcctgtgtggctggcccataaggttgctagcgaggggatcaaatatacggaccggaagtggtgctttgatggagaaagaaataaccagattctcgaggagaatatggacgtggaaatctggacaaaagagggcgaacgcaagaaacttcggcccagatggctggatgcccgcacctactctaacccgctggccctcaaagagttcaaggactttgctgcggggagaaaatccattgccctggatcttgtcaccgaaatcggacgggtgcctagccacctggctcatcgcacaagaaatgccctcgacaacctggtcatgctgcacacctctgagcacggcggccgggcctatcgccatgctgtggaggaactccccgagacaatggaaacgcttctgctgctcgggctgatgatccttctgaccggaggcgccatgctgttcctgatttccgggaagggaatcggcaaaacaagcattgggctgatctgtgttattgtgtcctctggaatgctctggatggcggatgtgcctcttcagtggatcgccagcgctattgtcctggagtttttcatgatggttctgctcatccccgagcctgaaaagcaaagaacaccccaggacaatcagctggcctacgtggtgatcggcattcttacactggctgccatcgtcgcggccaacgagatgggcctcctggaaaccacgaagcgggatctggggatgtccaaagagccgggagtggttagccctacctcttatctcgacgtggaccttcaccccgcttccgcctggacactgtacgctgtcgccaccacagtgattacccccatgctgagacatacgatcgaaaatagcacagctaacgtctctctcgccgcgattgccaaccaagctgtggttctgatgggccttgataaggggtggcctatcagcaaaatggacctgggagtgccgctcctggccctgggctgctattcccaggtcaatcccctcacccttacagctgccgtgctgctgctcgttacccactacgccatcattgggcctggactgcaggcgaaggctacccgcgaggcccagaaacggacagctgccggcatcatgaagaaccccacggtggatggcattatgaccatcgaccttgatcctgtcatttacgactctaagtttgagaaacaactgggacaggtgatgctcctggtgctgtgtgccgttcagctccttctgatgagaacaagctgggctctgtgcgaagccctcaccctggcgacaggacccatcaccacgctttgggagggctcccctgggaagttctggaatacaaccatcgccgtctctatggctaacatttttcgcggaagctatctggccggcgctgggctcgccttctccatcatgaaaagcgtgggaaccggcaagcggggcacagggtctcagggagaaaccctgggcgagaaatggaagaagaaactgaatcaactctccagacgggaatttgagctttacaagaaaagcgggattacagaggtggatcgcacggaagcgaaggagggactgaaaagaggcgaaaccacacatcacgccgtctcccgggggtctgctaagctgcagtggttcgttgagcgcaacatggtgatcccggaaggaagagtgattgacctcggctgtggcagagggggatggagctattactgcgccggcctgaaaaaggtcaccgaggtgcgcgggtatacaaagggaggccccgggcacgaggaacctgttcccatgtccacctacggatggaatacggtgaaacttatgtctggcaaggatgtcttttatctgcctcccgagaaatgtgacaccctcctgtgcgatatcggcgaaagctccccgagccctacagtggaggagtctagaaccattcgggttctgaagatggtggaaccctggctcaaaaacaatcagttctgtatcaaggtccttaacccctacatgcctacagtgatcgagcatctggaacgcctgcagagaaagcacgggggaatgctcgtgcggaatcccctgtccagaaacagcacccatgagatgtactggatttctaatggcacagggaacatcgtctccagcgttaatatggtgtctcgccttctgctcaaccggttcaccatgacgcacagacgccctacaattgaaaaagacgtggatctgggagctggcacccggcacgtcaacgccgagccggagacccccaatatggacgtgatcggggaaagaattaagcgcatcaaagaggaacatagctccacatggcactatgacgatgagaacccttacaagacgtgggcttatcatggatcttacgaagttaaagccaccggcagcgcgtccagcatgatcaatggcgtggtcaagctgctcacaaagccctgggacgtggttcctatggtgacccaaatggccatgacagataccacaccctttgggcagcagcgggtcttcaaagagaaggtggacaccagaacgccgcgccctatgcccggaacccggaaagttatggagattacagctgaatggctgtggagaacccttggccgcaacaagcggcctagactgtgcacacgcgaggaatttaccaaaaaggtgagaacgaatgccgctatgggggccgtcttcacagaggaaaaccaatgggagtccgcccgggcggctgtggaggatgaagagttttggaagctcgtcggacgcgaaagagagctgcacaaacttggcaagtgtgggtcttgcgtgtataatatgatgggcaaacgggagaagaaactgggagagttcggcaaggccaaagggagcagagccatctggtacatgtggctcggagctcggtatctggagtttgaagccctgggcttcctcaacgaggaccattggttttcccgcgaaaattcttacagcggggttgagggagagggcctgcacaaacttgggtacattctgagagatatctccaagattcccggcggagctatgtatgccgacgataccgcgggctgggacacacggatcaccgaagatgacctccacaacgaggagaagatcacgcagcagatggaccctgagcatcgccagctggccaatgctattttcaaacttacctaccaaaacaaagtggtcaaggtgcagagacccacaccgaaagggaccgtgatggatatcatttctcggaaggaccagcgcggaagcggccaggttgggacatatggactgaatacctttacaaacatggaagcccaactcatcagacagatggagggcgagggggtgctgtccaaggctgatctggaaaatcctcacctcctggagaaaaagattacccagtggcttgaaacgaaaggcgtcgagcggctgaagcgcatggccatcagcggagacgattgcgtggttaaacccatcgacgatagattcgcgaacgccctcctggctcttaacgacatgggcaaggtgcggaaggatattccccagtggcaaccttctaaagggtggcatgactggcagcaggtcccgttttgttcccaccacttccatgaactgatcatgaaggatggacgcaaactcgtggtcccctgcagacctcaggacgagctgattggccgggcccgcatcagccaaggggctggatggtctctgaaggagacagcctgtctcggcaaggcttacgcccagatgtggtccctgatgtatttccacagacgggatcttagactggcgagcaatgccatttgctctgctgtgcccgttcattgggtgcctacctcccgcaccacatggagcatccacgcccatcaccagtggatgaccacagaagacatgctcacggtctggaaccgggtgtggattgaggacaatccctggatggaagataagacccctgttacaacctgggaggacgtgccctacctggggaagagagaggatcaatggtgtggctcccttatcggactgacaagccgcgccacctgggctcagaacatcctcacggccattcagcaggtccggtctctgatcggcgacgaagagtttctggattatatgccgagcatgaaaagattccgcaaggaagaggaatccgagggggcgatttggtga

SEQ ID NO: 20881 - RNA, 9873 nt, synthetic construct
  misc_feature 1..9873: note = derived and/or modified CDS sequence (opt5) from DENV-3__KJ622196__SS-prME
  source 1..9873: mol_type = other RNA
accagcctgtgcctcatgatgatgctgcccgccacccttgctttccacctgacgagccgggacggcgaacctcggatgatcgtggggaagaacgaacgcggaaagtctctcctgtttaagaccgccagcggcattaatatgtgtacccttatcgcgatggatctgggggaaatgtgcgacgataccgtcacatacaagtgtccgctcattgctgaagttgaacccgaagacatcgattgctggtgtaacctgacctccacatgggtgacctatggaacgtgcaatcaggccggcgagcatcggcgggacaagcgctctgtggccctggctcctcacgtcgggatgggactcgatacccggacacaaacctggatgagcgccgagggcgcttggagacaggtggaaaaagttgagacatgggccctgcgccatcccggcttcaccattcttgcgctgtttctcgcccactacatcgggacgtccctgacacagaaggtggtcatcttcattcttctgatgctcgtgaccccttctatggctatgagatgtgttggagtgggcaaccgggactttgtcgaagggctgagcggagccacatgggtggatgtggtcctggagcatggcgggtgcgttaccaccatggctaagaataaacccacactcgacatcgagctgcagaagacggaagccacccaacttgcgacactgcgcaaactctgtattgagggaaagatcaccaacattacaaccgattccagatgccctacgcagggcgaagccatcctgccggaggaacaggaccagaattatgtgtgtaaacacacatacgtggatcggggctgggggaacggatgcggccttttcgggaagggaagcctggtgacatgcgctaagtttcaatgtctcgagtctattgagggcaaagtggttcagcacgaaaatctgaagtataccgtgacaatcaccgtccatacaggggaccagcaccaggtgggaaacgacacgcaaggcgttaccgccgagatcacaccccaggcttccaccgtggaagccattctgcctgagtacggcacactcgggctggaatgcagcccccgcaccggacttgatttcaatgagatgatcctgctcacgatgaaaaacaaggcctggatggtccatagacagtggtttttcgacctgcctcttccctggacctctggcgctattacagagaccccgacatggaatcggaaagaactgctcgtgacctttaagaacgcgcacgccaaaaagcaagaggtcgtggttctggggtcccaggaaggagctatgcacacggccctgacaggcgccaccgagatccagaatagcgggggcacatctattttcgctggacatctcaagtgtcgcctgaaaatggataaacttgaactgaaaggcatgtcctatgccatgtgcctcaacacctttgtgctgaagaaagaggtcagcgagacccagcacgggacaatcctgatcaaggtggaatacaagggagaggacgcgccttgtaaaattcccttctccacggaagatggccaagggaaggctcataacggaagacttatcaccgccaatcctgttgtgaccaagaaggaggagcccgtcaacattgaagccgagccccctttcggcgaatctaatatcgtgattgggatcggcgacaaagctctcaagatcaactggtacaagaaaggaagctccattggcaagatgtttgaggccaccgctagaggggccagacgcatggcgatcctgggagatacagcctgggacttcggcagcgtcggcggggttctcaattctctcgggaaaatggtccaccagatttttgggtccgcttataccgccctgttcggcggagtgagctggatcatgaagattggcatcggggtgcttctgacgtggattggactcaactctaaaaatacaagcatgtccttttcttgcatcgtcatcggcattatcaccctgtacctggggaccgtggttcaggctgatatgggatgtgtgattaactggaagggcaaggaacttaaatgcgggagcggcatcttcgtcacaaatgaggtgcatacctggacagagcagtataagtttcaagccgactccccgaaacggctcgcgacggccattgctggagcctgggaaaacggcgtttgtgggatcagaagcaccacacgcatggagaatctgctgtggaagcagatcgctaacgaactcaattacattctgtgggagaacaatatcaaacttaccgtggtcgtgggagatattatcggcgttctggaacaggggaagcggacactcacaccccagcctatggagctgaaatattcttggaagacgtggggaaaggccaaaattgtgaccgccgagatccaaaactccagcttcatcattgacggccccaacacacctgaatgcccctctgcttccagagcgtggaatgtctgggaggtggaagactacggctttggggtgttcaccacaaacatctggctgaaacttcgcgaggtctatacccagacatgtgatcaccggctcatgagcgccgctattaaagacgaaagagccgttcacgccgatatgggatactggatcgagtcccagaagaatggctcttggaaactggagaaggctagctttattgaagtgaagacctgcacgtggccgaaatcccatacactgtggtctaacggggtgctcgagagcgacatgatcatccctaagtccctggccggacccattagccagcacaatcatcgccctggctaccacacccaaaccgcggggccctggcaccttggaaaactggaactcgatttcaactattgcgagggcacaaccgtcgtgatcacggagaattgtggcacacgggggccttctctgagaaccacaaccgtttccggaaagctgattcatgaatggtgctgtcgcagctgcacacttcccccgctccggtacatgggcgaggacgggtgttggtatggaatggaaatcagacctattaacgagaaagaagagaatatggtgaagtctctggtctccgctggcagcgggaaggtggataactttaccatgggagttctgtgcctcgccatcctgttcgaggaagtgatgcggggcaaattcggcaagaaacacatgattgccggggtccttctgacgtttatgctcctgctgtctggacagatcacctggcgcgacatggctcatacacttatcatgattggcagcaatgcctccgatagaatggggatgggagtgacctacctggcgctcatcgctacattcaagattcagccctttctggccctcggcttctttctgcggaaacttaccagcagagagaacctgctcctgggggttggactggccatggctacgacacttcaactgcccgaagacatcgagcagatggccaatggcattgctctcggcctgatggccctcaagctgatcacccagttcgaaacatatcagctttggaccgcgctggtgtctctcacctgttccaacacaatctttacgctgaccgtcgcctggcgcacagctaccctgattcttgccggggtgagcctgctccctgtgtgccaatcctctagcatgcggaagacagattggctgccggtcgctgttgccgccatgggagtgccccctctccccctgttcatcttttcccttaaagacaccctgaagagacgctcttggcctctgaatgagggcgtgatggctgtcgggctcgtgagcattctggcgtcctctcttctgagaaacgatgttcccatggccggacctctcgtggctggcgggctgctcatcgcctgttacgtcattacgggaacaagcgccgacctgaccgtggagaaagctgccgacgttacctgggaagaggaagcggagcagacaggcgtgtcccacaaccttatgatcaccgtcgatgacgatggcacaatgcggatcaaggacgatgaaacggagaatattctgaccgtgctgctcaaaacagctctgcttatcgtcagcgggattttcccctattctatcccggccaccctgctcgtgtggcatacatggcagaagcagacccaacgctccggagttctgtgggacgtgccttctccccctgagacgcagaaagccgaactcgaggaaggcgtctacagaattaagcagcaggggatctttggaaagacccaagtgggcgttggggtgcagaaagagggagtcttccacacaatgtggcacgtgacccggggcgctgtgctgacacataacggcaagcgccttgagcccaattgggcctccgttaaaaaggatctgatttcctacgggggaggctggagactgagcgcgcagtggcaaaaaggggaagaggtccaggtgatcgctgtggaaccgggacggaaccctaagaattttcagaccatgcccggcatcttccagacaacgaccggggagattggagccatcgccctcgacttcaagcctggcacatctggctcccccattatcaaccgcgaagggaaagtcgtgggactgtatggcaatggggttgtgaccaagaacggaggctacgtcagcgggattgctcaagccaatgctgagcccgatggccctaccccggagcttgaagaggaaatgtttaaaaagagaaacctgacaatcatggacctccaccccggatccggcaaaacgcggaagtatctgcctgccatcgtgcgcgaggcgattaagagacggctcagaaccctgatccttgcccccacacgcgttgtggctgccgaaatggaggaggctctgaaagggctgcctattcggtaccagaccacagccaccaagagcgaacatacgggaagagagatcgtcgatctcatgtgccacgccacattcaccatgcgcctgctttctcccgtgcgggttcctaattataacctgattatcatggacgaagctcattttaccgatccggcgagcatcgccgctagaggctacatttccacacgcgtggggatgggagaggccgccgctatcttcatgaccgccacaccccctggcaccgcggaggcttttccccagtctaatgcccctattcaggacgaggagcgggacatccccgaaagaagctggaactccgggaatgagtggattacggatttcgtcggcaaaacagtgtggtttgtgccgtctatcaaggccggaaacgacattgctaactgtctccgcaaaaatggcaagaaggtcatccaactgagccggaaaaccttcgatacagaatatcagaagaccaaactgaacgactgggattttgttgtgacgaccgacatctccgagatgggggccaatttcaaggcggatagagtgattgaccctcggcgctgcctcaaacccgtcatccttacagatggacccgagagagtgattctggccggccctatgcccgttaccgctgcctctgctgcccagcggcgcgggagagtgggacggaaccctcagaaggaaaatgaccaatacatctttacaggccagccgctgaacaatgatgaggaccacgctcactggaccgaagccaagatgctcctggacaacattaatacacccgaggggatcatccctgcgcttttcgaacccgagagagagaaaagcgccgctattgatggcgaataccgcctgaagggagagtcccggaaaaccttcgtcgaactcatgagacgcggcgacctgcctgtgtggctggcccataaggttgctagcgaggggatcaaatatacggatcggaagtggtgctttgacggagaaagaaacaatcagattctcgaggagaacatggatgtggaaatctggacaaaagagggcgaacgcaagaaacttcggcccagatggctggacgcccgcacctactctaatccgctggccctcaaagagttcaaggattttgctgcggggagaaaatccattgccctggaccttgtcaccgaaatcggacgggtgcctagccacctggctcatcgcacaagaaacgccctcgataatctggtcatgctgcacacctctgagcacggcggccgggcctatcgccatgctgtggaggaactccccgagacaatggaaacgcttctgctgctcgggctgatgatccttctgaccggaggcgccatgctgttcctgatttccgggaagggaatcggcaaaacaagcattgggctgatctgtgttattgtgtcctctggaatgctctggatggcggacgtgcctcttcagtggatcgccagcgctattgtcctggagtttttcatgatggttctgctcatccccgagcctgaaaagcaaagaacaccccaggataaccagctggcctacgtggtgatcggcattcttacactggctgccatcgtcgcggccaatgagatgggcctcctggaaaccacgaagcgggacctggggatgtccaaagagccgggagtggttagccctacctcttatctcgatgtggaccttcaccccgcttccgcctggacactgtacgctgtcgccaccacagtgattacccccatgctgagacatacgatcgaaaacagcacagctaacgtctctctcgccgcgattgccaatcaagctgtggttctgatgggccttgacaaggggtggcctatcagcaaaatggatctgggagtgccgctcctggccctgggctgctattcccaggtcaaccccctcacccttacagctgccgtgctgctgctcgttacccactacgccatcattgggcctggactgcaggcgaaggctacccgcgaggcccagaaacggacagctgccggcatcatgaagaatcccacggtggacggcattatgaccatcgatcttgaccctgtcatttacgattctaagtttgagaaacaactgggacaggtgatgctcctggtgctgtgtgccgttcagctccttctgatgagaacaagctgggctctgtgcgaagccctcaccctggcgacaggacccatcaccacgctttgggagggctcccctgggaagttctggaacacaaccatcgccgtctctatggctaatatttttcgcggaagctatctggccggcgctgggctcgccttctccatcatgaaaagcgtgggaaccggcaagcggggcacagggtctcagggagaaaccctgggcgagaaatggaagaagaaactgaaccaactctccagacgggaatttgagctttacaagaaaagcgggattacagaggtggaccgcacggaagcgaaggagggactgaaaagaggcgaaaccacacatcacgccgtctcccgggggtctgctaagctgcagtggttcgttgagcgcaatatggtgatcccggaaggaagagtgattgatctcggctgtggcagagggggatggagctattactgcgccggcctgaaaaaggtcaccgaggtgcgcgggtatacaaagggaggccccgggcacgaggaacctgttcccatgtccacctacggatggaacacggtgaaacttatgtctggcaaggacgtcttttatctgcctcccgagaaatgtgataccctcctgtgcgacatcggcgaaagctccccgagccctacagtggaggagtctagaaccattcgggttctgaagatggtggaaccctggctcaaaaataaccagttctgtatcaaggtccttaatccctacatgcctacagtgatcgagcatctggaacgcctgcagagaaagcacgggggaatgctcgtgcggaaccccctgtccagaaatagcacccatgagatgtactggatttctaacggcacagggaatatcgtctccagcgttaacatggtgtctcgccttctgctcaaccggttcaccatgacgcacagacgccctacaattgaaaaagatgtggacctgggagctggcacccggcacgtcaatgccgagccggagacccccaacatggatgtgatcggggaaagaattaagcgcatcaaagaggaacatagctccacatggcactatgacgacgagaatccttacaagacgtgggcttatcatggatcttacgaagttaaagccaccggcagcgcgtccagcatgatcaacggcgtggtcaagctgctcacaaagccctgggatgtggttcctatggtgacccacatggccatgacagacaccacaccctttgggcaacagcgggtcttcaaagagaaggtggataccagaacgccgcgccctatgcccggaacccggaaagttatggagattacagctgaatggctgtggagaacccttggccgcaataagcggcctagactgtgcacacgcgaggaatttaccaaaaaggtgagaacgaacgccgctatgggggccgtcttcacagaggaaaatcagtgggagtccgcccgggcggctgtggaggacgaagagttttggaagctcgtcggacgcgaaagagagctgcataaacttggcaagtgtgggtcttgcgtgtataacatgatgggcaaacgggagaagaaactgggagagttcggcaaggccaaagggagcagagccatctggtacatgtggctcggagctcggtatctggagtttgaagccctgggcttcctcaatgaggatcactggttttcccgcgaaaactcttacagcggggttgagggagagggcctgcacaaacttgggtacattctgagagacatctccaagattcccggcggagctatgtatgccgatgacaccgcgggctgggatacacggatcaccgaagacgatctccataatgaggagaagatcacgcaacagatggaccctgagcaccgccagctggccaacgctattttcaaacttacctaccagaataaagtggtcaaggtgcaaagacccacaccgaaagggaccgtgatggacatcatttctcggaaggatcagcgcggaagcggccaggttgggacatatggactgaacacctttacaaatatggaagcccagctcatcagacaaatggagggcgagggggtgctgtccaaggctgacctggaaaaccctcatctcctggagaaaaagattacccagtggcttgaaacgaaaggcgtcgagcggctgaagcgcatggccatcagcggagatgactgcgtggttaaacccatcgatgacagattcgcgaacgccctcctggctcttaatgatatgggcaaggtgcggaaggacattccccagtggcagccttctaaagggtggcacgattggcaacaggtcccgttttgttcccaccatttccacgaactgatcatgaaggacggacgcaaactcgtggtcccctgcagacctcaggatgagctgattggccgggcccgcatcagccagggggctggatggtctctgaaggagacagcctgtctcggcaaggcttacgcccaaatgtggtccctgatgtatttccatagacgggaccttagactggcgagcaacgccatttgctctgctgtgcccgttcactgggtgcctacctcccgcaccacatggagcatccatgcccaccaccagtggatgaccacagaagatatgctcacggtctggaatcgggtgtggattgaggacaacccctggatggaagacaagacccctgttacaacctgggaggatgtgccctacctggggaagagagaggaccagtggtgtggctcccttatcggactgacaagccgcgccacctgggctcaaaatatcctcacggccattcagcaggtccggtctctgatcggcgatgaagagtttctggactatatgccgagcatgaaaagattccgcaaggaagaggaatccgagggggcgatttggtga

SEQ ID NO: 20882 - RNA, 9873 nt, synthetic construct
  misc_feature 1..9873: note = derived and/or modified CDS sequence (opt5) from DENV-3__KJ830751__SS-prME
  source 1..9873: mol_type = other RNA
acaagcctgtgcctcatgatgatcctgcccgccgctcttgccttccacctgacatcccgggacggcgagcctcggatgattgtggggaagaatgaacgcggaaagtctctcctgtttaagacggcgagcggcatcaatatgtgtacccttattgctatggatctgggggagatgtgcgacgatacagtgacctacaaatgtccgcatatcacagaagttgagcccgaagacattgattgctggtgtaacctcacctccacatgggtgacctatggaacgtgcaatcaggccggcgagcaccggcgggacaagcgctctgtggccctggctcctcatgttgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtgattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtgggccagcggcgctacaaccgaaacacctacctggaatcggaaagagcttctggtgacgtttaagaacgcgcacgccaaaaagcaagaagtcgtggttctcgggtctcaggagggagctatgcacacagccctgaccggcgccacagaaatccaaaattccgggggcaccagcattttcgctggacatctgaagtgtcgcctcaaaatggacaagctggagcttaaaggcatgtcttacgccatgtgcaccaacacatttgtgctgaagaaagaggtctccgaaacgcagcacgggaccatcctcatcaaggtggagtacaagggagaagatgcgccctgtaaaattcctttcagcacagaggacggccaagggaaggctcataacggaagactgatcaccgccaatcccgttgtgaccaagaaggaggaacccgtcaacattgaggccgaacctccgttcggcgagtccaatatcgtgattgggatcggcgataacgctctgaaaatcaattggtataagaagggatctagcattggcaaaatgtttgaagccaccgctagaggggccagacgcatggcgatccttggagacacggcctgggatttcggctccgtcgggggagttctcaacagcctgggcaagatggtccaccagatttttgggtctgcttacacagccctgttctccggcgtgagctgggtgatgaaaatcggaattggcgtcctcctgacctggatcgggcttaattctaagaacaccagcatgtccttttcttgcattgctatcggaatcattacactgtatctcggcgccgtggttcaggcggacatggggtgtgtgatcaattggaaaggaaaggagctgaagtgcggcagcgggattttcgtcaccaacgaggtgcatacatggacggaacagtacaaatttcaagccgattcccccaagcggctggctaccgccatcgctggcgcctgggagaatggagtttgtggcattagaagcacaacccgcatggaaaaccttctctggaaacagatcgccaatgagctgaactatatcctgtgggaaaataacattaagctcacagtggtcgtgggggacaccatcggagttctggagcagggcaaacggacgcttacccctcagcccatggagctgaagtactcttggaaaacatgggggaaggctaagattgtgaccgcggaaacacaaaactccagcttcatcattgatggacctaatacccccgagtgcccgtctgcctccagagcttggaacgtctgggaagtggaggactatggctttggcgtgttcacaaccaatatctggctcaaactgcgcgaagtctacacgcagctgtgtgaccaccggcttatgagcgccgccgttaaggatgagagagctgtgcacgccgacatggggtactggatcgagtcccagaaaaacggatcttggaagctcgaaaaagcgagcctgattgaggtgaagacatgcacctggcctaagtcccataccctgtggtctaatggcgtcctcgaaagcgatatgatcattcccaaatccctggctgggcctatcagccagcacaactatcgccccggataccatacacaaaccgccggcccttggcaccttgggaagctggagctcgactttaattattgcgagggaacgacagtggttattaccgaatcttgtggcacacggggcccctccctgagaaccacaaccgtgagcgggaaactgatccacgagtggtgctgtcgctcttgcacgcttccgcctctccggtacatgggagaagatggctgttggtatgggatggagatcagacccatttccgaaaaggaggagaacatggtcaaaagcctggtgtctgccggaagcggcaaggttgacaatttcaccatgggggtgctgtgcctcgctatcctgtacgaagaggtcatgcggggaaagtttggcaaaaagcatatgattgccggcgtgttcttcacatttgttcttctgctctccgggcagatcacctggcgcaacatggcgcacacactgattatgatcggaagcaatgcttctgatagaatgggcatgggggtgacctatctggcccttattgccacgttcaaaatccagccctttctggctctcggattctttctgcggaagctcacatccagagaaaacctgcttctgggcgtcgggctcgccatggctaccacactgcaactgcctgacgatatcgagcagatggccaatggaattgcgcttggcctgatggccctcaaactgatcacccagttcgaaacctaccagctctggacagctctggtgagccttacgtgttccaacaccatgtttacactgaccgtggcctggcgcacagctaccctcattctggccggcgtctctctgcttccggtttgccaaagctcctctatgcggaagacggactggctgcccatggccgtggctgcgatgggggtgcctcccctccctctgttcatctttaatctcaaggatacactgaaaagacgcagctggccccttaacgagggagtcatggccgtgggcctggtttccattctggcttctagcctcctgagaaacgacgtgcctatggccgggccccttgtcgccggaggcctgctcatcgcttgttacgtgatcaccgggacctccgccgatctgacagttgagaaggcggctgacgtgacctgggaagaggaagccgagcagacaggagtcagccataatctcatgattacggtggacgatgacggcaccatgcggatcaaagatgacgaaattgagaacatcctgacagtccttctgaagaccgccctgctcattgtgtctggcatcttcccgtattccatccctgctacactgcttgtttggcacacctggcagaaacagacgcaacgcagcggggtgctgtgggatgtcccctctcctcccgagacccagaaggccgaactcgaggaaggagtgtacagaattaaacagcagggcatctttgggaagacacaagttggagtgggcgtccagaaggagggggtgttccataccatgtggcacgtgacacggggagcggttctgacccacaatggcaaacgcctcgagccgaactgggcttccgtcaagaaagacctgattagctatggcgggggatggagactttctgcccagtggcaaaagggcgaagaggtccaggtgatcgccgtcgaacctgggaaaaatcccaagaactttcagacaatgcctggaacgttccagaccacaaccggcgagattggggctatcgccctggatttcaagcccggaacctccggcagccccattatcaatcgggaaggcaaagtggttgggctgtacggaaacggcgtggtcacaaagaatgggggatatgtgtccggcatcgctcaaacgaacgccgagcctgacgggccgacccccgagctcgaagaggaaatgtttaaaaagcgcaatctgacaattatggatcttcatcctggcagcggaaaaaccagaaagtacctgcccgcgatcgttcgggaggccattaagcgcagactccggacactgatcctcgctcctaccagagtggtcgccgctgaaatggaggaggccctgaaaggccttcccattcgctatcagacgacagccaccaagtctgaacacaccgggcgggagatcgtggacctgatgtgccatgctacattcaccatgagactgctcagccctgttcgcgtgccgaactacaatctgatcattatggatgaagcgcactttacagaccccgcctccatcgctgcccggggatacatttctaccagagtcggcatgggggaggccgctgccatcttcatgacggcgacacctcccggaaccgctgatgcctttcctcagagcaacgcccccattcaggacgaggaacgcgacatcccggagcggtcctggaactctggcaacgaatggatcacagatttcgctgggaaaaccgtgtggtttgtgcctagcattaaggccggcaacgacatcgcgaattgtcttcgcaaaaacggaaagaaggtcattcaactgtccagaaaaacgttcgataccgagtatcagaagacaaaactcaatgactgggattttgttgtgaccacagacatctctgaaatgggcgccaacttcaaggctgatcgggtgattgaccccagacggtgcctgaaacccgtcatcctgaccgatgggcctgagcgcgtgattctcgccggacccatgcctgttacagctgccagcgctgcccagagacggggccgcgtggggagaaatccgcagaaggagaacgaccaatacatctttaccggacagccccttaataacgatgaagaccatgcgcactggacggaggccaagatgctgctggacaatatcaacacacctgaaggcattctccccgctctgttcgagcctgaacgggagaaatccgccgctatcgatggggagtatagacttaagggcgaaagccgcaaaaccttcgtcgagctgatgcggagaggagacctccccgtgtggctggcccacaaggttgcctctgaaggcattaaatacaccgatcgcaagtggtgctttgacgggcagcggaataaccagatcctggaggaaaatatggatgtggagatttggacaaaagagggagaaaagaagaaactcagaccgcgctggcttgacgctcggacctattccgatcctctggcgctgaaggagttcaaagactttgccgctggcagaaagagcatcgccctcgatctggtcacagaaatcgggcgcgtgccctctcatcttgcccacagaacgcggaacgctctggacaatctcgtcatgctgcatacctccgagcacggaggccgcgcctacagacacgcggtggaggaactgcctgagacaatggaaaccctccttctgctgggcctcatgattctgcttacagggggagccatgctgttcctcatcagcggcaaagggattggaaagacctccatcggcctgatttgtgttatcgcttctagcgggatgctgtggatggccgaggtgcccctccaatggatcgcttccgccattgtgcttgaatttttcatgatggtcctgctgatccctgagcccgagaagcagcggacgccgcaggataaccaactcgcgtatgttgtgattggaatcctgacccttgccgctattatcgccgctaatgaaatgggcctgctcgagacaaccaaacgcgacctgggcatgagcaaggaacctggggtggtctctcccacatcctacctggatgtggacctccatcccgccagcgcttggaccctttacgccgttgcgacgacagtgattacccctatgctgagacacacaatcgagaactctaccgccaacgtcagcctggctgccatcgctaatcaggccgtggtcctcatgggactggacaaaggctggccgatttccaagatggatcttggggtgcccctgctcgccctgggatgctattctcaggttaaccctctgaccctcacagcggctgtgcttctgctgatcacgcattacgccattatcggccccgggctccaggctaaagccacccgggaagcccaaaagagaacagctgccggaattatgaagaatcctaccgtcgacggcatcatgacaatcgatctggaccccgtgatttatgatagcaaatttgagaagcagcttggccaggttatgctgctcgtgctgtgtgcggtccagctgctccttatgcgcacctcctgggccctgtgcgaggctctgacgctcgccacagggcctatcaccaccctgtgggaaggatctccgggcaaattctggaacacaaccattgctgtgagcatggccaatatctttcgggggtcctaccttgcgggagccggcctggctttcagcattatgaagtctgtggggacaggaaaaagaggcacgggctcccaaggggagaccctcggagaaaagtggaagaaaaagctgaaccagctgagccgcaaagagtttgacctctataagaaatccggcatcacagaagttgatcggaccgaggccaaggaggggcttaaaagaggagaaacaacccaccatgctgtctctcggggcagcgccaagctgcagtggttcgtggagcgcaatatggtggtccccgaagggagagttatcgacctgggatgtggccggggcgggtggtcctactattgcgctggactcaagaaagtgacggaggtgcgcggctacaccaaagggggacctggccacgaggaacccgtccctatgtctacatacgggtggaacattgtgaaactgatgagcggaaaggatgtcttttatcttcccccggagaaatgtgacaccctgctctgcgatatcggcgaatccagcccttctcccacagtggaggaatccagaaccattcgggtcctgaagatggtggagccctggctgaagaataaccagttctgtatcaaagttctcaatccttacatgcccacagtgattgagcaccttgaacgcctgcaaagaaagcatggcgggatgctggtccggaaccctctcagccgcaattctacccacgagatgtattggatctccaacggaacgggcaatattgtgagctctgtgaacatggtcagcagactgcttctgaaccggttcacaatgacccatagacgcccgaccatcgaaaaagacgttgatctcggggccggaacacggcacgtgaatgcggagcccgaaacgcctaacatggacgtgatcggcgagagaattaagcgcatcaaagaggaacacaattccacctggcattacgacgatgagaacccctataagacatgggcctaccacgggtcttatgaagtcaaggctaccggaagcgcctccagcatgattaatggcgtggttaaactgctgacaaagccttgggacgtggtccccatggtgacccagatggctatgacagataccacgccgtttggccagcaacgggttttcaaagagaaggtggacaccagaacacctcgccccatgcctgggacccggaaagtcatggaaatcacagccgagtggctctggagaaccctgggacgcaacaagcggcccagactttgcacgcgcgaggaatttacaaagaaagtgcggaccaatgccgcgatgggcgctgttttcacagaggaaaaccagtgggattccgccaaggccgctgtggaggacgaagagttttggaaactggtcgatagagagcgcgaactccataagctggggaaatgtggatcttgcgtgtacaatatgatgggcaagagagagaagaaacttggggagttcggcaaagccaaaggaagccgggctatttggtacatgtggctgggcgcccgctatctcgagtttgaggcgctggggttcctgaacgaagaccactggttttccagagaaaattcttacagcggagtcgaaggcgaggggctccataagctgggatatatccttcgggatatctccaaaattcctggcggggccatgtacgctgacgataccgccggctgggacacgagaatcaccgaagacgatctgcacaacgaggagaagattatccagcagatggaccccgaacaccggcaactcgctaatgccattttcaaactgacatatcagaacaaggtggttaaggtgcagcgcccgacccctacaggaaccgtcatggatatcatctctagaaaagaccagcggggcagcgggcaagtgggaacatacggccttaatacctttacgaacatggaggcgcagctggtgcgccagatggaaggggagggagttctcacaaaggccgatctggaaaactcccatctgcccgagaaaaagattacccagtggctcgagaccaaaggcgtggaaagactgaagcggatggctatcagcggggacgattgcgtcgtgaagcccattgacgatcgcttcgccaatgctcttgttgccctgaacgacatgggcaaagtgagaaaggatatccctcaatggcagccgtctcggggatggcacgactggcagcaggtccccttttgttcccatcacttccacgagctcattatgaaagatggccgcaagctggtggtcccttgcagaccccaagacgaacttatcgggcgggctcgcatcagccagggagccggctggtctctgagagagacagcgtgtctcgggaaagcctatgctcagatgtggtccctgatgtacttccatcggcgcgacctgagactcgccagcaatgccatttgctctgctgtgcctgttcactgggtgcccacctcccggacaacgtggagcatccatgcccaccatcaatggatgaccacagaagatatgctgaccgtctggaacagagtgtggattgaggagaatccttggatggaagacaagacacccgttaccacgtgggagaacgtgccgtaccttggaaagcgcgaagatcagtggtgtggctccctgatcgggctcaccagccgggcgacatgggctcagaatattcctaccgccatccagcaagtcagatctctgattggcaacgaggagtttcttgactatatgcccagcatgaaacgcttccggaaggaagaggaatccgagggagccatctggtga

SEQ ID NO: 20883 - RNA, 9873 nt, synthetic construct
  misc_feature 1..9873: note = derived and/or modified CDS sequence (opt5) from DENV-3__KC762681__SS-prME
  source 1..9873: mol_type = other RNA
accagcctgtgcctcatgatgatgctgcccgccacccttgctttccacctgacgtccagagacggcgaacctcggatgattgtggggaagaatgaacgcgggaagtctctcctgtttaagaccgccagcggcattaatatgtgtacccttatcgcgatggatctgggggagatgtgcgacgataccgttacctacaagtgtccgctcattaccgaagttgagcccgaagacatcgattgctggtgtaacctgacgtccacctgggtgacgtatggaacctgcaatcaggctggcgagcatagacgggacaagcgctctgtggccctggcccctcacgtcgggatgggactcgatacaagaacccagacatggatgagcgctgagggcgcctggcggcaggtcgaaaaggttgagacctgggctttccgccatcccggctttacgattctggcccttttcctggcgcactacatcgggacatccctcacccagaaggtggtcatctttattctgcttatgctggtgacaccttctatgaccatgagatgtgttggagtgggcaaccgggacttcgtcgaagggctcagcggagccacctgggtggatgtggtcctggagcatggcgggtgcgttacaacgatggctaagaataagcccaccctggacatcgagctccagaagacagaagccacccaactggctacacttcgcaaactgtgtattgagggaaagatcaccaacgtgacgacagattccagatgccctacccagggcgaagccattctcccggaggaacaggaccagaattatgtgtgtaaacacacctacgtcgatcggggctgggggaacggatgcggcctgtttgggaagggaagccttgtgacatgcgcgaagttccaatgtctggagtttatcgagggcaaagttgtgcagcacgaaaatctcaagtataccgtcattatcacagtgcatacgggggaccagcaccaggttggaaacgagacccaaggcgtgacagccgaaatcacaccccaggcttctacagtcgaggccattctgcctgaatacggcaccctggggctcgagtgcagcccccgcacgggactggacttcaatgagatgatccttctgaccatgaaaaacaaggcttggatggtgcatagacagtggtttttcgatctccctctgccctggacaagcggcgccaccacagaaaccccgacgtggaataaaaaggagcttctggtcacatttaaaaacgcccacgctaagaagcaagaagtggttgtgctcgggtctcaggagggagcgatgcacaccgccctgacaggcgctaccgaaattcagacctccgggggcacaagcatcttcgccggacatctgaaatgtcggctcaagatggacaaactggagcttaagggcatgtcttatgccatgtgcctgaatgctttcgtcctcaaaaaggaggtgtccgaaacgcagcacgggaccattctgatcaaggttgagtacaaaggagaagatgccccttgtaagatcccctttagcacagaggacggccaagggaaagcgcataacggacgcctgattaccgctaaccctgtggtcacaaagaaagaggaacccgtgaatatcgaggccgaaccccctttcggcgagtccaacattgtgatcgggattggcgataaggcccttaagatcaattggtacaaaaagggatctagcatcggcaaaatgtttgaagctaccgccagaggggctcggagaatggccattctcggagacacggcgtgggatttcggctccgttgggggagtcctgaacagcctgggcaagatggtgcaccagatctttgggtctgcctatacagctctcttctccggcgtgagctggattatgaaaatcggaattggcgtcctgcttacctggatcgggctcaattctaagaacaccagcatgtccttttcttgcattgtgatcggaatcattacactctacctgggcgccgttgtgcaggctgacatggggtgtgtcatcaattggaagggaaaagagctgaagtgcggcagcgggattttcgtgaccaacgaggttcatacatggacggaacagtataaatttcaagccgattccccgaagcgccttgcgaccgccatcgctggcgcctgggagaatggagtgtgtggcattcggagcacaaccagaatggaaaacctcctgtggaaacagatcgctaatgagctgaactacatcctctgggaaaataacattaagctgacagtcgtggttggggacatcattggagtgcttgagcagggcaaacgcaccctgacgccccagcctatggatctcaagtattcttggaagacctgggggaaagccaagatcgtcacagccgagacccaaaattccagcttcattatcgacggacccaacacacctgaatgcccctctgcttcccgggcgtggaacgtgtgggaggtggaagactacggctttggcgtcttcaccacaaatatctggctgaaactgagagagatgtatacccagctttgtgatcaccgcctcatgagcgccgctgttaaggacgaacgggccgtgcacgccgatatggggtactggattgagtcccagaaaaacggatcttggaagctggagaaggctagcctgatcgaagtgaaaacgtgcacatggccgaagtcccataccctctggtctaatggcgtcctggagagcgacatgattatccctaaatcccttgccgggcccgtgagccagcacaactacagacctggatatcatacccaaacagcgggcccctggcacctggggaagctcgaactggattttaattactgcgagggaaccacggttgtgattacagagaactgtggcacccgcggcccttctctgcggacaaccacagtctccgggaaacttatccacgaatggtgctgtagaagctgcaccctgcccccgctgcgctatatgggagaggacggctgttggtacgggatggaaatccggcctattaatgagaaggaagagaacatggtgaagtctctggtttccgctggaagcggcaaagtggataatttcacgatgggggtcctctgcctggccatccttttcgaggaagtgatgagaggaaagtttggcaaaaagcatatgattgccggcgttctgttcacctttgtgctcctgctgtctgggcagatcacatggcgggacatggctcgcacccttattatgatcggaagcaacgcctccgatagaatgggcatgggggtcacatatctggcgctcattgctaccttcaaaatccagccctttctggccctcggattctttctgcggaaacttacgagcagagagaatctgctcctgggcgtggggctggccatggctacaacccttcaactgcccgaagacatcgagcagatggccaacggaattgctctcggcctgatggccctcaagctgatcacacagttcgaaacctaccagctttggaccgcgctggtgtctctcatgtgttccaatacaatgtttacgctgaccgtcgcctggcgcacagctaccctgattcttgccggcatcagcctgctccctgtttgccaatcctctagcatgcggaaaacagattggctgccggtgaccgtggctgccatgggggtgccccctctccccctgttcatcttttcccttaaggacacgctgaaaagacgctcttggcctctgaacgagggagtgatggccgttggcctcgtgagcatcctggcttcctctcttctgagaaatgatgtccccatggcggggcctctcgtggccggaggcctgctcatcgcttgttatgttattacagggaccagcgccgacctgaccgtggagaaggccgctgacgtcatctgggaagaggaagccgagcagacaggagtgtcccacaaccttatgattaccgtcgatgacgatggcacaatgcggatcaaagacgatgaaacggagaacattctgaccgtgctgctcaagacagcgctgcttatcgttagcggcatcttcccctactctattccggctaccctgctcgtgtggcatacatggcagaaacagacccaacgctccggggtcctgtgggacgtgccttctccccctgagacgcagaaggccgaactcgaggaaggagtttacagaatcaagcagcagggcatttttgggaaaacccaagtgggagtcggcgtgcagaaggagggggtgttccacacaatgtggcatgttacccggggagccgtcctgacacacaatggcaaacgccttgagcccaactgggcttccgtgaagaaagatctgatctcctatggcgggggatggagactgagcgcccagtggcaaaagggcgaagaggtgcaggtcattgcggtggaaccggggaagaatcctaaaaacttccagaccatgcccggaatctttcagacaacgaccggcgagattggggctatcgccctcgacttcaagcctggaacatctggctcccccatcattaatcgggaaggcaaagttgtggggctgtacggaaacggcgtcgtgaccaagaatgggggatatgttagcggcatcgcccaaaccaacgctgagcccgatgggcctacaccggagcttgaagaggaaatgtttaaaaagcgcaatctgacgattatggacctccaccccggctccggaaagaccagaaaatacctgcctgccatcgtgcgggaggctattaagcgcagactccggacactgatccttgcccccaccagagtcgtggcggccgaaatggaggaggctctgaaaggcctgcctatccgctatcagacaaccgccacaaagagcgctcatacagggaaagaaattgttgatctcatgtgccacgccaccttcaccatgcggctgctttctcccgtgagagtccctaactacaatctgatcattatggacgaggcccattttacagatccggctagcatcgcggcccgcggatatatttccacccgggtgggcatgggggaagctgccgccatcttcatgacagctacaccccctggaacggccgacgcgtttccccagtctaacgctcctatccaggacgaggaaagagatattcccgagcgcagctggaactccggcaacgagtggatcacagacttcgccgggaagaccgtgtggtttgtcccgtctattaaggccggcaatgatatcgctaactgtctccggaaaaacggaaagaaagttattcaactgagcagaaagacattcgacaccgaataccagaaaacgaagctgaatgattgggactttgtggtgaccacagatatctccgagatgggcgccaacttcaagaccgaccgcgtcattgatcctcggagatgcctcaaacccgtgatccttacagacgggcccgaacgggttatcctggcgggacctatgcccgtgaccgtcgcctctgctgcccagcgcagaggccgggtggggcgcaatcctcagaaggagaacgatcaatacattttcacaggacagccgctgaataacgacgaggaccacgctcattggaccgaagccaaaatgctcctggataatatcaacacgcccgagggcattatccctgctctttttgaacccgagagagaaaagagcgccgcgattgacggggagtatcggctgaaaggcgagtccagaaagacattcgttgaactcatgcgccggggagatctgcctgtgtggctggcccacaaagtcgctagcgagggcatcaagtacaccgacagaaagtggtgctttgatggggaacgcaataaccagatcctcgaggaaaatatggacgtggagatttggaccaaagagggagaaaagaagaaacttcggcccagatggctggatgcccgcacatattctgacccgctggctctcaaagagttcaaagattttgccgccggccggaagtccatcgctctggaccttgtcaccgaaattgggagagtgcctagccacctggcgcatcgcacaagaaacgccctcgataatctggttatgctgcacacgtctgagcatggaggccgggcttaccgccacgccgtggaagaactccccgagaccatggaaacacttctgctgctcggcctgatgatccttctgaccgggggagccatgctgttcctgatttccggcaaagggatcggaaagacaagcatcggcctgatttgtgtggtcgcttcctctgggatgctctggatggccgacgttcctcttcagtggatcgcgagcgccattgtgctggagtttttcatgatggtgctgctcatccccgaacctgagaaacaaagaacaccccaggataaccagctggcttatgtcgtgattggaatccttacgctggccgctattgttgccgcgaatgagatgggcctcctggaaaccacaaagcgggacctgggcatgtccaaagagccgggggtggtcagccctacctcttacctcgacgtggatcttcaccccgcctccgcttggacactgtatgccgtcgctaccacggtgatcacacccatgctgcgccataccatcgaaaacagcacagccaatgtttctctcgctgccattgcgaaccaagccgtggtcctgatgggacttgacaagggctggcctatcagcaagatggatctgggggtgccgctcctggctctgggatgctactcccaggttaaccccctcacccttaccgccgctgtgctgctgctcgtcacacactacgccattatcggccctgggctgcaggccaaagcgacgagagaggctcagaagcggaccgccgctggaattatgaaaaatcccacagtggacggcatcatgaccatcgatcttgaccctgtgatttatgattctaagtttgaaaaacaactgggccaggttatgctcctggtcctgtgtgccgtgcagctccttctgatgagaacaagctgggccttctgcgaggctctgaccctcgccacggggcccatcacaaccctgtgggagggatcccctggcaagttttggaacaccacaattgcggtgtctatggccaatatcttccgcgggagctaccttgctggagccggcctggctttttccattatgaaaagcgtcgggaccggaaaacggggcacaggctctcagggggaaacgctcggagagaagtggaaaaagaaactgaaccaactgtccagaaaggagttcgacctctataaaaagagcggcatcaccgaggttgatcgcacagaagccaaggaggggcttaaacggggagagatcacccatcacgcggtgtccagaggctctgccaagctgcagtggttcgtggaacggaatatggtcattccggaggggcgcgtgatcgacctgggatgtggcagaggcgggtggagctactattgcgctggactcaaaaaggttacagaagtgcggggctacaccaaagggggacccggccatgaggaacctgtccccatgtccacgtatgggtggaacattgtgaagctgatgtctggaaaggatgtcttttaccttcctcccgagaaatgtgacaccctgctctgcgatatcggcgagagctccccgagccctacagtggaagagtctcgcaccattagagtcctgaagatggtggaaccctggctgaaaaataaccagttctgtatcaaggtgctcaatccctacatgcctacagtcattgagcaccttgagcggctgcagcgcaaacacggcgggatgctggttagaaaccccctctcccggaatagcacccatgaaatgtattggatctctaacggaacaggcaatatcgtgtccagcgtgaacatggtctctcgcctgcttctgaatagatttaccatgacgcaccggagacctacaattgagaaggacgtggacctcggggccggaacccgccatgttaacgctgaaccggagacccccaacatggatgtgatcggcgaacggattagacgcatcaaggaggagcacagctccacatggcactacgacgaagagaatccttataaaacgtgggcctaccatgggtcttatgaagtcaaggctaccggaagcgcctccagcatgattaacggcgtggttaaactgctgacaaagccctgggatgtggtccctaccgtgacacaaatggcgatgaccgacacaacccccttcggccagcagcgggtttttaaagagaaggtggatacgagaaccccgcgccctatgcccgggacacggaaggccatggaaatcaccgctgagtggctctggagaacactgggacgcaataaacggcctagactttgcacccgcgaggagttcacgaagaaagtccggacaaacgccgctatgggcgccgtgtttaccgaggaaaatcaatgggactccgccagagcggctgtcgaggatgaagagttctggaagctggtggaccgcgagagagaactccacaaactggggaagtgtggatcttgcgtttacaacatgatgggcaaacgggagaagaaacttggggaatttggcaaagccaagggaagccgcgccatctggtatatgtggctgggcgctagatacctcgagttcgaggccctggggtttctgaatgaagatcattggttctcccgggagaactcttttagcggagtggaaggcgaggggctccacaaactgggatacattcttagagacatctccaagattcccggcggggctatgtatgccgatgacacagcgggctgggacacccggatcacggaagatgacctgcataatgaggagaaaattacccagcagatggatcctgaacaccgccagctcgccaacgctatcttcaagctgacataccaaaataaggtcgtgaaagtgcagagacccaccccgaagggaacagttatggacatcatttctcggaaagatcagcgcggcagcggacaggtgggaacctatggccttaacacattcaccaatatggaggtccaactgatcagacagatggaaggggagggagtgctctccaaggccgacctggaaaaccctcacctcctcgagaaagagattacgcagtggctggaaacaaagggcgttgagcggcttaagcgcatggctatcagcggggatgactgcgtggtcaaacccattgatgacagatttgccgatgcgctgctcgccctgaatgacatgggcaaggtgcggaaagatatcccccagtggcaaccttctaagggatggcatgactggcagcaggtcccgttctgttcccaccattttcacgaacttatcatgaaagacggccgcaagctggtggttccctgcagacctcaggatgagctcattgggcgggctcgcatcagccaaggagccggctggtctctgaaggaaaccgcttgtctggggaaagcctacgctcagatgtgggccctcatgtatttccacagacgggacctgcgccttgcgtccaacgccatttgcagcgctgtgcccgtccattgggtgcctacctctagaacaacctggtccatccacgcccatcaccagtggatgacaacggaggatatgctgaccgtttggaaccgggtgtggattgaggacaatccctggatggaagataagacacctgtcaccacatgggaggacgtgccctacctcggaaaaagagaagatcaatggtgtggcagcctgatcgggcttgcctcccgcgctacctgggcccagaacattctgacggcgatccaacaggtgcggagcctcatcggcaatgaggagtttctggactatatgccgtctatgaagagattccgcaaagaagaggaaagcgagggagctatttggtga

SEQ ID NO: 20884 - RNA, 9873 nt, synthetic construct
  misc_feature 1..9873: note = derived and/or modified CDS sequence (opt5) from DENV-3__KC762684__SS-prME
  source 1..9873: mol_type = other RNA
accagcctctgcctcatgatgatgctgcccgccacccttgctttccacctgacgtcccgggacggcgaacctcggatgattgtggggaagaacgaacgcggaaagtctctcctgtttaagaccgccagcggcattaatatgtgtacacttatcgcgatggatctgggggagatgtgcgacgataccgtgacatacaaatgtccgctcattaccgaagttgagcccgaagacatcgattgctggtgtaacctgacatccacctgggtgacgtatggaacctgcaatcaggctggcgagcatagacgggacaagcgctctgtggccctggcccctcacgttgggatgggactcgatacaagagctcaaacctggatgagcgccgagggcgcttggagacaggtggaaaaagttgagacatgggccttccgccatcccggctttaccattctggcgcttttcctggcccactacatcgggacgtccctcacacagaaggtggttatctttattctgcttatgctggtgaccccttctatgacaatgagatgtgttggagtgggcaaccgggacttcgtggaagggctcagcggagctacctgggtggatgtggtcctggagcatggcgggtgcgttaccacaatggccaagaataaacccacgctggacatcgagctccagaagaccgaagctacacaactggccacccttcgcaaactgtgtattgagggaaagatcacaaacgtgaccacggattccagatgccctacacagggcgaagcgattctcccggaggaacaggaccagaattatgtgtgtaaacacacctacgtcgatcggggctgggggaacggatgcggcctgtttgggaagggaagccttgtgacctgcgccaagttccaatgtctggagctcatcgagggcaaagttgtgcagcacgaaaatctgaagtatacagtctctattaccgtgcatacaggggaccagcaccaggttggaaacgagacgcaaggcgtgaccgctgaaatcacaccccaggcctccaccgtcgaggctatcctgcctgaatacggcacactcgggctggagtgcagcccccgcaccggacttgactttaatgagatgattctgctcacgatgaaaaacaaggcctggatggtgcatagacagtggttctttgatctgcctcttccctggacctctggcgccacaaccgaaacaccgacctggaataaaaaggagctgctcgtcacgttcaaaaacgctcacgcgaagaagcaagaagtggttgtgctggggtcccaggagggagccatgcacacagctctgaccggcgccacagaaatccagaccagcgggggcacctctatttttgccggacatctcaaatgtcggctgaagatggacaaacttgagctgaagggcatgtcctatgctatgtgcagcaatgccttcgtcctcaaaaaggaggtgtccgaaacacagcacgggacgatcctgattaaggttgagtacaaaggagaagatgcgccttgtaagatccccttctctaccgaggacggccaagggaaagctcataacggacgcctgatcacagccaaccctgtggtcaccaagaaagaggaacccgtgaatattgaggccgaacccccttttggcgagagcaacatcattatcgggattggcgataaggctcttaagatcaattggtacaaaaagggatccagcatcggcaaaatgttcgaagccacagctagaggggcccggagaatggcgattctcggagacaccgcctgggattttggctctgtcggcggggttctgaactccctggggaagatggtccaccagatcttcgggagcgcttatacggccctcttttctggcgtgagctggattatgaaaatcggaattggcgtgctgcttacatggatcgggctcaatagcaagaacacctctatgagcttctcctgcattgtcatcggaatcattaccctctacctgggcgctgtggttcaggccgacatggggtgtgtgatcaattggaagggaaaagagctgaagtgcggcagcgggatttttgtcacaaacgaggtgcatacctggacagaacagtataaattccaagcggattctccgaagcgccttgccacggctatcgccggcgcttgggagaatggagtttgtggcattcggtccaccacaagaatggaaaacctcctgtggaaacagatcgccaatgagctgaactacatcctctgggaaaataacattaagctgaccgtggtcgtgggggacatcattggaatccttgagcagggcaaacgcacactgacaccccagcctatggagctcaagtatagctggaagacgtgggggaaagccaagattgttaccgctgaaatgcaaaattcttcctttatcatcgatggacccaacacacctgagtgccccaacgcgagccgggcctggaatgtgtgggaagtcgaggactacggcttcggcgtgtttaccacaaacatttggctgaaactgagagaaatgtatacccagctttgtgaccaccgcctcatgtccgctgccatcaaggatgagcgggccgtgcacgctgacatggggtactggattgagtctcagaaaaatggaagctggaagctggaaaaggcctccctgatcgaggtcaaaacatgcacctggccgaagtctcatacgctctggagcaacggcgttctggaatccgatatgattatccctaaaagccttgcggggcccatctctcagcacaattacagacctggatatcatacacaaaccgctggcccctggcacctggggaagctcgagctggacttcaactactgcgagggaaccacagtggtgattaccgaaaattgtggcacgcgcggcccttccctgcggacaaccacagtcagcgggaaacttatccacgagtggtgctgtagatcttgcaccctgcccccgctgcgctatatgggagaagatggctgttggtacgggatggagattcggcctatcaacgaaagagaggagaatatggtgaagtccctggttagcgccggatctggcaaggtggacaactttacaatgggggtcctctgcctggccattcttttcgaagaggtgatgcggggaaaattcggcaagaaacatatgatcgctggcgtctttttcacctttgtgctgctcctgagcgggcagattacgtggcgcgatatggccagaaccctgatcatgatcggatccaatgcgagcgaccggatgggcatgggggtcacatatcttgctctgattgccaccttcaagatccagccctttctcgccctgggattctttctcagaaaactgacatctcgcgaaaaccttctgctcggcgtggggctggctatggccaccacgctgcaacttcccgaggatattgaacagatggctaatggaatcgccctgggcctcatggcgctgaagctcgttacacagttcgagacctaccagctgtggacagcccttgtgtccctgatgtgtagcaacaccatttttaccctcacagtcgcttggcggacggccaccctgatcctggctggcatctcccttctgcctctctgccaatctagcgggatgagaaagacagactggctgccgatgaccgtggccgccatgggagtgccccctctccccctgttcatcttttcccttaaagatacactgaagcgcagatcttggcctctgaatgagggcgtcatggctgttgggctcgtgagcatcctggcgtcctctcttctgcggaacgacgtgcccatggccggacctctcgtcgctggcgggctgctcattgcctgttatgtgatcaccggaacgagcgccgatctgacagttgaaaaagctgccgacgtgacctgggaggaagaggcggaacagaccggcgtctcccacaaccttatgattacagtggacgatgacggcaccatgcgcatcaaggatgacgagacagagaatatcctgacggttctgctcaaaaccgctctgcttattgtgagcgggatcttcccctactctattccggccacactgctcgtctggcatacctggcagaagcagacacaaagatccggagtgctgtgggatgtcccttctccccctgaaacccagaaagccgagctcgaagagggcgtgtaccggatcaagcagcaggggatttttggaaagacgcaagttggcgtgggggtccagaaagagggagtgttccacaccatgtggcatgttacacgcggcgctgtgctgacctataacggcaagagacttgaacccaattgggcctccgtcaaaaaggacctgatctcctacgggggaggctggcggctgagcgcgcagtggcaaaaaggggaggaagtccaggtgattgctgttgagccgggaaagaaccctaagaatttccagacaatgcccggcatctttcagaccacaacgggggaaatcggagccattgccctcgatttcaaacctggcacctctggctcccccatcattaaccgcgaggggaaggtcgtgggactgtatggcaatggggtggtcaccaagaatggaggctacgtgagcgggatcgctcaaacctccgccgagcccgacggccctaccccggaacttgaggaagagatgtttaagaaaagaaatctgacaattatggatctccaccccggaagcggcaagacgcggaagtatctgcctgctatcgttcgcgaagccatcaaaagacggctcagaaccctgattcttgcgcccacacgcgtggtcgccgctgagatggaggaagccctgaaggggctgcctatccggtaccagaccacagctaccaaatctgagcacacgggaaaggaaattgtggacctcatgtgccatgccacattcaccatgagactgcttagccccgttcgcgtgcctaactataatctgatcattatggatgaggcccactttaccgacccggcttccatcgcggcccggggctacatctctacaagagtcgggatgggagaagctgccgccattttcatgaccgctacaccccctggcaccgccgatgcgtttccccagagcaacgctcctatccaggacgaggagcgcgacattcccgaacggtcctggaactctgggaacgattggatcacggacttcgccggcaaaacagtgtggtttgttccgagcattaaggccggaaatgatatcgctaactgtctcagaaagaacggcaaaaaggtgattcaactgtcccgcaaaaccttcgacacagagtaccagaagaccaaactgaatgattgggactttgtcgtgacgaccgatatctctgaaatgggggccaacttcaaggcggaccgggtgatcgatcctagacggtgcctcaagcccgtcattcttacagacggacccgagcgcgttatcctggccggccctatgcccgtgaccgtggctagcgccgctcagagacgggggcgcgtcggaagaaatcctcagaaagagaacgatcaatatattttcacaggccagccgctgaataacgacgaagaccatgcccactggaccgaggctaagatgctcctggataatatcaacacacccgaagggattatccctgccctttttgagcccgaacgggagaaatccgcggccatcgacggcgagtacagactgaagggagaaagccgcaaaaccttcgtggagctcatgcggagaggcgatctgcctgtttggctggctcataaggtggcctctgaagggattaaatatacggaccgcaagtggtgctttgatggagagcggaataaccagatcctcgaagagaatatggacgtcgagatttggacaaaggaaggcgagaaaaagaaacttagaccccgctggctggatgctcggacctactccgacccgctggccctcaaggagttcaaagattttgccgctgggagaaagagcatcgcgctggaccttgtgaccgagattggacgcgttccttctcacctggcccacagaacacggaacgctctcgataatctggtgatgctgcatacctccgaacacggcggccgcgcctatagacatgccgtcgaggagctccccgaaacaatggagacgcttctgctgctcgggctgatgatccttctgaccggaggcgtgatgctgttcctgatcagcgggaagggagtcggcaaaacatccattgggctgatctgtgtggttgcttctagctccatgctctggatggccgacattcctcttcagtggatcgcgagcgccattgtgctggaatttttcatgatggtgctgctcatccccgagcctgagaagcaacggacaccccaggataaccagctggcttacgtcgttattggaatccttacactggccgctatcgtggccgcgaatgaaatgggcctcctggagaccacgaaacgcgacctgggcatgtctaaggaaccgggggtggtctcccctaccagctatctcgacgtggatcttcaccccgcctctgcttggacactgtacgccgttgctaccacagtgattacccccatgctgagacacacgatcgagaacagcacagccaatgtctccctcgctgccattgcgaaccaagccgtggtcctgatgggacttgacaaaggctggcctatctctaagatggatctgggggtgccgctcctggctctgggatgctacagccaggttaaccccctcacccttacagccgctgtgctgctgctcgtcacccattatgccattatcggccctgggctgcaggccaaggcgacccgggaagctcagaaaagaacagccgctggaatcatgaagaatcccacggtggacggcattatgaccatcgatcttgaccctgttatttacgattccaaatttgagaagcaactgggccaggtgatgctcctggtcctgtgtgccgtgcagctccttctgatgcgcacatcttgggccttctgcgaggctctgaccctcgccacagggcccatcaccacgctgtgggaaggaagccctggcaaattttggaacacaaccattgcggtgtccatggccaatatcttccgggggagctatcttgctggagccggcctggctttttctatcatgaagtccgttgggaccggaaagagaggcacaggcagccagggggagaccctcggagaaaaatggaagaaaaagctgaaccaactgtcccgcaaagagttcgacctctacaagaaatctggcattacagaagtcgatcggacggaggccaaggaggggcttaagagaggagaaatcacccaccatgcggtgagccggggctccgccaaactgcagtggttcgtggagcgcaatatggtcattccggaagggagagttatcgacctgggatgtggccggggcgggtggtcttattactgcgctggactcaagaaagtgacagaggtgcgcggctataccaaagggggacccggccacgaagaacctgtccccatgagcacatacgggtggaacattgtgaaactgatgtccggaaaggatgtcttttaccttcctcccgagaagtgtgacaccctgctctgcgatatcggcgaaagctctccgtcccctacggtggaggaaagcagaaccattcgggtcctgaaaatggtggagccctggctgaagaataaccagttctgtatcaaagttctcaatccctatatgcctgccgtgatcgagcatcttgaacgcctgcagagaaagcacggcgggatgctggtccggaaccccctctctcgcaattccacacacgagatgtactggattagcaacggaaccggcaatatcgtgtctagcgtgaacatggtctccagactgcttctgaatcggtttacaatgacctatagacgccctacaattgaaaaagacgttgacctcggggctggaacccggcatgtgaacgccgagccggaaacgcccaacatggatgtgatcggcgagcgcattagacggatcaaggaggaacactctagcacatggcattacgacgatgagaatccttataagacctgggcttaccacgggtcctatgaagtcaaagccaccggaagcgcgtcctctatgatcaacggcgtggttaagctgctgacaaaaccctgggacgtggtccctacggtgacccaaatggccatgacagataccacacccttcggccagcagagagtttttaaggagaaagtggacacccgcacaccgaagcctatgcccgggacccggaaggtcatggaaattacggctgagtggctctggagaaccctgggacgcaataaacggcctagactttgcacacgcgaggagttcaccaagaaagtgcggacaaacgccgctatgggcgccgtttttaccgaggaaaatcaatgggatagcgccagagcggctgtggaggacgaagagttctggaagctggtcgatcgcgagagagaactccacaaactggggaagtgtggatcctgcgtgtacaacatgatgggcaaacgggagaagaaacttggggaatttggcaaagccaagggatctcgcgccatctggtacatgtggctgggcgctagatatctcgagttcgaggccctggggtttctgaatgaagaccattggttcagccgggagaactcctactctggagtcgaaggcgaggggctccacaaactgggatatattcttagagatatcagcaagattcccggcggggctatgtacgccgacgacacggcgggctgggatacacggatcaccgaagacgatctgcataatgaggagaaaatcacacagcagatggaccctgaacaccgccagctcgccaacgctatttttaagctgacctatcaaaataaggtggttaaagtgcagagacccacgccgaagggaaccgtcatggatatcatttcccggaaagaccagcgcggcagcggacaggtgggaacatacggccttaacaccttcacaaatatggaggcccaactgatcagacagatggaaggggagggagtgctctctaagaccgatctggaaaaccctcatctgctcgagaaaaagattacacagtggctggagaccaagggcgttgaacggcttaaacgcatggctatctccggggacgattgcgtggtcaagcccatcgacgatagattcgccaatgcgctgctcgccctgaacgacatgggcaaagtgcggaaggatattccccagtggcaacctagcaaaggatggcacgactggcagcaggttccgttttgttctcaccatttccacgagcttatcatgaaggacggccgcaagctggtggtcccctgcagacctcaggatgaactcattgggcgggctcgcatctcccaaggagccggctggagcctgaaagagacggcttgtctggggaaggcctatgctcagatgtgggccctcatgtactttcatagacgggacctgcgccttgcgtctaacgccatttgctccgctgtgcccgtccactgggtgcctacaagcagaaccacctggtccatccacgcccatcaccagtggatgacaaccgaagatatgctgacagtttggaatcgggtgtggattgaggacaacccctggatggaggataaaacgcctgtcaccacatgggaagacgtgccctacctcggaaagagagaggatcaatggtgtggcagcctgatcgggcttacctctcgcgccacatgggctcagaatatcctgaccgccattcagcaggttcggagcctcatcggcaacgaagagttcctggactatatgccgtccatgaaaagatttcgcaaggaggaagagtctgaaggagcgatttggtga

SEQ ID NO: 20885 - RNA, 9873 nt, synthetic construct
  misc_feature 1..9873: note = derived and/or modified CDS sequence (opt5) from DENV-3__KC762686__SS-prME
  source 1..9873: mol_type = other RNA
accagcctctgcctcatgatgatgctgcccgccacgcttgctttccacctgacgtcccgggacggcgagcctcggatgatcgtggggaagaatgaacgcggaaagtctctcctgtttaagaccgccagcggcattaatatgtgtacccttatcgcgatggatctgggggagatgtgcgacgataccgtgacatacaagtgtccgctcattaccgaagttgagcccgaagacatcgattgctggtgtaacctgacatccacctgggtgacgtatggaacctgcaatcaggctggcgagcatagacgggacaagcgctctgtggccctggcccctcacgtggggatgggactcgatacaagagctcagacctggatgagcgccgagggcgcttggagacaggtggaaaaagttgagacatgggccttccgccatcccggctttaccattctggcgcttttcctggcccactacatcgggacgtccctcacacagaaggtggtcatctttattctgcttatgctggtgaccccttctatgacaatgagatgtgttggagtgggcaaccgggacttcgtcgaagggctcagcggagctacctgggtggatgtggtcctggagcatggcgggtgcgttaccacaatggccaagaataaacccacgctggacatcgagctccagaagaccgaagctacacagctggccacccttcgcaaactgtgtattgagggaaagatcacaaacgtgaccacggattccagatgccctacacagggcgaagcgattctcccggaggaacaggaccagaattatgtgtgtaaacacacctacgtcgatcggggctgggggaacggatgcggcctgtttgggaagggaagccttgtgacctgcgccaagttccaatgtctggagtttatcgagggcaaagttgtgcagcacgaaaatctcaagtatacagtcattatcaccgtgcatacaggggaccagcaccaggttggaaacgagacgcaaggcgtgaccgctgaaatcacaccccaggcctctaccgtcgaggctattctgcctgaatacggcacactggggctcgagtgcagcccccgcaccggactggacttcaatgagatgatccttctgacgatgaaaaacaaggcctggatggtgcatagacagtggtttttcgatctccctctgccctggaccagcggcgccacaaccgaaacaccgacctggaataaaaaggagcttctggtcacgtttaaaaacgctcacgcgaagaagcaagaagtggttgtgctcgggtctcaggagggagccatgcacacagctctgaccggcgccacagaaattcagacctccgggggcaccagcatcttcgccggacatctgaaatgtcggctcaagatggacaaactggagcttaagggcatgtcttatgctatgtgcctgaatgccttcgtcctcaaaaaggaggtgtccgaaacacagcacgggacgattctgatcaaggttgagtacaaaggagaagatgcgccttgtaagatcccctttagcaccgaggacggccaagggaaagctcataacggacgcctgattacagccaaccctgtggtcaccaagaaagaggaacccatcaatattgaggccgaaccccctttcggcgagtccaacatcgtgattgggatcggcgataaggctcttaagatcaattggtacaaaaagggatctagcattggcaaaatgtttgaagccacagctagaggggcccggagaatggcgatcctcggagacaccgcctgggatttcggctccgtcgggggagttctgaacagcctgggcaagatggtccaccagatttttgggtctgcttatacggccctcttctccggcgtgagctggatcatgaaaattggaatcggcgtgctgcttacatggattgggctcaattctaagaacaccagcatgtccttttcttgcatcgtcatcggaattatcaccctctacctgggcgctgtggttcaggccgacatggggtgtgtgattaattggaagggaaaagagctgaagtgcggcagcgggatcttcgtcacaaacgaggtgcatacctggacagaacagtataaatttcaagcggattccccgaagcgccttgccacgaccattgctggcgcctgggagaatggagtttgtggcatccggagcacaaccagaatggaaaacctcctgtggaaacagatcgctaatgagctgaactacattctctgggaaaataacatcaagctgacagtggtcgtgggggacattatcggagttcttgagcagggcaaacgcaccctgacgccccagcctatggagctcaagtattcttggaagacctgggggaaagccaagattgtgacagccgaaacccaaaattccagcttcatcatcgatggacccaacacacctgagtgcccctctgcttcccgggcgtggaacgtctgggaagtggaggactacggctttggcgtgttcaccacaaatatttggctgaaactgagagaaatgtatacccagctttgtgaccaccgcctcatgagcgccgctgtcaaggatgagcgggccgttcacgccgacatggggtactggatcgagtcccagaaaaacggatcttggaagctggaaaaggctagcctgattgaggtgaaaacgtgcacatggccgaagtcccataccctctggtctaatggcgtgctggaaagcgatatgatcattcctaaatcccttgccgggcccgtcagccagcacaaccatagacctggataccacacccaaacagcgggcccctggcacctggggaagctcgagctggactttaattattgcgagggaaccacggtggttatcacagaaaactgtggcacccgcggcccttctctgcggacaaccacagtgtccgggaaacttatccatgagtggtgctgtagaagctgcaccctgcccccgctgcgctacatgggagaagatggctgttggtatgggatggagattcggcctatcaatgaaaaggaggagaacatggtcaagtctctggtgtccgctggaagcggcaaagttgacaatttcacgatgggggtgctctgcctggccattcttttcgaagaggtcatgagaggaaagtttggcaaaaagcacatgatcgccggcgtgctgttcacctttgttctcctgctgtctgggcagattacatggcgggatatggctcgcacccttatcatgattggaagcaacgcctccgacagaatgggcatgggggtgacatacctggcgctcatcgctaccttcaaaatccagccctttctggccctcggattctttctgcggaaacttacgagcagagaaaatctgctcctgggcgtcgggctggccatggctacaacccttcaactgcccgaggatattgaacagatggccaacggaatcgctctcggcctgatggccctcaagctgattacacagttcgagacctatcagctttggaccgcgctggtgtctctcatgtgttccaatacaatctttacgctgaccgtggcctggcgcacagctaccctgattcttgccggcatcagcctgctccctgtctgccaatcctctagcatgcggaaaacagactggctgccggttaccgtggctgccatgggggtgccccctctccccctgttcatcttttcccttaaggatacgctgaaaagacgctcttggcctctgaacgagggagtcatggccgtgggcctcgttagcattctggcttcctctcttctgagaaatgacgtgcccatggcggggcctctcgtcgccggaggcctgctcatcgcttgttacgtgattacagggaccagcgccgatctgaccgttgaaaaggccgctgacgtgatctgggaggaagaggccgaacagacaggagtctcccataaccttatgattaccgtggacgatgacggcacaatgcggatcaaagatgacgagacggagaacatcctgaccgtcctgctcaagacagcgctgcttattgtgagcggcatcttcccctattctattccggctaccctgctcgtttggcacacatggcagaaacagacccaacgctccggggtgctgtgggatgtcccttctccccctgaaacgcagaaggccgagctcgaagagggagtgtacagaatcaagcagcagggcatttttgggaaaacccaagttggagtgggcgtccagaaggagggggtgttccatacaatgtggcacgtgacccggggagccgttctgacacacaatggcaaacgccttgaacccaactgggcttccgtcaagaaagacctgatctcctacggcgggggatggagactgagcgcccagtggcaaaagggcgaggaagtccaggtgattgcggtcgagccggggaagaatcctaaaaacttccagaccatgcccggaatctttcagacaacgaccggcgaaatcggggctattgccctcgatttcaagcctggaacatctggctcccccatcattaatcgggagggcaaagtggttgggctgtatggaaacggcgtggtcaccaagaatgggggatacgtgagcggcatcgcccaaaccaacgctgagcccgacgggcctacaccggaacttgaggaagagatgtttaaaaagcgcaatctgacgattatggatctccatcccggctccggaaagaccagaaaatatctgcctgccatcgttcgggaagctatcaagcgcagactccggacactgattcttgcccccaccagagtggtcgcggccgagatggaggaagctctgaaaggcctgcctatccgctaccagacaaccgccacaaagagcgctcacacagggaaagagattgtggacctcatgtgccatgccaccttcaccatgcggctgctttctcccgttagagtgcctaactataatctgatcattatggatgaagcccactttacagacccggctagcatcgcggcccgcggatacatctccacccgggtcggcatgggggaggctgccgccattttcatgacagctacaccccctggaacggccgatgcgtttccccagtctaacgctcctatccaggacgaagagagagacattcccgagcgcagctggaactccggcaacgaatggatcacagatttcgccgggaagaccgtgtggtttgtgccgtctattaaggccggcaatgacatcgctaactgtctccggaaaaacggaaagaaagtcattcaactgagcagaaagacattcgataccgagtatcagaaaacgaagctgaatgactgggattttgttgtgaccacagacatctccgaaatgggcgccaacttcaaggcggatcgcgtgatcgaccctcggagatgcctcaaacccgtcattcttaccgatgggcccgagcgggtgatcctggccggacctatgcccgttacagtggcttctgccgctcagcgcagaggccgggtcgggcgcaatcctcagaaggagaacgaccaatacattttcaccggacagccgctgaataacgatgaagaccatgcccactggacagaggctaaaatgctcctggacaatatcaacacccccgaaggcattatccctgccctttttgagcccgaaagagaaaagagcgcggccatcgatggggagtaccggctgaaaggcgaatccagaaagacgttcgtggagctcatgcgccggggagacctgcctgtttggctggctcacaaagtggccagcgaaggcattaagtatacagatagaaagtggtgctttgacggggagcgcaataaccagatcctcgaagagaatatggatgtcgagatttggaccaaagaaggagagaagaagaaacttcggcccagatggctggacgctcgcacctactctgatccgctggccctcaaagagttcaaagactttgccgctggccggaagtccatcgcgctggatcttgtgacagagattgggagagtccctagccatctggcccaccgcaccagaaacgctctcgacaatctggtgatgctgcatacatctgaacacggaggccgggcctatcgccacgccgttgaggagctccccgaaacgatggagacccttctgctgctcggcctgatgatccttctgacagggggagctatgctgttcctgatctccggcaaagggattggaaagaccagcatcggcctgatttgtgtggtggcctcctctgggatgctctggatggcggatgtccctcttcagtggatcgccagcgctattgttctggaatttttcatgatggtgctgctcatccccgagcctgagaaacaaagaacaccccaggacaaccagctggcctacgtggtcattggaatccttaccctggctgccatcgtggcggccaatgaaatgggcctcctggagacgaccaagcgggatctgggcatgtccaaagaaccgggggttgtgagccctacatcttatctcgacgtcgaccttcatcccgcttccgcctggaccctgtacgctgtggccacaaccgtcattacgcccatgctgcgccacacaatcgagaacagcaccgctaatgtgtctctcgccgcgattgccaaccaagctgttgtgctgatgggacttgataagggctggcctatcagcaagatggacctgggggtcccgctcctggccctgggatgctattcccaggtgaaccccctcacacttaccgctgccgttctgctgctcgtgacccattacgccattatcggccctgggctgcaggcgaaagctacaagagaagcccagaagcggacggctgccggaatcatgaaaaatcccaccgtcgatggcattatgacaatcgaccttgatcctgtgatttacgactctaagtttgagaaacaactgggccaggtgatgctcctggttctgtgtgccgtccagctccttctgatgagaaccagctgggctttctgcgaggccctgacactcgcgaccgggcccatcacgacactgtgggaaggatcccctggcaagttttggaacaccaccattgccgtgtctatggctaatatcttccgcgggagctatcttgccggagctggcctggccttttccatcatgaaaagcgtggggacaggaaaacggggcaccggctctcagggggagacactcggagaaaagtggaaaaagaaactgaaccaactgtccagaaaggagttcgatctctacaaaaagagcggcattacggaagtcgaccgcaccgaggcgaaggaggggcttaaacggggagaaatcacacaccatgccgtttccagaggctctgctaagctgcagtggttcgtggagcggaatatggtgattccggaagggcgcgtcatcgatctgggatgtggcagaggcgggtggagctattactgcgccggactcaaaaaggtgaccgaggttcggggctatacaaaagggggacccggccacgaagaacctgtgcccatgtccacctacgggtggaacattgtcaagctgatgtctggaaaggacgtgttttatcttcctcccgagaaatgtgatacgctgctctgcgacatcggcgaaagctccccgagccctaccgttgaggaatctcgcacaattagagtgctgaagatggtcgagccctggctgaaaaataaccagttctgtatcaaggtgctcaatccctacatgcctaccgtgatcgagcaccttgaacggctgcagcgcaaacatggcgggatgctggtcagaaaccccctctcccggaatagcacacacgagatgtactggatttctaacggaaccggcaatatcgtttccagcgtgaacatggtgtctcgcctgcttctgaatagatttacaatgacccatcggagacctacgattgaaaaggatgtcgacctcggggctggaacacgccacgtgaacgccgagccggaaacccccaacatggacgttatcggcgagcggattagacgcatcaaggaggaacacagctccacctggcattatgatgaggaaaatccttacaaaacatgggcttatcacgggtcttacgaggtgaaggccacgggaagcgcgtccagcatgatcaacggcgtcgtgaaactgctgaccaagccctgggacgttgtgcctacagtcacccaaatggccatgacagataccacacccttcggccagcagcgggtgtttaaagaaaaggttgacaccagaacgccgcgccctatgcccgggacccggaaggctatggagattacagccgagtggctctggagaaccctgggacgcaataaacggcctagactttgcacacgcgaagagttcaccaagaaagtgcggacgaacgctgccatgggcgccgtctttacagaagagaatcaatgggattccgcgagagctgccgtggaagacgaggagttctggaagctggtcgatcgcgaaagagagctccataaactggggaagtgtggatcttgcgtgtataacatgatgggcaaacgggaaaagaaacttggggagtttggcaaagccaagggaagccgcgctatctggtacatgtggctgggcgccagatatctcgagttcgaagctctggggtttctgaatgaggaccactggttctcccgggaaaactcttttagcggagttgagggcgaagggctccataaactgggatacattcttagagatatctccaagattcccggcggggccatgtacgcggacgataccgccggctgggacacacggatcaccgaggacgatctgcacaatgaggagaagatcacgcagcagatggagcctgaacaccgccagctcgctaacgccattttcaagctgacctatcaaaataaggtggtcaaagtgcagagacccacaccgaagggaaccgtgatggacatcatttctcggaaagatcagcgcggcagcgggcaggttggaacatacggccttaacaccttcacaaatatggaggtgcaactgatcagacagatggaaggggagggagtcctctccaaggctgacctggagaaccctcatctgctcgaaaaagagattacccagtggctggaaacgaagggcgtggagcggcttaagcgcatggccatcagcggggatgactgcgttgtgaaacccatcgatgacagatttgcggatgccctgctcgctctgaatgacatgggcaaggtccggaaagatattccccagtggcaaccttctaagggatggcacgactggcaacaggtgccgttctgttcccatcactttcacgaacttatcatgaaagatggccgcaagctggtcgtgccctgcagacctcaggacgagctcattgggcgggcccgcatcagccaaggagctggctggtctctgaaggagacagcctgtctggggaaggcttatgcccagatgtgggcgctcatgtacttccatagacgggacctgcgccttgcctccaacgctatttgcagcgccgttcccgtgcactgggtccctacctctagaaccacatggtccatccatgcccaccatcagtggatgaccacagaagatatgctgacggtgtggaaccgggtttggattgaggacaatccctggatggaagataagacccctgtgacaacctgggaggacgtcccctatctcggaaaaagagaggatcaatggtgtggcagcctgatcgggcttgcttcccgcgccacatgggcgcagaacatcctgaccgctattcaacaggtgcggagcctcatcggcaatgaagagtttctggactacatgccgtctatgaagagattccgcaaagaagaggaaagcgagggagccatttggtga

SEQ ID NO: 20886 - RNA, 9873 nt, synthetic construct
  misc_feature 1..9873: note = derived and/or modified CDS sequence (opt5) from DENV-3__KC762685__SS-prME
  source 1..9873: mol_type = other RNA
accagcctgtgcctcatgatgatgctgcccgccacccttgctttccacctgacgtccagagacggagagcctcggatgatcgtggggaagaatgaacgcgggaagtctctcctgtttaagaccgccagcggcattaatatgtgtacgcttatcgcgatggatctgggggagatgtgcgacgataccgttacctacaagtgtccgctcattaccgaagttgagcccgaagacatcgattgctggtgtaacctgacatccacctgggtgacgtatggaacctgcaatcaggctggcgagcatagacgggacaagcgctctgtggccctggcccctcacgtcgggatgggactcgatacaagagctcagacctggatgagcgccgagggcgcttggcggcaggtcgaaaaagttgagacatgggccttccgccatcccggctttaccattctggcgcttttcctggcccactacatcgggacgtccctcacacagaaggtggtcatctttattctgcttatgctggtgaccccttctatgacaatgagatgtgttggagtgggcaaccgggacttcgtcgaagggctcagcggagctacctgggtggatgtggtcctggagcatggcgggtgcgttaccacaatggccaagaataaacccacgctggacatcgagctccagaagaccgaagctacacaactggccacccttcgcaaactgtgtattgagggaaagatcacaaacgtgaccacggattccagatgccctacacagggcgaagcgattctcccggaggaacaggaccagaattatgtgtgtaaacacacctacgtcgatcggggctgggggaacggatgcggcctgtttgggaagggaagccttgtgacctgcacaaagttccaatgtctggagtttatcgagggcaaagttgtgcagcacgaaaatctcaagtataccgtcattatcacagtgcatacgggggaccagcaccaggttggaaacgagacccaaggcgtgacagccgaaatcacaccccaggcttctacagtcgaggccattctgcctgaatacggcaccctggggctcgagtgcagcccccgcacgggactggacttcaatgagatgatccttctgaccatgaaaaacaaggcttggatggtgcatagacagtggtttttcgatctccctctgccctggacaagcggcgccaccacagaaaccccgacgtggaataaaaaggagcttctggtcacatttaaaaacgcccacgctaagaagcaagaagtggttgtgctcgggtctcaggagggagcgatgcacaccgccctgacaggcgctaccgaaattcagacctccgggggcacaagcatcttcgccggacatctgaaatgtcggctcaagatggacaaactggagcttaagggcatgtcttatgccatgtgcctgaatgctttcgtcctcaaaaaggaggtgtccgaaacgcagcacgggaccattctgatcaaggttgagtacaaaggagaagatgccccttgtaagatcccctttagcacagaggacggccaagggaaagcgcataacggacgcctgattaccgctaaccctgtggtcacaaagaaagaggaacccgtgaatatcgaggccgaaccccctttcggcgagtccaacattgtgatcgggattggcgataaggcccttaagatcaattggtacaaaaagggatctagcatcggcaaaatgtttgaagctaccgccagaggggctcggagaatggccattctcggagacacggcgtgggatttcggctccgttgggggagtcctgaacagcctgggcaagatggtgcaccagatctttgggtctgcctatacagctctcttctccggcgtgagctggattatgaaaatcggaattggcgtcctgcttacctggatcgggctcaattctaagaacaccagcatgtccttttcttgcattgtgatcggaatcattacactctacctgggcgccgttgtgcaggctgacatggggtgtgtcatcaattggaagggaaaagagctgaagtgcggcagcgggattttcgtgaccaacgaggttcatacatggacggaacagtataaatttcaagccgattccccgaagcgccttgcgaccgccatcgctggcgcctgggagaatggagtgtgtggcattcggagcacaaccagaatggaaaacctcctgtggaaacagatcgctaatgagctgaactacatcctctgggaaaataacattaagctgacagtcgtggttggggacatcattggagtgcttgagcagggcaaacgcaccctgacgccccagcctatggagctcaagtattcttggaagacctgggggaaagccaagatcgtcacagccgaaacccaaaattccagcttcattatcgatggacccaacacacctgagtgcccctctgcttcccgggcgtggaacgtgtgggaagtggaggactacggctttggcgtcttcaccacaaatatctggctgaaactgagagaaatgtatacccagctttgtgaccaccgcctcatgagcgccgctgttaaggatgagcgggccgtgcacgccgacatggggtactggattgagtcccagaaaaacggatcttggaagctggaaaaggctagcctgatcgaggtgaaaacgtgcacatggccgaagtcccataccctctggtctaatggcgtcctggaaagcgatatgattatccctaaatcccttgccgggcccgtgagccagcacaactacagacctggatatcatacccaaacagcgggcccctggcacctggggaagctcgagctggactttaattactgcgagggaaccacggttgtgattacagaaaactgtggcacccgcggcccttctctgcggacaaccacagtctccgggaaacttatccacgagtggtgctgtagaagctgcaccctgcccccgctgcgctatatgggagaagatggctgttggtacgggatggagatccggcctattaatgaaaaggaggagaacatggtgaagtctctggtttccgctggaagcggcaaagtggacaatttcacgatgggggtcctctgcctggccatccttttcgaagaggtgatgagaggaaagtttggcaaaaagcatatgattgccggcgttctgttcacctttgtgctcctgctgtctgggcagatcacatggcgggatatggctcgcacccttattatgatcggaagcaacgcctccgacagaatgggcatgggggtcacatatctggcgctcattgctaccttcaaaatccagccctttctggccctcggattctttctgcggaaacttacgagcagagaaaatctgctcctgggcgtggggctggccatggctacaacccttcaactgcccgaggatatcgaacagatggccaacggaattgctctcggcctgatggccctcaagctgatcacacagttcgagacctaccagctttggaccgcgctggtgtctctcatgtgttccaatacaatttttacgctgaccgtcgcctggcgcacagctaccctgatccttgccggcattagcctgctccctgtttgccaatcctctagcatgcggaaaacagactggctgccggtgaccgtggctgccatgggggtgccccctctccccctgttcatcttttcccttaaggatacgctgaaaagacgctcttggcctctgaacgagggagtgatggccgttggcctcgtgagcatcctggcttcctctcttctgagaaatgacgtccccatggcggggcctctcgtggccggaggcctgctcattgcttgttatgttatcacagggaccagcgccgatctgaccgtggaaaaggccgctgacgtcatttgggaggaagaggccgaacagacaggagtgtcccacaaccttatgatcaccgtcgacgatgacggcacaatgcggattaaagatgacgagacggagaacatcctgaccgtgctgctcaagacagcgctgcttatcgttagcggcattttcccctactctatcccggctaccctgctcgtgtggcatacatggcagaaacagacccaacgctccggggtcctgtgggatgtgccttctccccctgaaacgcagaaggccgagctcgaagagggagtttacagaattaagcagcagggcatctttgggaaaacccaagtgggagtcggcgtgcagaaggagggggtgttccacacaatgtggcatgttacccggggagccgtcctgacacacaatggcaaacgccttgaacccaactgggcttccgtgaagaaagacctgatttcctatggcgggggatggagactgagcgcccagtggcaaaagggcgaggaagtgcaggtcatcgcggtggagccggggaagaatcctaaaaacttccagaccatgcccggaatttttcagacaacgaccggcgaaatcggggctatcgccctcgatttcaagcctggaacatctggctcccccattatcaatcgggagggcaaagttgtggggctgtacggaaacggcgtcgtgaccaagaatgggggatatgttagcggcattgcccaaaccaacgctgagcccgacgggcctacaccggaacttgaggaagagatgtttaaaaagcgcaatctgacgatcatggatctccaccccggctccggaaagaccagaaaatacctgcctgccattgtgcgggaagctatcaagcgcagactccggacactgatccttgcccccaccagagtcgtggcggccgagatggaggaagctctgaaaggcctgcctattcgctatcagacaaccgccacaaagagcgctcatacagggaaagagatcgttgacctcatgtgccacgccaccttcaccatgcggctgctttctcccgtgagagtccctaactacaatctgattatcatggatgaagcccattttacagacccggctagcattgcggcccgcggatatatctccacccgggtgggcatgggggaggctgccgccatcttcatgacagctacaccccctggaacggccgatgcgtttccccagtctaacgctcctattcaggacgaagagagagacatccccgagcgcagctggaactccggcaacgaatggattacagatttcgccgggaagaccgtgtggtttgtcccgtctatcaaggccggcaatgacattgctaactgtctccggaaaaacggaaagaaagttatccaactgagcagaaagacattcgataccgagtaccagaaaacgaagctgaatgactgggattttgtggtgaccacagacatttccgaaatgggcgccaacttcaaggcggatcgcgtcatcgaccctcggagatgcctcaaacccgtgatccttaccgatgggcccgagcgggttattctggccggacctatgcccgtgacagtcgcttctgccgctcagcgcagaggccgggtggggcgcaatcctcagaaggagaacgaccaatacatcttcaccggacagccgctgaataacgatgaagaccacgcccattggacagaggctaaaatgctcctggacaatattaacacccccgaaggcatcattcctgccctttttgagcccgaaagagaaaagagcgcggccatcgatggggagtatcggctgaaaggcgaatccagaaagacgttcgttgagctcatgcgccggggagacctgcctgtgtggctggctcacaaagtcgccagcgaaggcatcaagtacacagatagaaagtggtgctttgacggggagcgcaataaccagattctcgaagagaatatggatgtggagatctggaccaaagaaggagagaagaagaaacttcggcccagatggctggacgctcgcacctattctgatccgctggccctcaaagagttcaaagactttgccgctggccggaagtccattgcgctggatcttgtcacagagatcgggagagtgcctagccacctggcccatcgcaccagaaacgctctcgacaatctggttatgctgcacacatctgaacatggaggccgggcctaccgccacgccgtggaggagctccccgaaacgatggagacccttctgctgctcggcctgatgattcttctgacagggggagctatgctgttcctgatctccggcaaagggatcggaaagaccagcattggcctgatctgtgtggtcgcctcctctgggatgctctggatggcggatgttcctcttcagtggattgccagcgctatcgtgctggaatttttcatgatggtgctgctcattcccgagcctgagaaacaaagaacaccccaggacaaccagctggcctatgtcgtgatcggcattcttaccctggctgccatcgttgcggccaatgaaatgggcctcctggagacgaccaagcgggatctgggcatgtccaaagaaccgggggtggtcagccctacatcttacctcgacgtggaccttcaccccgcttccgcctggaccctgtatgctgtcgccacaaccgtgatcacgcccatgctgcgccatacaattgagaacagcaccgctaatgtttctctcgccgcgatcgccaaccaagctgtggtcctgatgggacttgataagggctggcctattagcaagatggacctgggggtgccgctcctggccctgggatgctactcccaggttaaccccctcacacttaccgctgccgtgctgctgctcgtcacccactacgccatcattggccctgggctgcaggcgaaagctacaagagaagcccagaagcggacggctgccggaatcatgaaaaatcccaccgtggatggcatcatgacaattgaccttgatcctgtgatctatgactctaagtttgagaaacaactgggccaggttatgctcctggtcctgtgtgccgtgcagctccttctgatgagaaccagctgggctttctgcgaggccctgacactcgcgaccgggcccattacgacactgtgggaaggatcccctggcaagttttggaacaccaccatcgccgtgtctatggctaatattttccgcgggagctaccttgccggagctggcctggccttttccatcatgaaaagcgtcgggacaggaaaacggggcaccggctctcagggggagacactcggagaaaagtggaaaaagaaactgaaccaactgtccagaaaggagttcgatctctataaaaagagcggcatcacggaagttgaccgcaccgaggcgaaggaggggcttaaacggggagaaattacacatcacgccgtgtccagaggctctgctaagctgcagtggttcgtggagcggaatatggtcatcccggaagggcgcgtgattgatctgggatgtggcagaggcgggtggagctactattgcgccggactcaaaaaggttaccgaggtgcggggctacacaaaagggggacccggccatgaagaacctgtccccatgtccacctatgggtggaacatcgtgaagctgatgtctggaaaggacgtcttttaccttcctcccgagaaatgtgatacgctgctctgcgacattggcgaaagctccccgagccctaccgtggaggaatctcgcacaatcagagtcctgaagatggtggagccctggctgaaaaataaccagttctgtattaaggtgctcaatccctacatgcctaccgtcatcgagcaccttgaacggctgcagcgcaaacacggcgggatgctggttagaaaccccctctcccggaatagcacacatgagatgtattggatctctaacggaaccggcaatattgtgtccagcgtgaacatggtctctcgcctgcttctgaatagatttacaatgacccaccggagacctacgatcgaaaaggatgtggacctcggggctggaacacgccatgttaacgccgagccggaaacccccaacatggacgtgattggcgagcggatcagacgcattaaggaggaacacagctccacctggcactacgatgaggaaaatccttataaaacatgggcttaccatgggtcttatgaggtcaaggccacgggaagcgcgtccagcatgatcaacggcgtggttaaactgctgaccaagccctgggacgtggtccctacagtgacccaaatggccatgacagataccacacccttcggccagcagcgggtttttaaagaaaaggtggacaccagaacgccgcgccctatgcccgggacccggaaggctatggagatcacagccgagtggctctggagaaccctgggacgcaataaacggcctagactttgcacacgcgaagagttcaccaagaaagtccggacgaacgctgccatgggcgccgtgtttacagaagagaatcaatgggattccgcgagagctgccgtcgaagacgaggagttctggaagctggtggatcgcgaaagagagctccacaaactggggaagtgtggatcttgcgtttacaacatgatgggcaaacgggaaaagaaacttggggagtttggcaaagccaagggaagccgcgctatttggtatatgtggctgggcgccagatacctcgagttcgaagctctggggtttctgaatgaggaccattggttctcccgggaaaactcttttagcggagtggagggcgaagggctccacaaactgggatacatccttagagatatttccaagatccccggcggggccatgtatgcggacgataccgccggctgggacacacggattaccgaggacgatctgcataatgaggagaagatcacgcagcagatggagcctgaacaccgccagctcgctaacgccatcttcaagctgacctaccaaaataaggtcgtgaaagtgcagagacccacaccgaagggaaccgttatggacattatctctcggaaagatcagcgcggcagcggacaggtgggaacatatggccttaacaccttcacaaatatggaggtccaactgattagacagatggaaggggagggagtgctctccaaggctgacctggagaaccctcacctcctcgaaaaagagatcacccagtggctggaaacgaagggcgttgagcggcttaagcgcatggccattagcggggatgactgcgtggtcaaacccatcgatgacagatttgcggatgccctgctcgctctgaatgacatgggcaaggtgcggaaagatatcccccagtggcaaccttctaagggatggcatgactggcagcaggtcccgttctgttcccaccattttcacgaacttattatgaaagatggccgcaagctggtggttccctgcagacctcaggacgagctcatcgggcgggcccgcattagccaaggagctggctggtctctgaaggagacagcctgtctggggaaggcttacgcccagatgtgggcgctcatgtatttccacagacgggacctgcgccttgcctccaacgctatctgcagcgccgtgcccgtccattgggtgcctacctctagaaccacatggtccattcacgcccatcaccagtggatgaccacagaagatatgctgacggtttggaaccgggtgtggatcgaggacaatccctggatggaagataagacccctgtcacaacctgggaggacgtgccctacctcggaaaaagagaggatcaatggtgtggcagcctgattgggcttgcttcccgcgccacatgggcgcagaacatcctgaccgctatccaacaggtgcggagcctcattggcaatgaagagtttctggactatatgccgtctatgaagagattccgcaaagaagaggaaagcgagggagccatctggtga

SEQ ID NO: 20887 - RNA, 9873 nt, synthetic construct
  misc_feature 1..9873: note = derived and/or modified CDS sequence (opt5) from DENV-3__KC762687__SS-prME
  source 1..9873: mol_type = other RNA
accagcctgtgcctcatgatgatgctgcccgccacacttgctttccacctgacgtcccgggacggcgagcctcggatgatcgtggggaagaatgaacgcggaaagtctctcctgtttaagaccgccagcggcattaatatgtgtacacttatcgcgatggatctgggggagatgtgcgacgataccgtcacatacaaatgtccgctcattaccgaagttgagcccgaagacatcgattgctggtgtaacctgacatccacctgggtgacgtatggaacctgcaatcaggctggcgagcacagacgggacaagcgctctgtggccctggcccctcacgtcgggatgggactcgatacaagagctcaaacctggatgagcgccgagggcgcttggagacaggtggaaaaagttgagacatgggccttccgccatcccggctttaccattctggcgcttttcctggcccactacatcgggacgtccctcacacagaaggtggtcatctttattctgcttatgctggtgaccccttctatgacaatgagatgtgttggagtgggcaaccgggacttcgtcgaagggctcagcggagctacctgggtggatgtggtcctggagcatggcgggtgcgttaccacaatggccaagaataaacccacgctggacatcgagctccagaagaccgaagctacacaactggccacccttcgcaaactgtgtattgagggaaagatcacaaacgtgaccacggattccagatgccctacacagggcgaagcgattctcccggaggaacaggaccagaattatgtgtgtaaacacacctacgtcgatcggggctgggggaacggatgcggcctgtttgggaagggaagccttgtgacctgcgccaagttccaatgtctggagtttatcgagggcaaagttgtgcagcacgaaaatctcaagtatacagtcattatcaccgtgcatacaggggaccagcaccaggttggaaacgagacgcaaggcgtgaccgctgaaatcacaccccaggcctctaccgtcgaggctattctgcctgaatacggcacactggggctcgagtgcagcccccgcaccggactggacttcaatgagatgatccttctgacgatgaaaaacaaggcctggatggtgcatagacagtggtttttcgatctccctctgccctggaccagcggcgccacaaccgaaacaccgacctggaataaaaaggagcttctggtcacgtttaaaaacgctcacgcgaagaagcaagaagtggttgtgctcgggtctcaggagggagccatgcacacagctctgaccggcgccacagaaattcagacctccgggggcaccagcatcttcgccggacatctgaaatgtcggctcaagatggacaaactggagcttaagggcatgtcttatgctatgtgcctgaatgccttcgtcctcaaaaaggaggtgtccgaaacacagcacgggacgattctgatcaaggttgagtacaaaggagaagatgcgccttgtaagatcccctttagcaccgaggacggccaagggaaagctcataacggacgcctgattacagccaaccctgtggtcgtgaagaaagaggaacccgtgaatatcgaggccgaaccccctttcggcgagtccaacattgttatcgggattggcgataaggctcttaagatcaattggtacaaaaagggatctagcatcggcaaaatgtttgaagccaccgctagaggggcccggagaatggcgattctcggagacacagcctgggatttcggctccgtcgggggagtgctgaacagcctgggcaagatggtgcaccagatctttgggtctgcttataccgccctcttctccggcgtcagctggattatgaaaatcggaattggcgtgctgcttacgtggatcgggctcaattctaagaacacaagcatgtccttttcttgcattgttatcggaatcattaccctctacctgggcgctgtggtccaggccgacatggggtgtgtgatcaattggaagggaaaagagctgaagtgcggcagcgggattttcgttaccaacgaggtgcatacatggaccgaacagtataaatttcaagcggattccccgaagcgccttgccacagctatcgccggcgcttgggagaatggagtctgtggcattcggagcacgaccagaatggaaaacctcctgtggaaacagatcgccaatgagctgaactacatcctctgggaaaataacattaagctgacagtggttgtgggggacatcattggagtccttgagcagggcaaacgcaccctgacaccccagcctatggagctcaagtattcttggaagacctgggggaaagccaagatcgtgacggctgaaacccaaaattccagcttcattatcgatggacccaacacacctgagtgcccctctgcgtcccgggcctggaacgtgtgggaagtcgaggactacggctttggcgttttcaccacaaatatctggctgaaactgagagaaatgtatacccagctttgtgaccaccgcctcatgagcgctgccgtgaaggatgagcgggccgtgcacgctgacatggggtactggattgagtcccagaaaaacggatcttggaagctggaaaaggccagcctgatcgaggtcaaaacatgcacctggccgaagtcccatacgctctggtctaatggcgtgctggaaagcgatatgattatccctaaatcccttgcggggcccgttagccagcacaactacagacctggatatcatacacaaaccgctggcccctggcacctggggaagctcgagctggactttaattactgcgagggaaccacagtggtcattaccgaaaactgtggcacgcgcggcccttctctgcggacaaccacagtgtccgggaaacttatccacgagtggtgctgtagaagctgcaccctgcccccgctgcgctatatgggagaagatggctgttggtacgggatggagatccggcctattaatgaaaaggaggagaacatggttaagtctctggtgtccgccggaagcggcaaagtcgacaatttcacaatgggggtgctctgcctggccatccttttcgaagaggttatgagaggaaagtttggcaaaaagcatatgattgctggcgtgctgttcacctttgtcctcctgctgtctgggcagatcacgtggcgggatatggcccgcacccttattatgatcggaagcaacgcgtccgacagaatgggcatgggggtgacatatctggctctcattgccaccttcaaaatccagccctttctggccctcggattctttctgcggaaacttacaagcagagaaaatctgctcctgggcgtggggctggctatggccaccacgcttcaactgcccgaggatatcgaacagatggctaacggaattgccctcggcctgatggcgctcaagctgatcacacagttcgagacctaccagctttggacagccctggtctctctcatgtgttccaataccatttttaccctgacagttgcttggcgcacggccaccctgatccttgctggcattagcctgttccctgtgtgccaatcctctagcatgcggaaaacagactggctcccggtgaccgtcgccgccatgggggtgccccctctgcccctctttatcttctccctgaaggatacacttaaaagacgctcttggcctctgaacgagggagttatggctgtgggcctggtcagcatcctcgcgtcctctctgcttagaaatgacgtgcccatggccgggcctctggttgctggaggcctcctgattgcctgttatgtgatcaccgggacgagcgccgatctcacagtcgaaaaggctgccgacgtgatttgggaggaagaggcggaacagaccggagtctcccacaacctgatgatcaccgtggacgatgacggcacaatgcggattaaagatgacgagaccgagaacatccttacagttctgctgaagacggctctcctgatcgtgagcggcatttttccctactctatcccggccacccttctggtctggcatacatggcagaaacagacccaacgctccggggtgctctgggatgttccttctccccctgaaacacagaaggccgagctggaagagggagtgtacagaattaagcagcagggcatcttcgggaaaacccaagtcggagtgggcgtgcagaaggagggggttttccacacgatgtggcatgtcacccggggagctgtgctcacacacaatggcaaacgcctggaacccaactgggcctccgtgaagaaagaccttatttcctatggcgggggatggagactgagcgcgcagtggcaaaagggcgaggaagtccaggtgatcgctgttgagccggggaagaatcctaaaaactttcagaccatgcccggaacattccagaccacaacgggcgaaattggggccatcgccctggattttaagcctggaacctctggctcccccatcattaatcgggagggcaaagtggtcgggctctacggaaacggcgtggttacaaagaatgggggatatgtgagcggcatcgctcaaaccaacgccgagcccgacgggcctaccccggaactggaggaagagatgttcaaaaagcgcaatcttacaattatggatctgcaccccggctccggaaagacgagaaaatacctccctgctatcgtccgggaagccattaagcgcagactgcggaccctcatcctggcgcccacaagagtggttgccgctgagatggaggaagcccttaaaggcctgcctatccgctatcagaccacagctaccaagagcgtgcatacggggaaagagattgtcgacctgatgtgccacgccacatttaccatgcggctcctgtctcccgtgagagtgcctaactacaatcttatcattatggatgaagcccatttcaccgacccggctagcatcgcggcccgcggatatatttccacacgggtcggcatgggggaggctgccgccatctttatgaccgctacaccccctggaaccgccgatgcgttcccccagtctaacgctcctatccaggacgaagagagagacattcccgagcgcagctggaactccggcaacgaatggatcacggattttgccgggaagacagtttggttcgtgccgtctattaaggccggcaatgacatcgctaactgtctgcggaaaaacggaaagaaagtgattcaactcagcagaaagacctttgatacagagtaccagaaaaccaagctgaatgactgggatttcgtcgtgacgaccgacatctccgaaatgggcgccaacttcaaggcggatcgcgttattgaccctcggagatgcctgaaacccgtgatcctcacagatgggcccgagcgggtcatccttgccggacctatgcccgtgaccgttgcttctgccgctcagcgcagaggccgggtggggcgcaatcctcagaaggagaacgaccaatacatttttacaggacagccgctgaataacgatgaagaccacgcccattggaccgaggctaaaatgctgctcgacaatatcaacacacccgaaggcattatccctgccctgttcgagcccgaaagagaaaagagcgcggccattgatggggagtatcggcttaaaggcgaatccagaaagacctttgtcgagctgatgcgccggggagacctccctgtgtggctggctcacaaagtcgccagcgaaggcatcaagtacacggatagaaagtggtgcttcgacggggagcgcaataaccagatcctggaagagaatatggatgtggagatttggacaaaagaaggagagaagaaaaagctccggcccagatggcttgacgctcgcacctattctgatccgctggccctgaaagaatttaaggacttcgccgctggccggaagtccatcgcgctcgatctggttaccgagattgggagagtgcctagccaccttgcccataaaacacgctctgctctggacaacctcgtgatgctgcacacctccgaacatggaggcagagcctaccggcacgccgtcgaggagctgcccgaaacaatggagacgctccttctgctgggcctcatgatcctgcttaccgggggagctatgctgtttctcattagcggcaaggggatcggaaaaacatccatcggcctgatttgtgttgtggcctctagcgggatgctgtggatggcggatgtgcctctccagtggatcgcctccgctattgtccttgagttctttatgatggtgctgctgatccccgagcctgagaagcaacgcacaccccaggacaatcagctcgcctatgttgtgattggaatcctgacacttgctgccattgtcgcggccaacgaaatgggcctgctcgagaccacgaaaagagatctgggcatgagcaaggaaccgggggtggtctctcctacctcctacctggacgtggacctccaccccgctagcgcctggacactttatgctgttgccaccacagtgatcacccccatgctgcggcatacgatcgaaaattctacagctaacgtcagcctggccgcgattgccaatcaagctgtggttctcatgggactggataagggctggcctatctccaaaatggaccttggggtgccgctgctcgccctgggatgctactctcaggtcaaccccctgaccctcacagctgccgtgcttctgctggtgacccactacgccattatcggccctgggctccaggcgaaggctacccgcgaagcccagaaaagaacagctgccggaattatgaagaaccccacggttgatggcatcatgaccatcgacctggatcctgtcatttatgacagcaaattcgagaagcaacttggccaggtgatgctgctcgtgctgtgtgccgtccagctgctccttatgcggacatcctgggctttttgcgaggccctgaccctggcgacagggcccatcaccacgctctgggaaggatctcctggcaagttctggaatacaaccattgccgttagcatggctaacatctttagagggtcctacctggccggagctggccttgccttcagcattatgaaatctgtggggaccggaaagcgcggcacaggctcccagggggagaccctgggagaaaaatggaagaaaaagctcaatcaactgagccggaaagagttcgatctgtataagaagtccggcatcacagaagtggacagaacggaggcgaaagaggggctcaagcgcggagaaatcacccatcacgccgtctctcggggcagcgctaaacttcagtggtttgtggagagaaacatggttattccggaagggcgggtgatcgatctgggatgtggccgcggcgggtggtcctactattgcgccggactgaagaaagtcacagaggtgagaggctacaccaaaggcgggcccgggcatgaagaacctgttcccatgtctacatatgggtggaatattgtgaagctcatgagcggaaaagacgtcttctacctgcctcccgagaagtgtgatacccttctgtgcgacatcggcgaatccagcccgtctcctacggtggaggaatcccggaccattcgcgtgctcaaaatggtcgagccctggctgaagaacaatcagttttgtatcaaagttctgaacccctacatgcctacagtgattgagcacctcgaaagacttcagcggaagcacggcgggatgctggtgcgcaatcccctgagcagaaactctacccatgagatgtattggatctccaatggaacaggcaacatcgtcagctctgtgaatatggttagccggctcctgcttaaccgcttcaccatgacacacagacggcctaccattgaaaaggatgtggacctgggggctggaacgagacatgtcaatgccgagccggaaacacccaacatggacgtgatcggcgagcgcattcggagaatcaaagaggaacactcctctacctggcactacgatgaggaaaacccttataagacctgggcttaccatgggagctatgaggttaaagccacaggatccgcgagctccatgattaatggcgtggtcaagctcctgacgaaaccctgggacgtggttcctaccgtgacacaaatggccatgaccgatacaaccccctttggccagcagcgcgtcttcaaggaaaaggtggacacacggaccccgagacctatgcccgggacgcgcaaagctatggagatcaccgccgagtggctgtggcggacactcggaagaaacaagcgccctcggctgtgcaccagagaagagtttaccaagaaggtccgcaccaatgctgccatgggcgccgtgttcacggaagagaaccaatgggattctgcgaaagctgccgttgaagacgaggagttttggaaacttgtggatcgggaaagagagctgcacaaactcgggaagtgtggaagctgcgtctacaatatgatgggcaagcgcgagaagaagctgggggagttcggcaaagccaagggatccagagctatctggtatatgtggcttggcgcccggtacctggagtttgaagctctcgggttcctgaacgaggaccattggttttctcgcgaaaatagcttctccggagtggagggcgaagggctgcacaaactcggatacattctgagagatatctctaagattcccggcggggccatgtatgcggacgatacagccggctgggacacccggatcacagaggacgatcttcataacgaggaaaagattacccagcagatggaccctgagcacagacagctggctaatgccatcttcaaactcacgtaccaaaacaaggtggttaaagtgcagcggcccaccccgaagggaacagtcatggatatcattagccgcaaagaccagagaggctccggacaggtgggaacctatggcctgaatacatttaccaacatggaagttcaacttatccggcagatggagggggaaggagtgctgagcaaggctgatctcgagaatcctcatctgctggagaaggaaattacacagtggctcgagaccaaaggcgtcgaacgcctgaagagaatggccatctctggggacgattgcgtggtcaaacccattgacgatcggttcgcggacgcccttctggctctcaacgatatgggcaaggtgcgcaaagacatcccccagtggcaaccttccaagggatggcatgattggcagcaggttccgttttgtagccaccatttccacgagctgatcatgaaggacggcagaaaacttgtggtcccctgccggcctcaggacgaactgattgggcgcgccagaatctctcaaggagctggctggtccctccgggagacggcctgtctggggaaggcttacgcccagatgtgggcgctgatgtattttcaccgcagagatctccggctggccagcaatgctatttgctctgccgtgcccgttcattgggtgcctacatcccgcaccacctggagcatccacgcccatcaccagtggatgacaaccgaggacatgcttacagtctggaacagagtgtggattgaagataacccctggatggaggacaaaacgcctgtgaccacatgggaagatgttccctacctgggaaagcgggaggaccaatggtgtggctccctcatcgggctggctagcagagccacctgggcgcagaatattcttacagctatccagcaggtccgctctctgatcggcaacgaggagttcctcgattatatgccgagcatgaaacggtttagaaaggaggaagagtccgaaggagccatttggtga

SEQ ID NO: 20888 - RNA, 9873 nt, synthetic construct
  misc_feature 1..9873: note = derived and/or modified CDS sequence (opt5) from DENV-3__KC762688__SS-prME
  source 1..9873: mol_type = other RNA
accagcctgtgcctcatgatgatgctgcccgctacccttgctttccacctgacgtccagagacggcgaacctcggatgattgtggggaagaatgaacgcggaaagtctctcctgtttaagaccgccagcggcattaatatgtgtacacttatcgcgatggatctgggggagatgtgcgacgataccgtcacatacaagtgtccgctcattaccgaagttgagcccgaagacatcgattgctggtgtaacctgacatccacctgggtgacgtatggaacctgcaatcaggctggcgagcacagacgggacaagcgctctgtggccctggcccctcacgtcgggatgggactcgatacaagagctcagacctggatgagcgccgagggcgcttggcggcaggtcgaaaaagttgagacatgggccttccgccatcccggctttaccattctggcgcttttcctggcccactacatcgggacgtccctcacacagaaggtggtcatctttattctgcttatgctggtgaccccttctatgacaatgagatgtgttggagtgggcaaccgggacttcgtcgaagggctcagcggagctacctgggtggatgtggtcctggagcatggcgggtgcgttaccacaatggccaagaataaacccacgctggacatcgagctccagaagaccgaagctacacaactggccacccttcgcaaactgtgtattgagggaaagatcacaaacgtgaccacggattccagatgccctacacagggcgaagcgattctcccggaggaacaggaccagaattatgtgtgtaaacacacctacgtcgatcggggctgggggaacggatgcggcctgtttgggaagggaagccttgtgacctgcgccaagttccaatgtctggagtttatcgagggcaaagttgtgcagcacgaaaatctcaagtatacagtcattatcaccgtgcatacaggggaccagcaccaggttggaaacgagacgcaaggcgtgaccgctgaaatcacaccccaggcctctaccgtcgaggctattctgcctgaatacggcacactggggctcgagtgcagcccccgcaccggactggacttcaatgagatgatccttctgacgatgaaaaacaaggcctggatggtgcatagacagtggtttttcgatctccctctgccctggaccagcggcgccacaaccgaaacaccgacctggaataaaaaggagcttctggtcacgtttaaaaacgctcacgcgaagaagcaagaagtggttgtgctcgggtctcaggagggagccatgcacacagctctgaccggcgccacagaaattcagacctccgggggcaccagcatcttcgccggacatctgaaatgtcggctcaagatggacaaactggagcttaagggcatgtcttatgctatgtgcctgaatgccttcgtcctcaaaaaggaggtgtccgaaacacagcacgggacgattctgatcaaggttgagtacaaaggagaagatgcgccttgtaagatcccctttagcaccgaggacggccaagggaaagctcataacggacgcctgattacagccaaccctgtggtcaccaagaaagaggaacccgtgaatatcgaggccgaaccccctttcggcgagtccaacattgtgatcgggattggcgataaggctcttaagatcaattggtacaaaaagggatctagcatcggcaaaatgtttgaagccacagctagaggggcccggagaatggcgattctcggagacaccgcctgggatttcggctccgttgggggagtcctgaacagcctgggcaagatggtgcaccagatctttgggtctgcttatacggccctcttctccggcgtgagctggattatgaaaatcggaattggcgtcctgcttacatggatcgggctcaattctaagaacaccagcatgtccttttcttgcattgtgatcggaatcattaccctctacctgggcgctgttgtgcaggccgacatggggtgtgtcatcaattggaagggaaaagagctgaagtgcggcagcgggattttcgtgacaaacgaggttcatacctggacagaacagtataaatttcaagcggattccccgaagcgccttgccacggctatcgccggcgcttgggagaatggagtgtgtggcattcggagcaccacaagaatggaaaacctcctgtggaaacagatcgccaatgagctgaactacatcctctgggaaaataacattaagctgaccgtcgtggttggggacatcattggagtgcttgagcagggcaaacgcacactgacaccccagcctatggagctcaagtattcttggaagacgtgggggaaagccaagatcgtcaccgctgaaacacaaaattccagcttcattatcgatggacccaacacccctgagtgcccctctgcgtcccgggcctggaacgtgtgggaagtggaggactacggctttggcgtcttcacaaccaatatctggctgaaactgagagaaatgtatacacagctttgtgaccaccgcctcatgagcgctgccgttaaggatgagcgggccgtgcacgctgacatggggtactggattgagtcccagaaaaacggatcttggaagctggaaaaggccagcctgatcgaggtgaaaacctgcacgtggccgaagtcccatacactctggtctaatggcgtcctggaaagcgatatgattatccctaaatcccttgcggggcccgtgagccagcacaactacagacctggatatcatacccaaaccgctggcccctggcacctggggaagctcgagctggactttaattactgcgagggaacaaccgttgtgattacggaaaactgtggcacacgcggcccttctctgcggaccacaaccgtctccgggaaacttatccacgagtggtgctgtagaagctgcacactgcccccgctgcgctatatgggagaagatggctgttggtacgggatggagatccggcctattaatgaaaaggaggagaacatggtgaagtctctggtttccgccggaagcggcaaagtggacaatttcaccatgggggtcctctgcctggccatccttttcgaagaggtgatgagaggaaagtttggcaaaaagcatatgattgctggcgttctgttcacgtttgtgctcctgctgtctgggcagatcacctggcgggatatggcccgcacacttattatgatcggaagcaacgcgtccgacagaatgggcatgggggtcacctatctggctctcattgccacattcaaaatccagccctttctggccctcggattctttctgcggaaacttaccagcagagaaaatctgctcctgggcgtggggctggctatggccacgacacttcaactgcccgaggatatcgaacagatggctaacggaattgccctcggcctgatggcgctcaagctgatcacccagttcgagacataccagctttggaccgccctggtgtctctcatgtgttccaataccctgtttacactgacggtcgcttggcgcaccgccacacttattctggctggcatcagcctcctgcctgtttgccaatcctctagcatgcggaaaaccgactggctcccggtgacagtggccgccatgggggtgccccctctgccccttttcatcttttccctgaaggataccctgaaaagacgctcttggcctctcaacgagggagtgatggctgttggcctggtgagcatccttgcgtcctctctgctcagaaatgacgtccccatggccgggcctctggtggctggaggcctcctgatcgcctgttatgttattacggggacaagcgccgatcttaccgtggaaaaggctgccgacgtcatctgggaggaagaggcggaacagaccggagtgtcccacaacctgatgattacagtcgacgatgacggcaccatgcggatcaaagatgacgagacagagaacattctgacggtgctcctgaagaccgcccttctgatcgttagcggcatcttcccctactctattccggccacactcctggtgtggcatacctggcagaaacagacacaacgctccggggtcctctgggatgtgccttctccccctgaaacccagaaggccgagctggaagagggagtttacagaatcaagcagcagggcatttttgggaaaacgcaagtgggagtcggcgtgcagaaggagggggtgttccacaccatgtggcatgttacacggggagctgtccttacccacaatggcaaacgcctggaacccaactgggcctccgtgaagaaagacctgatctcctatggcgggggatggagactcagcgcgcagtggcaaaagggcgaggaagtgcaggtcattgctgtggagccggggaagaatcctaaaaacttccagacaatgcccggaatctttcagaccacaacgggcgaaattggggccatcgccctggatttcaagcctggaacctctggctcccccatcattaatcgggagggcaaagttgtggggctttacggaaacggcgtcgtgacaaagaatgggggatatgttagcggcatcgctcaaaccaacgccgagcccgacgggcctaccccggaactggaggaagagatgtttaaaaagcgcaatctcacaattatggatctgcaccccggctccggaaagacgagaaaatacctccctgctatcgtgcgggaagccattaagcgcagactgcggacccttatcctggcgcccacaagagtcgtggccgctgagatggaggaagccctgaaaggcctccctatccgctatcagaccacagctaccaagagcgcccatacggggaaagagattgttgacctgatgtgccacgccacattcaccatgcggcttctgtctcccgtgagagtccctaactacaatctcatcattatggatgaagctcattttaccgacccggcgagcatcgccgctcgcggatatatttccacacgggtgggcatgggggaggccgccgctatcttcatgaccgccacaccccctggaaccgcggatgcttttccccagtctaacgcccctatccaggacgaagagagagacattcccgagcgcagctggaactccggcaacgaatggatcacggatttcgccgggaagacagtgtggtttgtcccgtctattaaggctggcaatgacatcgccaactgtctgcggaaaaacggaaagaaagttattcaactgagcagaaagaccttcgatacagagtaccagaaaaccaagctcaatgactgggattttgtggtgacgaccgacatctccgaaatgggcgcgaacttcaaggccgatcgcgtcattgaccctcggagatgccttaaacccgtgatcctgacagatgggcccgagcgggttatcctggctggacctatgcccgtgaccgtcgcctctgctgcccagcgcagaggccgggtggggcgcaatcctcagaaggagaacgaccaatacattttcacaggacagccgctcaataacgatgaagaccacgctcattggaccgaggccaaaatgctgcttgacaatatcaacacacccgaaggcattatccctgcgctgtttgagcccgaaagagaaaagagcgccgctattgatggggagtatcggctcaaaggcgaatccagaaagaccttcgttgagctgatgcgccggggagacctgcctgtgtggctcgcccacaaagtcgctagcgaaggcatcaagtacacggatagaaagtggtgctttgacggggagcgcaataaccagatccttgaagagaatatggatgtggagatttggacaaaagaaggagagaagaaaaagctgcggcccagatggctggacgcccgcacctattctgatccgctcgccctgaaagagttcaaggactttgctgcgggccggaagtccatcgcccttgatctggtcaccgagattgggagagtgcctagccacctcgctcatcgcacaagaaacgccctggacaatctggttatgctccacacctctgaacatggaggccgggcctaccgccacgctgtggaggagttccccgaaacaatggagacgcttctgctgctcggcctgatgatccttctgaccgggggagccatgctctttctgatttccggcaaagggatcggaaagacaagcatcggcctgatttgtgtggtcgcgtcctctgggatgctctggatggccgatgttcctcttcagtggatcgctagcgccattgtgctggagttctttatgatggtgctgctcatccccgagcctgagaaacaaagaacaccccaggacaaccagctggcttatgtcgtgattggaatccttacactggccgcgattgttgccgctaatgaaatgggcctcctggagaccacgaagcgggatctgggcatgtccaaagaaccgggggtggtcagccctacctcttacctcgacgtggaccttcaccccgcctccgcttggacactgtatgccgtcgctaccacagtgatcacccccatgctgcgccatacgatcgagaacagcacagccaatgtttctctcgcggccattgctaaccaagccgtggtcctgatgggacttgataagggctggcctatcagcaagatggacctgggggtgccgctcctggctctgggatgctactcccaggttaaccccctcacccttacagccgccgtgctgctgctcgtcacccactacgcgattatcggccctgggctgcaggctaaagccaccagagaagctcagaagcggacagccgccggaattatgaaaaatcccacggtggatggcatcatgaccatcgaccttgatcctgtgatttatgactctaagttcgagaaacaactgggccaggttatgctcctggtcctgtgtgctgtgcagctccttctgatgagaacaagctgggccttttgcgaggcgctgaccctcgccacagggcccatcaccacgctgtgggaaggatcccctggcaagttctggaacacaaccattgctgtgtctatggccaatatctttcgcgggagctaccttgctggagccggcctggcgttctccattatgaaaagcgtcgggaccggaaaacggggcacaggctctcagggggagaccctcggagaaaagtggaaaaagaaactgaaccaactgtccagaaaggagttcgatctctataaaaagagcggcatcacagaagttgaccgcacggaggccaaggaggggcttaaaaagggagaaatcacccatcacgctgtgtcccggggctctgccaaactgcagtggtttgtggagagaaatatggtcattccggaagggcgggtgatcgatctgggatgtggccgcggcgggtggagctactattgcgctggactcaagaaagttacagaggtgagaggctacaccaaaggcgggcccgggcatgaagaacctgtccccatgtccacatatgggtggaacattgtgaagctgatgtctggaaaagacgttttctaccttcctcccgagaagtgtgataccctgctctgcgacatcggcgaaagctccccgagccctacggtggaggaatctcggaccattcgcgtcctgaaaatggtggagccctggctgaagaataaccagttttgtatcaaagtgctcaatccctacatgcctacagtcattgagcaccttgaaagactgcagcggaagcacggcgggatgctggttcgcaaccccctctccagaaatagcacccatgagatgtattggatctctaacggaacaggcaatatcgtgtccagcgtgaacatggtctctcggctgcttctgaatcgcttcaccatgacacacagacggcctaccattgaaaaggatgtggacctcggggccggaacgagacatgttaacgctgagccggaaacacccaacatggacgtgatcggcgagcgcattcggagaatcaaagaggaacacagctccacctggcactacgatgaggaaaatccttataagacctgggcctaccatgggtcttatgaggtcaaagcgacaggaagcgcctccagcatgattaacggcgtggttaagctgctgacgaaaccctgggacgtggtccctaccgtgacacaaatggctatgaccgatacaaccccctttggccagcagcgcgttttcaaggaaaaggtggacacacggaccccgagacctatgcccgggacgcgcaaagccatggagatcaccgctgagtggctctggcggacactgggaagaaataagcgccctcggctttgcaccagagaagagtttaccaagaaggtccgcaccaacgccgccatgggcgcggtgttcacggaagagaatcaatgggattccgctcgggccgccgtcgaagacgaggagttttggaaactggtggatagagaacgcgagctccacaagctggggaaatgtggatcttgcgtttacaacatgatgggcaagagagaaaagaaacttggggagttcggcaaggctaaaggaagccgggccatctggtatatgtggctgggcgctcgctacctcgagtttgaagccctggggttcctgaatgaggaccattggttttccagagaaaactctttcagcggagtggagggcgaagggctccacaagctgggatacattcttcgggatatctccaaaattcccggcggggcgatgtatgccgacgatacagctggctgggacaccagaatcacagaggacgatctgcataatgaggaaaagattacccagcagatggaccctgagcaccggcagctcgccaacgctatcttcaagctgacgtaccaaaataaagtcgtgaaggtgcagcgccccaccccgaaaggaacagttatggatatcatttctagaaaggaccagcggggcagcggacaggtgggaacctatggccttaacacatttaccaatatggaagtccaactgatccgccagatggagggggaaggagtgctctccaaagccgatctggagaaccctcatctgctcgagaaggaaattacacagtggctggagaccaagggcgttgaaagacttaaacggatggcgatcagcggggacgattgcgtggtcaagcccattgacgatcgcttcgccgacgctctgctcgccctgaatgatatgggcaaagtgagaaaggacatcccccagtggcaaccttctaaaggatggcatgattggcagcaggtcccgttttgttcccaccatttccacgagcttatcatgaaggacggccggaagctggtggttccctgccgccctcaggacgaactcattgggagagctcggatcagccaaggagccggctggtctctgaaagagacggcttgtctggggaaggcctacgcgcagatgtgggccctcatgtattttcaccgcagagatctgcggcttgcttccaacgccatttgcagcgccgtgcccgtccattgggtgcctacatctcgcaccacctggtccatccacgctcatcaccagtggatgacaaccgaggacatgctgacagtttggaacagagtgtggattgaagataatccctggatcgaggacaaaacgcctgtcaccacatgggaagatgtgccctacctcggaaagcgggaggaccaatggtgtggcagcctgattgggcttgcctccagagcgacctgggctcagaacatcctgacagccatccaacaggtgcgcagcctcattggcaatgaggagttcctggattatatgccgtctatgaaacggtttagaaaggaggaagagagcgaaggagccatctggtga

SEQ ID NO: 20889 - RNA, 9873 nt, synthetic construct
  misc_feature 1..9873: note = derived and/or modified CDS sequence (opt5) from DENV-3__KC762689__SS-prME
  source 1..9873: mol_type = other RNA
accagcctgtgcctcatgatgatgatccccgccacactggctttccaccttacgtccagagacggcgagcctcggatgattgtggggaagaacgaacgcggaaaatctctgctctttaagaccgccagcggcatcaatatgtgtacactgattgcgatggatcttggggagatgtgcgacgataccgtcacatacaaatgtccgctgatcaccgaagttgagcccgaagacattgattgctggtgtaacctcacatccacctgggtgacgtatggaacctgcaatcaggctggcgagcatagacgggacaagcgctctgtggccctggcccctcacgtcgggatgggactggatacaagagctcaaacctggatgagcgccgagggcgcttggcggcaggtggaaaaagttgagacatgggccttccgccatcccggctttaccatcctcgcgctgttccttgcccactacatcgggacgtccctgacacagaaggtggtcatttttatcctcctgatgcttgtgaccccttctatgacaatgagatgtgttggagtgggcaaccgggacttcgtcgaagggctgagcggagctacctgggtggatgtggtcctcgagcatggcgggtgcgttaccacaatggccaagaataaacccacgctggacattgagctgcagaagaccgaagctacacaactcgccaccctgcgcaaactttgtatcgagggaaagattacaaacgtgaccacggattccagatgccctacacagggcgaagcgatcctgccggaggaacaggaccagaattatgtgtgtaaacacacctacgtcgatcggggctgggggaacggatgcggcctctttgggaagggaagcctggtgacctgcgccaagttccaatgtcttgagtttattgagggcaaagttgtgcagcacgaaaatctgaagtatacagtcatcatcaccgtgcatacaggggaccagcaccaggttggaaacgagacgcaaggcgtgaccgctgaaattacaccccaggcctctaccgtcgaggctatcctccctgaatacggcacactggggctggagtgctccccccgcaccggactcgacttcaatgagatgattctgcttacgatgaaaaacaaggcctggatggtgcatagacagtggtttttcgatctgcctctcccctggaccagcggcgccacaaccgaaacaccgacctggaataaaaaggagctgcttgtcacgtttaaaaacgctcacgcgaagaagcaagaagtggttgtgctggggtctcaggagggagccatgcacacagctctcaccggcgccacagaaatccagacctccgggggcaccagcattttcgccggacatctgaaatgtcggctgaagatggacaaactcgagctgaagggcatgtcttatgctatgtgccttaatgccttcgtcctgaaaaaggaggtgtccgaaacacagcacgggacgatcctcatcaaggttgagtacaaaggagaagatgcgccttgtaagattccctttagcaccgaggacggccaagggaaagctcataacggacgcctgatcacagccaaccctgtggtcaccaagaaagaggaacccgtgaatattgaggccgaaccccctttcggcgagtccaacatcgtgattgggatcggcgataaggctctgaagatcaattggtacaaaaagggatctagcattggcaaaatgtttgaagccacagctagaggggcccggagaatggcgatccttggagacaccgcctgggatttcggctccgttgggggagtcctcaacagcctgggcaagatggtgcaccagatttttgggtctgcttatacggccctgttctccggcgtgagctggatcatgaaaattggaatcggcgtcctcctgacatggattgggcttaattctaagaacaccagcatgtccttttcttgcatcgtgatcggaattatcaccctgtacctcggcgctgttgtgcaggccgacatggggtgtgtcattaattggaagggaaaagagctgaagtgcggcagcgggatcttcgtgacaaacgaggttcatacctggacagaacagtataaatttcaagcggattccccgaagcgcctggccacggctattgccggcgcttgggagaatggagtgtgtggcatccggagcaccacaagaatggaaaaccttctctggaaacagatcgccaatgagctgaactacattctgtgggaaaataacatcaagctcaccgtcgtggttggggacattatcggagtgctggagcagggcaaacgcacacttaccccccagcctatggagctgaagtattcttggaagacgtgggggaaagccaagattgtcaccgctgaaacacaaaattccagcttcatcatcgatggacccaacacccctgagtgcccctctgcgtcccgggcctggaacgtgtgggaagtggaggactacggctttggcgtcttcacaaccaatatttggctcaaactgagagaaatgtatacacagctgtgtgaccaccgccttatgagcgctgccgttaaggatgagcgggccgtgcacgctgacatggggtactggatcgagtcccagaaaaacggatcttggaagctcgaaaaggccagcctgattgaggtgaaaacctgcacgtggccgaagtcccatacactgtggtctaatggcgtcctcgaaagcgatatgatcattcctaaatccctggcggggcccgtgagccagcacaactacagacctggatatcatacccaaaccgctggcccctggcaccttgggaagctggagctcgactttaattactgcgagggaacaaccgttgtgatcacggaatcttgtggcacacgcggcccttccctgcggaccacaaccgtcagcgggaaactgatccacgagtggtgctgtagatcttgcacacttcccccgctccgctatatgggagaagatggctgttggtacgggatggagattcggcctatcaacgaaaaggaggagaatatggtgaagtccctggttagcgccggatctggcaaagtggacaacttcaccatgggggtcctgtgcctcgccattctgttcgaagaggtgatgagaggaaagtttggcaaaaagcatatgatcgctggcgttcttttcacgtttgtgctgctcctgagcgggcagattacctggcgggatatggcccgcacactgatcatgattggatccaatgcgagcgacagaatgggcatgggggtcacctatcttgctctgatcgccacattcaaaatccagccctttctcgccctgggattctttctccggaagctgacctctagagaaaaccttctgctcggcgtggggctggctatggccacgacactgcaacttcccgaggatattgaacagatggctaatggaatcgccctgggcctcatggcgctgaagctcattacccagttcgagacataccagctgtggaccgcccttgtgtccctgatgtgtagcaacaccatctttacactcacggtcgcttggcgcaccgccacactgattctggctggcatctcccttctgcctgtttgccaatctagctccatgcggaaaaccgactggctcccggtgacagtggccgccatgggggtcccccctctgcccctcttcatcttttctctgaaggatacccttaaaagacgcagctggcctctgaatgagggagtgatggctgttggcctggtgtccattctcgcgtctagcctgcttagaaacgacgtccccatggccgggcctctggtggctggaggcctcctgatcgcctgttatgttattacggggacatccgccgatctcaccgtggaaaaggctgccgacgtcatctgggaggaagaggcggaacagaccggagtgagccacaatctgatgattacagtcgacgatgacggcaccatgcggatcaaagatgacgagacagagaacatccttacggtgctgctgaagaccgctctcctgattgtttctggcatcttcccctactccattccggccacacttctggtgtggcatacctggcagaaacagacacaacgcagcggggtcctctgggatgtgccttctccccctgaaacccagaaggccgagctggaagagggagtttacagaatcaagcagcagggcatttttgggaaaacgcaagtgggagtcggcgtgcagaaggagggggtgttccacaccatgtggcatgttacacggggagctgtcctcacccacaacggcaaacgcctggaacccaattgggcctccgtgaagaaagaccttatcagctatggcgggggatggagactgtctgcgcagtggcaaaagggcgaggaagtgcaggtcgtggctgttgagccggggaagaaccctaaaaatttccagacaatgcccggaatttttcagaccacaacgggcgaaatcggggccatcgccctggatttcaagcctggaacctccggcagccccattatcaaccgggagggcaaagtggtcgggctctacggaaatggcgtggttacaaagaacgggggatatgtgtccggcattgctcaaaccaatgccgagcccgacgggcctaccccggatctggaagaggaaatgtttaaaaagcgcaaccttacaatcatggacctgcaccccggcagcggaaagacgagaaaatacctccctgctattgtccgggaggccatcaagcgcagactgcggaccctcatcctggcgcccacaagagtggttgccgctgaaatggaggaggcccttaaaggcctgcctattcgctatcagaccacagctaccaagtctgtgcatacggggaaagaaatcgtcgatctgatgtgccacgccacattcaccatgcggctcctgagccccgtgagagtgcctaattacaaccttattatcatggacgaggcccattttaccgatccggcttccattgcggcccgcggatatatctctacacgggtcggcatgggggaagctgccgccatcttcatgaccgctacaccccctggaaccgccgacgcgtttccccagagcaatgctcctattcaggacgaggaaagagatatccccgagcgctcctggaactctggcaatgagtggattacggacttcgccgggaagacagtttggtttgtgccgagcatcaaggccggcaacgatattgctaattgtctgcggaaaaacggaaagaaagtgatccaactctccagaaagaccttcgacacagaataccagaaaaccaagctgaacgattgggactttgtcgtgacgaccgatatttctgagatgggcgccaatttcaaggcggaccgcgttatcgatcctcggagatgcctgaaacccgtgatcctcacagacgggcccgaacgggtcattcttgccggacctatgcccgtgaccgttgctagcgccgctcagcgcagaggccgggtggggcgcaaccctcagaaggagaatgatcaatacatcttcacaggacagccgctgaacaatgacgaggaccacgcccattggaccgaagctaaaatgctgctcgataacattaatacacccgagggcatcattcctgccctgtttgaacccgagagagaaaagtccgcggccatcgacggggagtatcggcttaaaggcgagagcagaaagaccttcgtcgaactgatgcgccggggagatctccctgtgtggctggctcacaaagtcgcctctgagggcatcaagtacacggacagaaagtggtgctttgatggggaacgcaacaatcagattctggaggaaaacatggacgtggagatctggacaaaagagggagaaaagaaaaagctccggcccagatggcttgatgctcgcacctattccgacccgctggccctgaaagagttcaaggattttgccgctggccggaagagcattgcgctcgacctggttaccgaaatcgggagagtgccttctcaccttgcctaccgcacaagaaatgctctggataacctcgtgatgctgcatacctccgagcacggaggccgggcctatcgccatgccgtcgaagagctgcccgagacaatggaaacgctccttctgctgggcctcatgattctgcttaccgggggagctatgctgttcctcatcagcggcaaagggatcggaaagacatccattggcctgatctgtgttgtggcctctagcgggatgctgtggatggcggacgtgcctctccagtggattgcctccgctatcgtccttgagtttttcatgatggtgctgctgattcccgaacctgagaaacaaagaaccccccaggataatcagctcgcctacgttgtgatcggaattctgacacttgctgccatcgtcgcggccaacgagatgggcctgctcgaaaccacgaagcgggacctgggcatgagcaaagagccgggggtggtctctcctacctcctatctggacgtggatctccaccccgctagcgcctggacactttacgctgttgccaccacagtgatcacccccatgctgcgccacacgattgaaaattctacagctaacgtcagcctggccgcgatcgccaatcaagctgtggttctcatgggactggacaagggctggcctatttccaaggtggatcttggggtcccgctgctcgccctgggatgctactctcaggtgaaccccctgaccctcacagctgccgtgcttctgctggttacccattatgccatcattggccctgggctccaggcgaaagctaccagagaggcccagaagcggacagctgccggaatcatgaaaaaccccacggtcgacggcatcatgaccattgatctggaccctgtgatctacgatagcaagtttgaaaaacaacttggccaggtgatgctgctcgtcctgtgtgccgttcagctgctccttatgagaacatcctgggctttctgcgaggccctgaccctggcgacagggcccattaccacgctctgggagggatctcctggcaagttttggaatacaaccatcgccgtgagcatggctaacattttccgcgggtcctatctggccggagctggccttgcctttagcatcatgaagtctgtggggaccggaaaacggggcacaggctcccagggggaaaccctgggagagaagtggaaaaagaaactcaatcaactgagcagaaaggaattcgacctgtacaaaaagtccggcatcacagaggtcgatcgcacggaagcgaaggaggggctcaaacggggagagaccacacaccatgccgtgtctagaggcagcgctaagcttcagtggttcgttgaacggaacatggtgattccggaggggcgcgtcatcgacctgggatgtggcagaggcgggtggtcctattactgcgccggactgaaaaaggtgaccgaagttcggggctatacaaaagggggacccggccacgaggaacctgtgcccatgtctacctacgggtggaatattgtcaagctcatgagcggaaaggatgtgttttacctgcctcccgagaaatgtgacacgcttctgtgcgatatcggcgagtccagcccgtctcctaccgtggaagagtcccgcacaattagagtcctcaagatggttgaaccctggctgaaaaacaatcagttctgtatcaaggtgctgaacccctatatgcctaccgtgattgagcatctcgagcggcttcagcgcaaacacggcgggatgctggtcagaaatcccctgagccggaactctacacacgaaatgtactggatctccaatggaaccggcaacatcgtgagctctgttaatatggtgagccgcctcctgcttaacagatttacaatgacccatcggagacctacgattgagaaggacgtcgacctgggggctggaacacgccacgtgaatgccgaaccggagacccccaacatggatgttatcggcgaacggattagacgcatcaaggaggagcattcctctacctggcactatgacgaagagaacccttacaaaacatgggcttatcacgggagctacgaagtgaaggccacgggatccgcgagctccatgattaatggcgtcgtgaaactcctgaccaagccctgggatgttgtgcctacagtcacccaaatggccatgacagacaccacacccttcggccagcagcgggtgtttaaagagaaggtcgataccagaacgccgcgccctatgcccgggacccggaaggctatggaaatcacagccgagtggctgtggagaaccctcggacgcaacaaacggcctagactgtgcacacgcgaggaattcaccaagaaagtgcggacgaatgctgccatgggcgccgtttttacagaggaaaaccaatgggactctgcgagagctgccgtggaggatgaagagttctggaagcttgtcgaccgcgagagagaactgcataaactcgggaagtgtggaagctgcgtgtataatatgatgggcaaacgggagaagaagctgggggaatttggcaaagccaagggatcccgcgctatctggtacatgtggcttggcgccagatacctggagttcgaggctctcgggtttctgaacgaagatcactggttctctcgggagaatagcttttccggagtggaaggcgaggggctgcataaactcggatatattctgagagacatctctaagattcccggcggggccatgtacgcggatgacaccgccggctgggacacacggatcaccgaagatgaccttcacaacgaggagaaaattacgcagcagatggatcctgaacatcgccagctggctaatgccatcttcaagctcacctatcaaaacaaggttgtgaaagtccagagacccacaccgaagggaaccgtgatggacatcattagccggaaagatcagcgcggctccgggcaggttggaacatacggcctgaataccttcacaaacatggaggtgcaacttatcagacagatggaaggggagggagtcctgagcaaggctgacctcgaaaatcctcacctgctggagaaagagattacccagtggctcgaaacgaagggcgtggagcggctgaagcgcatggccatctctggggatgactgcgtcgtgaaacccattgatgacagatttgcggatgcccttctggctctcaacgacatgggcaaggttcggaaagatatcccccagtggcaaccttccaagggatggcacgactggcagcaggtgccgttctgtagccatcactttcatgaactgatcatgaaagacggccgcaagcttgtcgtgccctgcagacctcaggatgagctgattgggcgggcccgcatctctcaaggagctggctggtccctcaaggaaacagcctgtctggggaaagcttatgcccagatgtgggcgctgatgtacttccacagacgggacctccgcctggccagcaatgctatttgctctgccgttcccgtgcactgggtccctacctccagaaccacatggagcatccatgcccaccatcagtggatgaccacagaggatatgcttacggtgtggaaccgggtgtggattgaggacaacccctggatggaagataagacccctgttacaacctgggaggacgtcccctatctgggaaaaagagaagatcaatggtgtggctccctcatcgggctggctagccgcgccacatgggcgcagaatattcttaccgctatccagcaggtgcggtctctgatcggcaacgaggagtttctcgactacatgccgagcatgaagagattccgcaaagaagaggaatccgagggagccatttggtga

SEQ ID NO: 20890 - RNA, 9873 nt, synthetic construct
  misc_feature 1..9873: note = derived and/or modified CDS sequence (opt5) from DENV-3__KC762690__SS-prME
  source 1..9873: mol_type = other RNA
accagcctgtgcctcatgatgatgctgcccgccacccttgctttccacctgacgtccagagacggagagcctcggatgatcgtggggaagaatgaacgcgggaagtctctcctgtttaagaccgccagcggcattaatatgtgtacccttatcgcgatggatctgggggagatgtgcgacgataccgttacatacaagtgtccgctcattaccgaagttgagcccgaagacatcgattgctggtgtaacctgacatccacctgggtgacgtatggaacctgcaatcaggctggcgagcatagacgggacaagcgctctgtggccctggcccctcacgtcgggatgggactcgatacaagagctcagacctggatgagcgccgagggcgcttggcggcaggtcgaaaaggttgagacatgggccttccgccatcccggctttaccattctggcgcttttcctggcccactacatcgggacgtccctcacacagaaggtggtcatctttattctgcttatgctggtgaccccttctatgacaatgagatgtgttggagtgggcaaccgggacttcgtcgaagggctcagcggagctacctgggtggatgtggtcctggagcatggcgggtgcgttaccacaatggccaagaataaacccacgctggacatcgagctccagaagaccgaagctacacaactggccacccttcgcaaactgtgtattgagggaaagatcacaaacgtgaccacggattccagatgccctacacagggcgaagcgattctcccggaggaacaggaccagaattatgtgtgtaaacacacctacgtcgatcggggctgggggaacggatgcggcctgtttgggaagggaagccttgtgacctgcgccaagttccaatgtctggagtttatcgagggcaaagttgtgcagcacgaaaatctcaagtatacagtcattatcaccgtgcatacaggggaccagcaccaggttggaaacgagacgcaaggcgtgaccgctgaaatcacaccccaggcctctaccgtcgaggctattctgcctgaatacggcacactggggctcgagtgcagcccccgcaccggactggacttcaatgagatgatccttctgacgatgaaaaacaaggcctggatggtgcatagacagtggtttttcgatctccctctgccctggaccagcggcgccacaaccgaaacaccgacctggaataaaaaggagcttctggtcacgtttaaaaacgctcacgcgaagaagcaagaagtggttgtgctcgggtctcaggagggagccatgcacacagctctgaccggcgccacagaaattcagacctccgggggcaccagcatcttcgccggacatctgaaatgtcggctcaagatggacaaactggagcttaagggcatgtcttatgctatgtgcctgaatgccttcgtcctcaaaaaggaggtgtccgaaacacagcacgggacgattctgatcaaggttgagtacaaaggagaagatgcgccttgtaagatcccctttagcaccgaggacggccaagggaaagctcataacggacgcctgattacagccaaccctgtggtcaccaagaaagaggaacccgtgaatatcgaggccgaaccccctttcggcgagtccaacattgtgatcgggattggcgataaggctcttaagatcaattggtacaaaaagggatctagcatcggcaaaatgtttgaagccacagctagaggggcccggagaatggcgattctcggagacaccgcctgggatttcggctccgttgggggagtcctgaacagcctgggcaagatggtgcaccagatctttgggtctgcttatacggccctcttctccggcgtgagctggattatgaaaatcggaattggcgtcctgcttacatggatcgggctcaattctaagaacaccagcatgtccttttcttgcattgtgatcggaatcattaccctctacctgggcgctgttgtgcaggccgacatggggtgtgtcatcaattggaagggaaaagagctgaagtgcggcagcgggattttcgtgacaaacgaggttcatacctggacagaacagtataaatttcaagcggattccccgaagcgccttgccacggctatcgccggcgcttgggagaatggagtgtgtggcattcggagcaccacaagaatggaaaacctcctgtggaaacagatcgccaatgagctgaactacatcctctgggaaaataacattaagctgaccgtcgtggttggggacatcattggagtgcttgagcagggcaaacgcacactgacaccccagcctatggagctcaagtattcttggaagacgtgggggaaagccaagatcgtcaccgctgaaacacaaaattccagcttcattatcgatggacccaacacccctgagtgcccctctgcgtcccgggcctggaacgtgtgggaagtggaggactacggctttggcgtcttcacaaccaatatctggctgaaactgagagaaatgtatacacagctttgtgaccaccgcctcatgagcgctgccgttaaggatgagcgggccgtgcacgctgacatggggtactggattgagtcccagaaaaacggatcttggaagctggaaaaggccagcctgatcgaggtgaaaacctgcacgtggccgaagtcccatacactctggtctaatggcgtcctggaaagcgatatgattatccctaaatcccttgcggggcccgtgagccagcacaactacagacctggatatcatacccaaaccgctggcccctggcacctggggaagctcgagctggactttaattactgcgagggaacaaccgttgtgattacggaaaactgtggcacacgcggcccttctctgcggaccacaaccgtctccgggaaacttatccacgagtggtgctgtagaagctgcacactgcccccgctgcgctatatgggagaagatggctgttggtacgggatggagatccggcctattaatgaaaaggaggagaacatggtgaagtctctggtttccgccggaagcggcaaagtggacaatttcaccatgggggtcctctgcctggccatccttttcgaagaggtgatgagaggaaagtttggcaaaaagcatatgattgctggcgttctgttcacgtttgtgctcctgctgtctgggcagatcacctggcgggatatggcccgcacacttattatgatcggaagcaacgcgtccgacagaatgggcatgggggtcacctatctggctctcattgccacattcaaaatccagccctttctggccctcggattctttctgcggaaacttaccagcagagaaaatctgctcctgggcgtggggctggctatggccacgacacttcaactgcccgaggatatcgaacagatggctaacggaattgccctcggcctgatggcgctcaagctgatcacccagttcgagacataccagctttggaccgccctggtgtctctcatgtgttccaataccatttttacactgacggtcgcttggcgcaccgccacactgatccttgctggcattagcctgctccctgtttgccaatcctctagcatgcggaaaaccgactggctgccggtgacagtggccgccatgggggtgccccctctccccctgttcatcttttcccttaaggataccctgaaaagacgctcttggcctctgaacgagggagtgatggctgttggcctcgtgagcatcctggcgtcctctcttctgagaaatgacgtccccatggccgggcctctcgtggctggaggcctgctcattgcctgttatgttatcacggggacaagcgccgatctgaccgtggaaaaggctgccgacgtcatttgggaggaagaggcggaacagaccggagtgtcccacaaccttatgatcacagtcgacgatgacggcaccatgcggattaaagatgacgagacagagaacatcctgacggtgctgctcaagaccgctctgcttatcgttagcggcattttcccctactctatcccggccacactgctcgtgtggcatacctggcagaaacagacacaacgctccggggtcctgtgggatgtgccttctccccctgaaacccagaaggccgagctcgaagagggagtttacagaattaagcagcagggcatctttgggaaaacgcaagtgggagtcggcgtgcagaaggagggggtgttccacaccatgtggcatgttacacggggagctgtcctgacccacaatggcaaacgccttgaacccaactgggcctccgtgaagaaagacctgatttcctatggcgggggatggagactgagcgcgcagtggcaaaagggcgaggaagtgcaggtcatcgctgtggagccggggaagaatcctaaaaacttccagacaatgcccggaatttttcagaccacaacgggcgaaatcggggccatcgccctcgatttcaagcctggaacctctggctcccccattatcaatcgggagggcaaagttgtggggctgtacggaaacggcgtcgtgacaaagaatgggggatatgttagcggcattgctcaaaccaacgccgagcccgacgggcctaccccggaacttgaggaagagatgtttaaaaagcgcaatctgacaatcatggatctccaccccggctccggaaagacgagaaaatacctgcctgctattgtgcgggaagccatcaagcgcagactccggaccctgatccttgcgcccacaagagtcgtggccgctgagatggaggaagccctgaaaggcctgcctattcgctatcagaccacagctaccaagagcgcccatacggggaaagagatcgttgacctcatgtgccacgccacattcaccatgcggctgctttctcccgtgagagtccctaactacaatctgattatcatggatgaagctcattttaccgacccggcgagcattgccgctcgcggatatatctccacacgggtgggcatgggggaggccgccgctatcttcatgaccgccacaccccctggaaccgcggatgcttttccccagtctaacgcccctattcaggacgaagagagagacatccccgagcgcagctggaactccggcaacgaatggattacggatttcgccgggaagacagtgtggtttgtcccgtctatcaaggctggcaatgacattgccaactgtctccggaaaaacggaaagaaagttatccaactgagcagaaagaccttcgatacagagtaccagaaaaccaagctgaatgactgggattttgtggtgacgaccgacatttccgaaatgggcgcgaacttcaaggccgatcgcgtcatcgaccctcggagatgcctcaaacccgtgatccttacagatgggcccgagcgggttattctggctggacctatgcccgtgaccgtcgcctctgctgcccagcgcagaggccgggtggggcgcaatcctcagaaggagaacgaccaatacatcttcacaggacagccgctgaataacgatgaagaccacgctcattggaccgaggccaaaatgctcctggacaatattaacacacccgaaggcatcattcctgcgctttttgagcccgaaagagaaaagagcgccgctatcgatggggagtatcggctgaaaggcgaatccagaaagaccttcgttgagctcatgcgccggggagacctgcctgtgtggctggcccacaaagtcgctagcgaaggcatcaagtacacggatagaaagtggtgctttgacggggagcgcaataaccagattctcgaagagaatatggatgtggagatctggacaaaagaaggagagaagaagaaacttcggcccagatggctggacgcccgcacctattctgatccgctggccctcaaagagttcaaagactttgctgcgggccggaagtccattgccctggatcttgtcaccgagatcgggagagtgcctagccacctggctcatcgcacaagaaacgccctcgacaatctggttatgctgcacacctctgaacatggaggccgggcctaccgccacgctgtggaggagctccccgaaacaatggagacgcttctgctgctcggcctgatgattcttctgaccgggggagccatgctgttcctgatctccggcaaagggatcggaaagacaagcattggcctgatctgtgtggtcgcgtcctctgggatgctctggatggccgatgttcctcttcagtggattgctagcgccatcgtgctggaatttttcatgatggtgctgctcattcccgagcctgagaaacaaagaacaccccaggacaaccagctggcttatgtcgtgatcggcattcttacactggccgcgatcgttgccgctaatgaaatgggcctcctggagaccacgaagcgggatctgggcatgtccaaagaaccgggggtggtcagccctacctcttacctcgacgtggaccttcaccccgcctccgcttggacactgtatgccgtcgctaccacagtgatcacccccatgctgcgccatacgattgagaacagcacagccaatgtttctctcgcggccatcgctaaccaagccgtggtcctgatgggacttgataagggctggcctattagcaagatggacctgggggtgccgctcctggctctgggatgctactcccaggttaaccccctcacccttacagccgccgtgctgctgctcgtcacccactacgcgatcattggccctgggctgcaggctaaagccaccagagaagctcagaagcggacagccgccggaatcatgaaaaatcccacggtggatggcatcatgaccattgaccttgatcctgtgatctatgactctaagtttgagaaacaactgggccaggttatgctcctggtcctgtgtgctgtgcagctccttctgatgagaacaagctgggccttctgcgaggcgctgaccctcgccacagggcccattaccacgctgtgggaaggatcccctggcaagttttggaacacaaccatcgctgtgtctatggccaatattttccgcgggagctaccttgctggagccggcctggcgttttccatcatgaaaagcgtcgggaccggaaaacggggcacaggctctcagggggagaccctcggagaaaagtggaaaaagaaactgaaccaactgtccagaaaggagttcgatctctataaaaagagcggcatcacagaagttgaccgcacggaggccaaggaggggcttaaacggggagaaattacccatcacgctgtgtccagaggctctgccaagctgcagtggttcgtggagcggaatatggtcatcccggaagggcgcgtgattgatctgggatgtggcagaggcgggtggagctactattgcgctggactcaaaaaggttacagaggtgcggggctacaccaaagggggacccggccatgaagaacctgtccccatgtccacatatgggtggaacatcgtgaagctgatgtctggaaaggacgtcttttaccttcctcccgagaaatgtgataccctgctctgcgacattggcgaaagctccccgagccctacggtggaggaatctcgcaccatcagagtcctgaagatggtggagccctggctgaaaaataaccagttctgtattaaggtgctcaatccctacatgcctacagtcatcgagcaccttgaacggctgcagcgcaaacacggcgggatgctggttagaaaccccctctcccggaatagcacccatgagatgtattggatctctaacggaacaggcaatattgtgtccagcgtgaacatggtctctcgcctgcttctgaatagatttaccatgacacaccggagacctaccatcgaaaaggatgtggacctcggggccggaacgcgccatgttaacgctgagccggaaacacccaacatggacgtgattggcgagcggatcagacgcattaaggaggaacacagctccacctggcactacgatgaggaaaatccttataaaacctgggcctaccatgggtcttatgaggtcaaggcgacaggaagcgcctccagcatgatcaacggcgtggttaaactgctgacgaagccctgggacgtggtccctaccgtgacacaaatggctatgaccgatacaacccccttcggccagcagcgggtttttaaagaaaaggtggacacaagaaccccgcgccctatgcccgggacgcggaaggccatggagatcaccgctgagtggctctggagaacactgggacgcaataaacggcctagactttgcacccgcgaagagttcacaaagaaagtccggaccaacgccgccatgggcgcggtgtttacggaagagaatcaatgggattccgctagagccgccgtcgaagacgaggagttctggaagctggtggatcgcgaaagagagctccacaaactggggaagtgtggatcttgcgtttacaacatgatgggcaaacgggaaaagaaacttggggagtttggcaaagctaagggaagccgcgccatttggtatatgtggctgggcgctagatacctcgagttcgaagccctggggtttctgaatgaggaccattggttctcccgggaaaactcttttagcggagtggagggcgaagggctccacaaactgggatacatccttagagatatttccaagatccccggcggggcgatgtatgccgacgatacagctggctgggacacccggattacagaggacgatctgcataatgaggagaagatcacccagcagatggagcctgaacaccgccagctcgccaacgctatcttcaagctgacgtaccaaaataaggtcgtgaaagtgcagagacccaccccgaagggaacagttatggacattatctctcggaaagatcagcgcggcagcggacaggtgggaacctatggccttaacacattcaccaatatggaggtccaactgattagacagatggaaggggagggagtgctctccaaggccgacctggagaaccctcacctcctcgaaaaagagatcacacagtggctggaaaccaagggcgttgagcggcttaagcgcatggcgattagcggggatgactgcgtggtcaaacccatcgatgacagatttgccgatgctctgctcgccctgaatgacatgggcaaggtgcggaaagatatcccccagtggcaaccttctaagggatggcatgactggcagcaggtcccgttctgttcccaccattttcacgaacttattatgaaagatggccgcaagctggtggttccctgcagacctcaggacgagctcatcgggcgggctcgcattagccaaggagccggctggtctctgaaggagacggcttgtctggggaaagcctacgcgcagatgtgggccctcatgtatttccacagacgggacctgcgccttgcttccaacgccatctgcagcgccgtgcccgtccattgggtgcctacatctagaaccacctggtccattcacgctcatcaccagtggatgacaaccgaagatatgctgacagtttggaaccgggtgtggatcgaggacaatccctggatggaagataagacgcctgtcaccacatgggaggacgtgccctacctcggaaaaagagaggatcaatggtgtggcagcctgattgggcttgcctcccgcgcgacctgggctcagaacatcctgacagccatccaacaggtgcggagcctcattggcaatgaagagtttctggactatatgccgtctatgaagagattccgcaaagaagaggaaagcgagggagccatctggtga

SEQ ID NO: 20891 - RNA, 9873 nt, synthetic construct
  misc_feature 1..9873: note = derived and/or modified CDS sequence (opt5) from DENV-3__KC762691__SS-prME
  source 1..9873: mol_type = other RNA
accagcctgtgcctcatgatgatgctgcccgccacccttgctttccacctgacgtcccgggacggagaacctcggatgatcgtggggaagaatgaacgcggaaagtctctcctgtttaagaccgccagcggcattaatatgtgtacccttatcgcgatggatctgggggagatgtgcgacgataccgtgacatacaagtgtccgctcattaccgaagttgagcccgaagacatcgattgctggtgtaacctgacatccacctgggtgacgtatggaacctgcaatcaggctggcgagcatagacgggacaagcgctctgtggccctggcccctcacgttgggatgggactcgatacaagagctcaaacctggatgagcgccgagggcgcttggagacaggtggaaaaggttgagacatgggccttccgccatcccggctttaccattctggcgcttttcctggcccactacatcgggacgtccctcacacagaaggtggtcatctttattctgcttatgctggtgaccccttctatgacaatgagatgtgttggagtgggcaaccgggacttcgtcgaagggctcagcggagctacctgggtggatgtggtcctggagcatggcgggtgcgttaccacaatggccaagaataagcccacgctggacatcgagctccagaagaccgaagctacacaactggccacccttcgcaaactgtgtattgagggaaagatcacaaacgtgaccacggattccagatgccctacacagggcgaagcgattctcccggaggaacaggaccagaattatgtgtgtaaacacacctacgtcgatcggggctgggggaacggatgcggcctgtttgggaagggaagccttgtgacctgcgccaagttccaatgtctggagctcatcgagggcaaagttgtgcagcacgaaaatctgaagtatacagtcattatcaccgtgcatacaggggaccagcaccaggttggaaacgagacgcaaggcgtgaccgctgaaatcacaccccaggcctctaccgtcgaggctattctgcctgaatacggcacactcgggctggagtgcagccccagaaccggacttgactttaatgagatgatcctgctcacgatgaaagataaggcctggatggtgcatagacagtggttctttgacctgcctcttccctggaccagcggcgccacaaccgaaacaccgacctggaacaaaaaggagctgctcgtcacgttcaaaaatgctcacgcgaagaagcaagaagtggttgtgctggggtctcaggagggagccatgcacacagctctgaccggcgccacagaaattcagacctccgggggcaccagcatctttgccggacatctcaaatgtcggctgaagatggataaacttgagctgaagggcatgtcttatacaatgtgctccaacgctttcgtcctcaaaaaggaggtgagcgaaacgcagcacgggaccattctgatcaaggttgagtacaaaggagaagacgccccttgtaagatccccttctccacagaggatggccaagggaaagcgcataatggacgcctgattaccgctaaccctgtggtcacaaagaaagaggaacccgtgaacatcgaggccgaacccccttttggcgagtctaatattatcattgggatcggcgacaaggcccttaagatcaactggtacaaaaagggaagctccattggcaaaatgttcgaagctaccgccagaggggctcggagaatggccatcctcggagatacggcgtgggactttggcagcgtcggcggggttctcaattctctggggaagatggtccaccagattttcgggtccgcctatacagctctctttagcggcgtgtcttggatcatgaaaattggaatcggcgtgctgcttacctggattgggctgaacagcaagaatacctccatgtctttcagctgcatcgtcatcggaattatcacactctacctgggcgccgtggttcaggctgatatggggtgtgtgattaactggaagggaaaagagctgaagtgcggctccgggatctttgtcaccaatgaggtgcatacatggacggaacagtataaattccaagccgacagcccgcgccggcttgcgaccgccattgctggcgcctgggagaacggagtttgtggcatcagatctacaacccgcatggaaaatctcctgtggaagcagatcgctaacgagctgaattacattctctgggaaaacaatatcaaactgacagtggtcgtgggggataccattggagttcttgagcagggcaagcggacgctgacaccccagcctatggagctcaaatattcctggaagacatgggggaaggccaaaatcgtgaccgccgaaacacaaaacagctcttttattatcgacggacccaatacccctgagtgccccaacgcttccagagcgtggaacgtctgggaagtggaggactacggcttcggcgtgtttacaaccaatatctggctgaagctgcgcgaaatgtatacgcagctttgtgatcaccggctcatgagcgccgctgtcaaagacgagagagccgttcacgccgatatggggtactggattgagtcccagaagaacggatcttggaaactggaaaaggctagcctgatcgaggtgaagacatgcacctggccgaaatcccataccctctggtctaatggcgtgctggaaagcgacatgattatccctaagtcccttgccgggcccattagccagcacaactaccgccctggatatcatacacaaaccgcgggcccctggcacctggggaaactcgagctggatttcaattactgcgagggaacgacagtcgtgatcaccgaaaactgtggcgctcggggcccttctctgagaacaaccacagtttccgggaaacttatccacgagtggtgctgtcgcagctgcaccctgcccccgctgcggtatatgggagaagacggctgttggtacgggatggagattagacctatcaatgaaaaagaggagaacatggtgaagtctctggtctccgccggaagcggcaaggtggataattttacgatgggggttctctgcctggccattcttttcgaagaggtgatgcggggaaaattcggcaagaaacatatgatcgctggcgtcctgtttaccttcgtgctcctgctgtctgggcagattacatggcgcgacatggccagaacccttatcatgattggaagcaacgcgtccgatcggatgggcatgggggttacatatctggctctcatcgccacctttaagatccagcccttcctggccctcggatttttcctgagaaaacttacgagccgcgaaaatctgctcctgggcgtggggctggctatggccacaacccttcaactgcccgaggacattgaacagatggctaacggaatcgccctcggcctgatggcgctcaagctgattacacagtttgagacctaccagctttggaccgccctggtctctctcatgtgttccaatacaatcttcacgctgaccgtggcttggcggacagccaccctgattcttgctggcatcagcctgtttcctgtgtgccaatcctctagcatgagaaagacagattggctcccgatgaccgtcgccgccatgggggttccccctctgcccctcttcatcttttccctgaaagacacgcttaagcgcagatcttggcctctgaacgagggagtgatggctgtgggcctggtcagcattctcgcgtcctctctgcttcggaatgatgtgcccatggccgggcctctggttgctggaggcctcctgatcgcctgttatgtgattacagggaccagcgccgacctcaccgtcgaaaaagctgccgacgtgacatgggaggaagaggcggaacagaccggagtttcccacaacctgatgatcacagtggatgacgatggcacgatgcgcattaaggacgatgagaccgagaacatccttacagtcctgctgaaaaccgctctcctgatcgtgagcggcattttcccctactctatcccggccacacttctggtctggcatacctggcagaagcagacgcaaagatccggggtgctctgggacgttccttctccccctgaaacccagaaagccgagctggaagagggagtgtaccggattaagcagcagggcatctttgggaagacacaagtcggagtgggcgttcagaaagagggggtgttccacaccatgtggcatgtcacacgcggagctgtgctcacctataatggcaagagactggaacccaactgggcctccgtgaaaaaggatcttatttcctacggcgggggatggcggctgagcgcgcagtggcaaaaaggcgaggaagttcaggtcatcgctgtggagccggggaagaatcctaagaacttccagacaatgcccggaatttttcagacgaccacaggcgaaatcggggccatcgccctggacttcaaacctggaacctctggctcccccattatcaatcgcgagggcaaggtggtcgggctctatggaaacggcgtggttaccaaaaatgggggatacgtgagcggcattgctcaaacaaacgccgagcccgatgggcctacgccggaactggaggaagagatgtttaagaaaagaaatcttaccatcatggacctgcaccccggctccggaaagacacggaagtatctccctgctattgtccgcgaagccatcaaaagacggctgagaaccctcatcctggcgcccacacgcgtggttgccgctgagatggaggaagcccttaagggcctgcctattcggtaccagaccacggctacaaaaagcgagcacaccgggaaggaaatcgtggatctgatgtgccatgccaccttcacaatgagactcctgtctcccgtccgcgtgcctaactataatcttattatcatggacgaggcccactttaccgatccggctagcattgcggcccggggatacatctccacaagagttggcatgggggaagctgccgccatcttcatgaccgctacgccccctggaacagccgacgcgtttccccagtctaacgctcctattcaggacgaggagcgcgatatccccgaacggagctggaactccggcaacgactggattaccgatttcgccgggaaaacagtgtggtttgtcccgtctatcaaggccggcaatgacattgctaactgtctgagaaagaacggcaagaaggtgatccaactcagccgcaaaaccttcgatacggagtaccagaagaccaaactgaatgactgggattttgtggtcacaaccgacatttccgaaatgggcgccaacttcaaggcggatcgggttatcgaccctagacggtgcctgaagcccgtgatcctcacagatgggcccgagcgcgtgattcttgccggacctatgcccgtcaccgtggcttctgccgctcagagacggggccgcatcgggagaaatcctcagaaagagaacgaccaatatattttcacaggacagccgctgaataacgacgaagatcatgcccactggaccgaggctaagatgctgctcgacaatatcaacacgcccgaaggcattatccctgccctgtttgagcccgaacgggagaaaagcgcggccatcgatggggagtacagacttaagggcgaatcccgcaaaacattcgttgagctgatgcggagaggagacctccctgtgtggctggctcataaggtcgccagcgaaggcattaaatataccgatcgcaagtggtgctttgacggggagcggaataaccagatcctggaagagaatatggatgtggagatttggaccaaggaaggagagaaaaagaaactcagaccccgctggcttgacgctcggacatactctgatccgctggccctgaaggagttcaaagactttgccgctggcagaaagtccatcgcgctcgatctggttaccgagattgggcgcgtgcctagccaccttgcccacagaacacggaacgctctggacaatctcgtcatgctgcatacgtctgaacacggaggccgcgcctatagacatgccgtggaggagctgcccgaaaccatggagacactccttctgctgggcctcatgatcctgcttaccgggggagctatgctgttcctcatctccggcaagggggtcggaaaaacaagcattggcctgatctgtgtggttgcctcctctgggatgctgtggatggcggatattcctctccagtggatcgccagcgctattgtgcttgaatttttcatgatggtgctgctgatccccgagcctgagaagcaacggacaccccaggacaaccagctcgcctacgtcgttattggaatcctgacgcttgctgccatcgtggcggccaatgaaatgggcctgctcgagaccacaaaacgcgacctgggcatgtccaaggaaccgggggtggtcagccctacctcttatctggatgtggacctccaccccgcttccgcctggacactttacgctgttgccaccacggtgattacacccatgctgagacacaccatcgagaacagcacagctaatgtctctctggccgcgattgccaaccaagctgtggtcctcatgggactggataaaggctggcctatcagcaagatggaccttggggtgccgctgctcgccctgggatgctactcccaggttaaccccctgaccctcaccgctgccgtgcttctgctggtcacacattatgccattatcggccctgggctccaggcgaaggctacgcgggaagcccagaaaagaaccgctgccggaatcatgaagaatcccacagtggatggcattatgaccatcgacctggatcctgttatttacgactctaaatttgagaagcaacttggccaggtgatgctgctcgtcctgtgtgccgtgcagctgctccttatgcgcacaagctgggctttctgcgaggccctgaccctggcgacggggcccatcacaaccctctgggaaggatcccctggcaaattttggaacaccacaattgccgtgtctatggctaatatcttccgggggagctatctggccggagctggccttgccttttccatcatgaaaagcgttgggaccggaaagagaggcacaggctctcagggggagacgctgggagaaaaatggaagaaaaagctcaaccaactgtcccgcaaagagttcgatctgtacaagaaaagcggcattaccgaagtcgaccggacagaggcgaaggaggggctcaagagaggagaaatcacccaccatgccgtgtcccggggctctgctaaacttcagtggttcgtggagcgcaatatggtcattccggaagggagagttatcgatctgggatgtggccggggcgggtggagctattactgcgccggactgaagaaagtgacagaggtgcgcggctataccaaagggggacccggccacgaagaacctgtccccatgtccacgtacgggtggaacattgtgaaactcatgtctggaaaggacgtcttttacctgcctcccgagaagtgtgatacccttctgtgcgacatcggcgaaagctccccgagccctacagtggaggaatctagaaccattcgggtcctcaaaatggtggagccctggctgaagaataaccagttctgtatcaaagttctgaatccctatatgcctacagtgatcgagcatctcgaacgccttcagagaaagcacggcgggatgctggtccggaaccccctgtcccgcaatagcacccacgagatgtactggatttctaacggaacaggcaatatcgtgtccagcgtgaacatggtctctagactcctgcttaatcggtttaccatgacgtatagacgccctacaattgaaaaagacgttgatctgggggctggaacccggcatgtgaacgccgagccggaaacccccaacatggacgtgatcggcgagcgcattcgccggatcaaggaggaacacagctccacatggcattacgatgacgagaatccttataagacgtgggcttaccacgggtcttatgaagtcaaagccaccggaagcgcgtccagcatgatcaacggcgtggttaagctcctgacaaaaccctgggatgtggtccctaccgtgacacaaatggccatgaccgacacaacccccttcggccagcagagagtttttaaggagaaagtggatacgcgcaccccgaagcctatgcccgggacacggaaggtcatggaaattaccgctgagtggctgtggagaacactcggacgcaataaacggcctagactgtgcacccgcgaggagttcacgaagaaagtgcggacaaacgccgctatgggcgccgtttttaccgaggaaaatcaatgggactccgccagagcggctgtggaggatgaagagttctggaaacttgtcgaccgcgagagagaactgcacaaactcgggaagtgtggatcttgcgtgtacaacatgatgggcaaacgggagaagaagctgggggaatttggcaaagccaagggaagccgcgccatctggtacatgtggcttggcgctagatatctggagttcgaggccctcgggtttctgaatgaagatcattggttctcccgggagaactcttacagcggagtcgaaggcgaggggctgcacaaactcggatatattctgagagacatctccaagattcccggcggggctatgtacgccgacgatacagcgggctgggacacccggatcacggaagatgaccttcataatgaggagaaaatcacccagcagatggatcctgaacaccgccagctggccaacgctatttttaagctcacatatcaaaataaggtggttaaagtgcagagacccaccccgaagggaacagtcatggacatcatttctcggaaagatcagcgcggcagcggacaggtgggaacctacggcctgaacacattcaccaatatggaggcccaacttatcagacagatggaaggggagggagtgctgtccaagacggacctcgaaaaccctcatctgctggagaaaaagattacacagtggctcgagaccaagggcgttgaacggctgaaacgcatggctatcagcggggatgactgcgtggtcaagcccatcgatgacagattcgccaatgcgcttctggccctcaacgatatgggcaaagtgcggaaggacattccccagtggcaaccttctaaaggatggcacgactggcagcaggttccgttttgttcccaccatttccacgagctgatcatgaaggatggccgcaaacttgtggtcccctgcagacctcaggacgaactgattgggcgggctcgcatcagccaaggagccggctggtctctcaaagagaccgcttgtctggggaaggcctatgctcagatgtgggccctgatgtactttcatagacgggatctccgcctggcgtccaacgccatttgcagcgctgtgcccgtccactgggtgcctacatctagaaccacatggtccatccacgcccatcaccagtggatgacgaccgaagacatgcttacagtttggaatcgggtgtggattgaggataacccctggatggaggacaaaacccctgtcacaacctgggaagatgtgccctacctgggaaagagagaggaccaatggtgtggcagcctcatcgggctgacgtcccgcgccacctgggctcagaatatccttacagccattcagcaggttcggagcctgatcggcaacgaagagttcctcgattatatgccgtctatgaaaagatttcgcaaggaggaagagagcgaaggagcgatttggtga

SEQ ID NO: 20892 - RNA, 9873 nt, synthetic construct
  misc_feature 1..9873: note = derived and/or modified CDS sequence (opt5) from DENV-3__KC762692__SS-prME
  source 1..9873: mol_type = other RNA
accagcctctgcctcatgatgatgctgcccgccacccttgctttccacctgacgtccagagacggagagcctcggatgatcgtggggaagaacgaacgcggaaagtctctcctgtttaagaccgccagcggcattaatatgtgtacgcttatcgcgatggatctgggggagatgtgcgacgataccgtgacctacaagtgtccgctcattaccgaagttgagcccgaagacatcgattgctggtgtaacctgacatccacctgggtgacgtatggaacctgcaatcaggctggcgagcatagacgggacaagcgctctgtggccctggcccctcacgtggggatgggactcgatacaagagctcaaacctggatgagcgccgagggcgcttggagacaggtggaaaaggttgagacatgggccttccgccatcccggctttaccattctggcgcttttcctggcccactacatcgggacgtccctcacacagaaggtggtcatctttattctgcttatgctggtgaccccttctatgacaatgagatgtgttggagtgggcaaccgggacttcgtcgaagggctcagcggagctacctgggtggatgtggtcctggagcatggcgggtgcgttaccacaatggccaagaataaacccacgctggacatcgagctccagaagaccgaagctacacaactggccacccttcgcaaactgtgtattgagggaaagatcacaaacgtgaccacggattccagatgccctacacagggcgaagcgattctcccggaggaacaggaccagaattatgtgtgtaaacacacctacgtcgatcggggctgggggaacggatgcggcctgtttgggaagggaagccttgtgacctgcgccaagttccaatgtctggagctcatcgagggcaaagttgtgcagcacgaaaatctgaagtatacagtcattatcaccgtgcatacaggggaccagcaccaggttggaaacgagacgcaaggcgtgaccgctgaaatcacaccccaggcctctaccgtcgaggctattctgcctgaatacggcacactcgggctggagtgcagcccccgcaccggacttgactttaatgagatgatcctgctcacgatgaaaaacaaggcctggatggtgcatagacagtggttctttgatctgcctcttccctggaccagcggcgccacaaccgaaacaccgacctggaataaaaaggagctgctcgtcacgttcaaaaacgctcacgcgaagaagcaagaagtggttgtgctggggtctcaggagggagccatgcacacagctctgaccggcgccacagaaattcagacctccgggggcaccagcatctttgccggacatctcaaatgtcggctgaagatggacaaacttgagctgaagggcatgtcttatgctatgtgctccaatgccttcgtcctcaaaaaggaggtgagcgaaacacagcacgggacgattctgatcaaggttgagtacaaaggagaagatgcgccttgtaagatccccttctccaccgaggacggccaagggaaagctcataacggacgcctgattacagccaaccctgtggtcaccaagaaagaggaacccgtgaatatcgaggccgaacccccttttggcgagtctaacattatcattgggatcggcgataaggctcttaagatcaattggtacaaaaagggaagctccattggcaaaatgttcgaagccacagctagaggggcccggagaatggcgatcctcggagacaccgcctgggattttggcagcgtcgggggagttctgaactctctgggcaagatggtccaccagattttcgggtccgcttatacggccctctttagcggcgtgtcttggatcatgaaaattggaatcggcgtgctgcttacatggattgggctgaatagcaagaacacctccatgtctttcagctgcatcgtcatcggaattatcaccctctacctgggcgctgtggttcaggccgacatggggtgtgtgattaattggaagggaaaagagctgaagtgcggctccgggatctttgtcacaaacgaggtgcatacctggacagaacagtataaattccaagcggatagcccgaagcgccttgccacggctattgttggcgcctgggagaatggagtgtgtggcatccggtctaccacaagaatggaaaacctcctgtggaaacagatcgctaatgagctgaactacattctctgggaaaataacatcaagctgaccgtcgtggttggggacattatcggagtgcttgagcagggcaaacgcacactgacaccccagcctatggagctcaagtattcctggaagacgtgggggaaagccaagattgtcaccgccgaaatccaaaatagctcttttatcattgatggacccaacacacctgagtgccccaacgcttcccgggcgtggaatgtgtgggaagtggaggactacggcttcggcgtctttaccacaaacatctggctgaaactgagagaaatgtatacccagctttgtgaccaccgcctcatgagcgccgctgttaaggatgagcgggccgtgcacgccgacatggggtactggattgagtcccagaaaaatggatcttggaagctggaaaaggctagcctgatcgaggtgaaaacatgcacctggccgaagtcccatacgctctggtctaacggcgtcctggaaagcgatatgattatccctaaatcccttgccgggcccatcagccagcacaattacagacctggatatcatacacaaaccgcgggcccctggcacctggggaagctcgagctggacttcaactactgcgagggaaccacagtggttattaccgaaaattgtggcacgcgcggcccttctctgcggacaaccacagtgtccgggaaacttatccacgagtggtgctgtagaagctgcaccctgcccccgctgcgctatatgggagaagatggctgttggtacgggatggagattcggcctatcaacgaaaaggaggagaatatggtcaagtctctggtgtccgctggaagcggcaaagttgacaactttacaatgggggtgctctgcctggccattcttttcgaagaggtcatgagaggaaagttcggcaaaaagcatatgatcgccggcgtgctgtttatgttcgttctcctgctgtctgggcagattacctggcgggatatggctcgcacgcttatcatgatcggaagcaatgcctccgacagaatgggcatgggggtgacctatctggcgctcattgctacatttaaaatccagcccttcctggccctcggatttttcctgcggaaacttaccagcagagaaaacctgctcctgggcgtcgggctggccatggctacaacccttcaactgcccgaggatattgaacagatggccaatggaatcgctctcggcctgatggtgctcaagctgattacgcagtttgagacataccagctttggaccgccctggtgtctctcacatgttccaacaccatcttcaccctgacagtcgcgtggcgcacggccaccctgatccttgctggcacaagcctgctccctgtttgccaatcctctagcatgcggaaaaccgactggctgccgatgacagtggccgctatgggggtgccccctctccccctgtttattttctcccttaaggataccctgaaaagacgctcttggcctctgaatgagggagtcatggccgtgggcctcgttagcatcctggcctcctctcttctgagaaacgacgtgcccatggctgggcctctcgtcgcgggaggcctgctcattgcctgttatgtgatcacggggacaagcgctgatctgaccgttgaaaaggccgccgacgtgacctgggaggaagaggctgaacagacaggagtctcccacaaccttatgattaccgtggacgatgacggcacaatgcggatcaaagatgacgagacggagaatatcctgaccgtcctgctcaagacagccctgcttattgtgagcggcatctttccctactctattccggcgaccctgctcgtttggcatacatggcagaaacagacccaacgctccggggtgctgtgggatgtcccttctccccctgaaacgcagaaggctgagctcgaagagggagtgtacagaatcaagcagcagggcattttcgggaaaacccaagttggagtgggcgtccagaaggagggggtgtttcacacaatgtggcatgtgacccggggagccgttctgacatataacggcaaacgccttgaacccaattgggcctccgtcaagaaagacctgatctcctacggcgggggatggagactgagcgctcagtggcaaaagggcgaggaagtccaggtgattgccgtcgagccggggaagaaccctaaaaatttccagaccatgcccggaatcttccagacaatcacgggcgaaattggggcgatcgctctcgattttaagcctggaacctctggctcccccattatcaaccgggagggcaaagtggttgggctgtatggaaatggcgtggtcacaaagaacgggggatacgtgagcggcattgcccaaaccaatgccgagcccgacgggcctaccccggaacttgaggaagagatgttcaaaaagcgcaacctgacaatcatggatctccaccccggctccggaaagacgagaaaatatctgcctaccatcgttcgggaagctattaagcgcagactccggacactgatccttgcccccaccagagtggtcgctgccgagatggaggaagcgctgaaaggcctgcctattcgctaccagacaaccgccacaaagagcgagcacacagggaaagaaatcgtggacctcatgtgccatgctacctttaccatgcggctgctttctcccgttagagtgcctaattataacctgattatcatggatgaggcccacttcacagacccggctagcatcgccgcccgcggatacatttccacccgggtcggcatgggggaagctgcggccatctttatgacagctacaccccctggaacggccgatgccttcccccagtctaatgctcctattcaggacgaggagagagacatccccgaacgcagctggaactccggcaatgattggattacagactttgccgggaagaccgtgtggttcgtgccgtctatcaaggcgggcaacgatattgctaactgtctccggaaaaatggaaagaaagtcatccaactgagcagaaagacatttgacaccgagtaccagaaaacgaagctgaacgattgggacttcgttgtgaccacagatatctccgaaatgggcgccaattttaaggccgaccgcgtgattgatcctcggagatgcctcaaacccgtcatccttaccgacgggcccgagcgggtgattctggctggacctatgcccgttacagtggcctctgcggcccagcgcagaggccgggtcgggcgcaaccctcagaaggagaatgatcaatatatcttcaccggacagccgctgaacaatgacgaagaccatgctcactggacagaggccaaaatgctcctggataacattaatacccccgaaggcatcatccctgctcttttcgagcccgaaagagaaaagagcgccgctattgacggggagtaccggctgaaaggcgaatccagaaagacgtttgtggagctcatgcgccggggagatctgcctgtttggctggcccataaagtggcgagcgaaggcatcaagtatacagacagaaagtggtgcttcgatggggagcgcaacaatcagattctcgaagagaacatggacgtcgagatctggaccaaagaaggagagaagaagaaacttcggcccagatggctggatgcccgcacctactctgacccgctggctctcaaagaatttaaagatttcgccgctggccggaagtccattgccctggaccttgtgacagagatcgggagagtccctagccacctggcccaccgcaccagaaatgctctcgataacctggtgatgctgcatacatctgaacacggaggccgggcgtatcgccatgccgttgaggagctccccgaaacgatggagacccttctgctgctcggcctgatgatccttctgacagggggagctatgctctttctgatttccggcaaaggggtgggaaagaccagcatcggcctgatttgtgtggtcgcctcctctgggatgctctggatggccgacatccctcttcagtggattgctagcgccatcgttctggagttctttatgatggtgctgctcattcccgagcctgagaaacaaagaacaccccaggataatcagctggcgtacgtggtcatcggaatccttaccctggccgctattgtggccgctaacgaaatgggcctcctggagacgaccaagcgggacctgggcatgtccaaagaaccgggggttgtgagccctacatcttatctcgacgtcgatcttcaccccgcctccgcgtggaccctgtacgccgtggctacaaccgtcatcacgcccatgctgcgccacacaattgagaatagcaccgccaacgtgtctctcgctgccatcgctaaccaagccgttgtgctgatgggacttgacaagggctggcctattagcaagatggatctgggggtcccgctcctggcgctgggatgctactcccaggtgaatcccctcacacttaccgccgctgttctgctgctcgtgacccattatgccatcatcggccctgggctgcaggctaaagccacaagagaagcccagaagcggacggcggctggaattatgaaaaaccccaccgtcgacggcatcatgacaattgatcttgaccctgtgatctacgattctaagttcgagaaacaactgggccaggtgatgctcctggttctgtgtgccgtccagctccttctgatgagaaccagctgggctttttgcgaggccctgacactcgccaccgggcccattacgacactgtgggaaggatcccctggcaagttctggaataccaccatcgctgtgtctatggccaacatctttcgcgggagctatcttgcgggagccggcctggctttctccattatgaaaagcgtggggacaggaaaacggggcaccggctctcagggggagacactcggagaaaagtggaaaaagaaactgaatcaactgtccagaaaggagtttgacctctacaaaaagagcggcatcacggaagtcgatcgcaccgaggccaaggaggggcttaaacggggagaaattacacaccatgctgtttccagaggctctgccaagctgcagtggttcgtggagcggaacatggtgatcccggaagggcgcgtcattgacctgggatgtggcagaggcgggtggagctattactgcgcgggactcaaaaaggtgaccgaggttcggggctatacaaaagggggacccggccacgaggaacctgtgcccatgtccacctacgggtggaatatcgtcaagctgatgtctggaaaggatgtgttctaccttcctcccgagaaatgtgacacgctgctctgcgatattggcgaaagctccccgagccctaccgttgaggaatctcgcacaatcagagtgctgaagatggtcgagccctggctgaaaaacaatcagttttgtatcaaggtgctcaacccctatatgcctaccgtgattgagcatcttgaacggctgcagcgcaaacacggcgggatgctggtcagaaatcccctctcccggaacagcacacacgagatgtactggatctctaatggaaccggcaacattgtttccagcgtgaatatggtgtctcgcctgcttctgaacagattcacaatgacctatcggagacctacgatcgaaaaggacgtcgacctcggggccggaacacgccatgtgaacgctgagccggaaacccccaatatggatgttattggcgagcggatcagacgcatcaaggaggaacacagctccacctggcattacgacgatgagaacccttataaaacatgggcctaccacgggtcttatgaagtgaaggctacgggaagcgcctccagcatgattaatggcgtcgtgaaactgctgaccaagccctgggacgttgtgcctacagtcacccaaatggctatgacagataccacaccctttggccagcagcgggtgttcaaagagaaggttgacaccagaacgccgaagcctatgcccgggacccgcaaaatcatggaaattacagccggatggctctggcggaccctgggcagaaacaagcgccctcggctttgcacaagagaggagtttaccaaaaaggtgcgcacgaatgcggccatgggggctgtcttcacagaagagaaccaatgggattccgcccgggctgccgtggaagacgaggaattttggaaactggtcgatagagagcgcgagctccacaagcagggaaaatgtggctcttgcgtgtacaatatgatggggaagagagaaaagaaactgggcgagttcggaaaggccaaaggcagccgggcgatctggtacatgtggcttggggctcgctatctggaatttgaggccctcggattcctgaacgaggaccattggttttccagagaaaattcttacagcggcgttgagggggaaggactgcacaagctcggctatattctgcgggatatctccaaaatccccgggggcgccatgtacgctgacgacaccgccggatgggatacaagaattaccgaggacgatcttcataacgaagagaagatcacgcagcagatggaccctgagcaccggcaactggctaatgccattttcaagctcacctatcagaacaaagtggtcaaggtgcagcgccccacaccgaaaggcaccgtgatggatatcatttctagaaaggaccagcgggggagcggacaagttggcacatacgggctgaatacctttacaaacatggaagcgcagcttatccgccagatggagggagaaggcgtgctgtccaaaaccgatctcgagaatcctcatctgctggaaaagaagatcacgcagtggctcgagacaaaaggggtcgagagactgaagcggatggccattagcggcgacgattgcgtggttaaacccatcgacgatcgcttcgctaacgcccttctggctctcaacgacatgggaaaggtgagaaaagatattccccaatggcagccttctaagggctggcacgactggcagcaggtcccgttctgttcccaccattttcacgaactgatcatgaaggacgggcggaatcttgtggtcccctgccgccctcaagatgagctgattggccgggcccggatcagccagggcgcggggtggtctctcaaagaaaccgcctgtctgggaaaggcttatgcccagatgtgggctctgatgtacttccatcgcagagacctccggctggcctccaacgctatttgcagcgccgtgcccgttcactgggtgcctacctctcgcacaacctggtccatccacgcgcatcaccaatggatgacaacggagaatatgcttaccgtctggaacagagtgtggatcgaagataatccctggatggaggacaaaacacctgttaccacatgggaggatgtgccctacctgggcaagcgggaagaccagtggtgtgggagcctcattggcctgacctccagagccacgtgggctcagaacatccttaccgccattcagcaagtccgcagcctgatcggaaatgaggaatttctcgattatatgccgtctatgaaacggttcagaaaggaggaggaaagcgagggcgccatttggtga

SEQ ID NO: 20893 - RNA, 9873 nt, synthetic construct
  misc_feature 1..9873: note = derived and/or modified CDS sequence (opt5) from DENV-3__JQ920481__SS-prME
  source 1..9873: mol_type = other RNA
accagcctgtgcctcatgatgatgctgcccgccacacttgctttccacctgacgtccagagacggcgagcctcggatgatcgtggggaagaacgaacgcggaaaatctctcctgtttaagaccgccagcggcattaatatgtgtacacttatcgcgatggatctgggggagatgtgcgacgataccgtcacatacaaatgtccgctcattaccgaagttgagcccgaagacatcgattgctggtgtaacctgacatccacctgggtgacgtatggaacctgcaatcaggctggcgagcatagacgggacaagcgctctgtggccctggcccctcacgtcgggatgggactcgatacaagaacccaaacatggatgagcgctgagggcgcctggcggcaggtggaaaaagttgagacctgggctttccgccatcccggctttacgattctggcccttttcctggcgcactacatcgggacatccctcacccagaaggtggtcatctttattctgcttatgctggtgacaccttctatgaccatgagatgtgttggagtgggcaaccgggacttcgtcgaagggctcagcggagccacctgggtggatgtggtcctggagcatggcgggtgcgttacaacgatggctaagaataaacccaccctggacatcgagctccagaagacagaagccacccaactggctacacttcgcaaactgtgtattgagggaaagatcaccaacgtgacgacagattccagatgccctacccagggcgaagccattctcccggaggaacaggaccagaattatgtgtgtaaacacacctacgtcgatcggggctgggggaacggatgcggcctgtttgggaagggaagccttgtgacatgcgcgaagttccaatgtctggagtctatcgagggcaaagccgttcagcacgaaaatctcaagtataccgtgattatcacagtccatacgggggaccagcaccaggtgggaaacgagacccaaggcgttacagctgaaatcaccccccaggcctccacagtggaggctattctgcctgaatacggcaccctggggctcgagtgcagcccccgcacgggactggactttaatgagatgatccttctgaccatgaaaaacaaggcctggatggtccatagacagtggttctttgatctccctctgccctggacatctggcgccaccacagaaaccccgacgtggaataaaaaggagcttctggtgacattcaaaaacgctcacgcgaagaagcaagaagtcgtggttctcgggtcccaggagggagccatgcacaccgctctgacaggcgccaccgaaattcagaccagcgggggcacatctatctttgccggacatctgaaatgtcggctcaagatggacaaactggagcttaagggcatgtcctatgctatgtgcctgaatgccttcgtgctcaaaaaggaggtcagcgaaacgcagcacgggaccattctgatcaaggtggagtacaaaggagaagatgcgccttgtaagatccccttctccacagaggacggccaagggaaagctcataacggacgcctgattaccgccaaccctatcgttacaaagaaagaggaacccgtgaatattgaggccgaacccccttttggcgagtctaacatcgtcattgggatcggcgataaggctcttaagatcaattggtacaaaaagggaagctccattggcaaaatgttcgaagccaccgctagaggggcccggagaatggcgatcctcggagacacggcctgggattttggcagcgtggggggagtgctgaactctctgggcaagatggttcaccagattttcgggtccgcttatacagccctctttagcggcgtctcttggatcatgaaaattggaatcggcgtgctgcttacctggattgggctgaatagcaagaacacctccatgtctttcagctgcatcgtgatcggaattatcacactctacctgggcgctgtcgtgcaggccgacatggggtgtgttattaattggaagggaaaagagctgaagtgcggctccgggatctttgtgaccaacgaggtccatacatggacggaacagtataaattccaagcggatagcccgaagcgccttgccaccgctattgccggcgcttgggagaatggagtgtgtggcatccggtctacaaccagaatggaaaacctcctgtggaaacagatcgccaatgagctgaactacattctctgggaaaataacatcaagctgacagttgtggtcggggacgtgattggagttcttgagcagggcaaacgcaccctgacgccccagcctatggagctcaagtattcctggaagacctgggggaaagccaagatcgtgacagctgaaacccaaaatagctcttttattatcgatggacccaacacacctgagtgcccctccgcgagccgggcctggaacgtctgggaagtggaggactacggcttcggcgtgtttaccacaaatatctggctgaaactgagagaaatgtatacccagctttgtgaccaccgcctcatgtccgctgccgtcaaggatgagcgggccgttcacgctgacatggggtactggattgagtctcagaaaaacggaagctggaagctggaaaaggcctccctgatcgaggtgaaaacgtgcacatggccgaagtctcataccctctggagcaatggcgtgctggaatccgatatgattatccctaaaagccttgcggggcccatttctcagcacaactacagacctggatatcatacccaaacagctggcccctggcacctggggaagctcgagctggacttcaattactgcgagggaaccacggtcgtgatcacagaaaactgtggcacccgcggcccttccctgcggacaaccacagttagcgggaaacttatccacgagtggtgctgtagatcttgcaccctccccccgctgcgctatatgggagaagatggctgttggtacgggatggagattcggcctatcaatgaaaaggaggagaacatggtgaagtccctggtcagcgccggatctggcaaagccgacaattttacgatgggggtgctctgcctggctattcttttcgaagaggttatgagaggaaagttcggcaaaaagcatatgatcgccggcgcgctgtttaccttcgtgctcctgctgagcgggcagattacatggcgggatatggctcacacccttatcatgattggatccaacgccagcgaccgcatgggcatgggggtcacatatctggccctcatcgctacctttaaaatccagcccttcctggccctcggatttttcctgagaaagcttacgtctcgggaaaatctgctcctgggcgtggggctggctatggccacaacccttcaactgcccgaggatattgaacagatggcgaacggaatcgccctcggcctgatggctctcaagctgattacacagtttgagacctaccagctttggaccgccctggtttccctcatgtgtagcaatacaatcttcacgctgaccgtggcttggagaacagccaccctgattcttgccgtcatctccctgctccctgtgtgccaatctagctccatgcgcaaaacagactggctgccgatgaccgtggctgcgatgggcgtcccccctctccccctgtttatcttctctcttaaggatacgctgaaacggagaagctggcctctgaacgagggggttatggccgtgggactcgtgtccattctggcttctagctttcttcgcaatgacgtccccatggccggccctctggtggccgggggactcctgatcgcttgttatgttattacaggcacctccgccgatctcaccgtggaaaaggcggctgacgtcacatgggaggaagaggccgaacagaccggggtgagccataacctgatgatcacagttgacgatgacggaacgatgagaattaaagatgacgagaccgagaacatccttacagtgctgctgaagaccgccctcctgatcgtctctggcattttcccctactccatcccggctacacttctggtgtggcacacctggcagaaacagacgcaacggagcggcgtcctctgggatgtgccttctccccctgaaacccagaaggccgagctggaagagggggtttaccgcattaagcagcagggaatctttggcaaaacacaagtgggggtcggagtgcagaaggagggcgttttccataccatgtggcacgtgacaagaggggcggtcctcacccacaatggaaaacggctggaacccaactgggctaatgtgaagaaagaccttatttcctatggcggcgggtggaagctgagcgcccagtggcaaaagggagaggaagtgcaggttatcgccgtcgagccgggcaaaaaccctaagaatttccagacaatgcccgggatttttcagacgaccacaggagaaatcggcgctatcgccctggatttcaaacctgggacctctggatcccccattatcaaccgcgagggcaaggtggtgggcctctacgggaatggagtcgtgaccaaaaacggcgggtatgttagcggaattgctcaaacaaatgccgagcccgacggccctacgccggaactggaggaagagatgtttaagaagagaaaccttaccatcatggatctgcatcccgggtccggcaaaacacggaagtacctccctgcgattgtgcgcgaagccatcaaaagacggctgcgcaccctcatcctggctcccacaagagtcgtggccgctgagatggaggaagcccttaagggactgcctattcggtatcagaccacggccacaaaaagcgagcacaccggcagagaaatcgttgacctgatgtgccatgctaccttcacaatgcgcctcctgtctcccgtgcgggtccctaattacaaccttattgtgatggatgaggcgcactttaccgacccggccagcatcgctgccagagggtatatttccacacgcgttggaatgggcgaagccgctgccatcttcatgaccgcgacgccccctgggacagctgatgcctttccccagtctaatgcccctatccaggacgaggagcgggacattcccgaaagaagctggaactccggaaatgagtggatcaccgatttcgctggcaagacagtgtggtttgtcccgtctattaaggccgggaacgacatcgcgaactgtctgcgcaaaaatggcaagaaagtgattcaactcagccggaagaccttcgatacggaataccagaaaaccaagctgaacgactgggattttgtggtcacaaccgacatctccgagatgggagccaatttcaaggctgatagagttattgaccctcgccggtgcctgaaacccgtgatcctcacagatggccccgagagagtgatccttgccgggcctatgcccgtcaccgtggcttctgccgctcagcggcgcggaagagttggccggaaccctcagaaggaaaatgaccaatacattttcacagggcagccgctgaacaatgatgaggaccatgcccactggaccgaagcgaaaatgctgctcgacaacatcaatacgcccgagggaattatccctgccctgtttgaacccgagcgcgagaagagcgctgccattgatggcgaatatagacttaaaggggagtcccggaagacattcgtggaactgatgagacgcggcgacctccctgtctggctggctcacaaagtggccagcgagggaatcaagtacaccgatcggaagtggtgctttgacggcgaaagaaacaatcagatcctggaggagaacatggatgttgaaatttggaccaaagagggggaaaagaaaaagctccgcccccggtggcttgacgccagaacatattctgatccgctggctctgaaagagttcaaggactttgcggccggacgcaagtccatcgctctcgatctggtgaccgaaattggccgggtccctagccatcttgcccacagaacacgcaatgccctggacaacctcgtgatgctgcatacgtctgagcacgggggaagagcttaccggcacgccgtcgaggaactgcccgagaccatggaaacactccttctgctgggcctcatgatcctgcttaccggcggggcgatgctgttcctcatttccggaaaaggcatcgggaagacaagcatcggactgatttgtgtggttgcctcctctggcatgctgtggatggctgatgtgcctctccagtggatcgccagcgctattgtgcttgagtttttcatgatggtcctgctgatccccgagcctgaaaaacaacgcaccccccaggacaatcagctcgcctatgttgtgattgggatcctgacgcttgcggccattgtggctgccaacgagatgggactgctcgaaaccacaaagagagatctgggcatgtccaaagagccgggcgtcgtgagccctacctcttacctggacgttgacctccatcccgcttccgcctggacactttatgctgtggccaccacggtcatcacacccatgctgcggcacaccatcgaaaatagcacagcgaacgtgtctctggccgctattgccaaccaagctgtcgtgctcatggggctggataagggatggcctatcagcaagatggaccttggcgttccgctgctcgccctggggtgctactcccaggtgaatcccctgaccctcaccgccgcggtccttctgctggtgacacattacgctattatcggacctggcctccaggccaaagctacgcgcgaggcccagaagagaaccgccgctgggattatgaaaaaccccacagttgatggaatcatgaccatcgacctggatcctgtgatttatgactctaagtttgagaaacaacttggccaggtcatgctgctcgtgctgtgtgccgtgcagctgctccttatgcggacaagctgggcgttctgcgaagccctgaccctggctacgggccccatcacaaccctctgggaggggtcccctggaaagttttggaataccacaattgccgtttctatggctaacatcttcagaggcagctacctggccggggcgggacttgccttttccattatgaagagcgtcggcaccgggaaacgcggaacaggctctcagggcgaaacgctgggggagaagtggaaaaagaaactcaatcaactgtcccggaaggaattcgatctgtataaaaagagcggaatcaccgaggtggacagaacagaggctaaggaaggcctcaaacgcggggagatcacccaccatgccgtgtcccggggatctgctaagcttcagtggttcgtcgaaagaaacatggttattccggagggccgggtgatcgatctggggtgtggacgcggcggctggagctactattgcgccgggctgaaaaaggtgacagaagtcagaggatacaccaaaggcgggcccggacacgaggagcctgtgcccatgtccacgtatggctggaatattgttaagctcatgtctgggaaggacgtgttttacctgcctcccgaaaaatgtgatacccttctgtgcgacatcggagagagctccccgagccctacagtcgaagagtctcggaccattcgcgtgctcaagatggttgagccctggctgaaaaacaatcagttctgtatcaaggtgctgaacccctacatgcctacagtcattgaacacctcgagagacttcagcggaaacatggcggcatgctggtgcgcaatcccctgtccagaaacagcacccacgaaatgtattggatctctaatgggacaggaaacatcgtgtccagcgtcaatatggtttctcggctcctgcttaaccgctttaccatgacgcatagacggcctacaattgagaaggatgtggacctgggcgctgggaccagacacgtgaacgccgaaccggagacccccaatatggacgtcatcggagagcgcattcggagaatcaaggaagagcacagctccacatggcattacgatgacgaaaacccttataaaacgtgggcgtaccacggctcttatgaggtgaaggccaccgggagcgcttccagcatgattaatggagttgtgaaactcctgacaaagccctgggatgtcgtgcctatggttacccaaatggccatgacagacaccacacccttcggccagcagcgcgtgtttaaagaaaaggtcgatacccggacgccgagacctatgcccggcacccgcaaggtgatggagatcacagctgagtggctgtggcggaccctcgggagaaacaaacgccctcggctgtgcacaagagaagagttcatcaagaaagttcgcaccaatgccgccatgggagcggtgtttacggaagagaaccaatgggactccgctcgggccgccgtcgaagatgaggagttctggaagcttgtggacagagaacgcgagctgcataaactcggcaagtgtgggtcttgcgtctacaatatgatgggaaaaagagaaaagaagctgggcgagtttgggaaagctaagggcagccgggccatttggtatatgtggcttggagctcgctacctggagttcgaagccctcggctttctgaacgaggatcactggttctccagagaaaattcttacagcggggtggagggagaaggcctgcataaactcgggtatatcctgcgggacatttccaagatccccggaggcgcgatgtacgccgatgacacagctgggtgggacaccagaattacagaggatgaccttcacaacgaggaaaaaatcacccagcagatggatcctgagcaccggcagctggccaatgctatctttaagctcacgtatcaaaacaaggttgtgaaagtccagcgccccaccccgaagggcacagtgatggacattatctctagaaaagatcagcggggaagcggccaggtggggacctacggactgaatacattcaccaacatggaagcccaacttattcgccagatggagggcgaaggggttctgtccaaggcggacctcgagaatcctcatctgctggagaaaaaggtgacacagtggctcgaaaccaagggagtcgagagactgaaacggatggccatcagcggcgatgactgcgtggttaagcccattgatgaccgcttcgctaacgcccttctggctctcaacgatatggggaaagtgagaaaggacatcccccagtggcaaccttctaaaggctggcacgattggcagcaggtcccgttttgttcccatcacttccacgaactgatcatgaaggacggacggaagcttgtggtcccctgccgccctcaggacgagctgattggcagagcccggatcagccaaggggctggatggtctctccgcgaaacggcctgtctgggcaaagcgtatgcccagatgtgggctctgatgtactttcatagacgggatctccgcctggcctccaatgccatttgcagcgctgtgcccgttcactgggtgcctacatctagaaccacctggtccatccatgcccaccatcagtggatgacaaccgaggacatgcttacagtctggaaccgggtgtggattgaggataatccctggatggaagacaagacgcctgttaccacatgggaggatgtgccctatctggggaaaagagaagaccaatggtgtggaagcctcatcggcctgacctcccgcgcgacatgggctcagaacattcttaccgccatccagcaggtccggagcctgatcgggaatgaggagttcctcgattacatgccgtctatgaagagatttcgcaaagaagaggaaagcgagggcgccatttggtga

SEQ ID NO: 20894 - RNA, 9873 nt, synthetic construct
  misc_feature 1..9873: note = derived and/or modified CDS sequence (opt5) from DENV-3__JQ920483__SS-prME
  source 1..9873: mol_type = other RNA
accagcctgtgcctcatgatgatgctgcccgccacacttgctttccacctgacgtccagagacggcgagcctcggatgatcgtggggaagaacgaacgcggaaaatctctcctgtttaagaccgccagcggcattaatatgtgtacacttatcgcgatggatctgggggagatgtgcgacgataccgtcacatacaaatgtccgctcattaccgaagttgagcccgaagacatcgattgctggtgtaacctgacatccacctgggtgacgtatggaacctgcaatcaggctggcgagcatagacgggacaagcgctctgtggccctggcccctcacgtcgggatgggactcgatacaagaacccaaacatggatgagcgctgagggcgcctggcggcaggtggaaaaagttgagacctgggctttccgccatcccggctttacgattctggcccttttcctggcgcactacatcgggacatccctcacccagaaggtggtcatctttattctgcttatgctggtgacaccttctatgaccatgagatgtgttggagtgggcaaccgggacttcgtcgaagggctcagcggagccacctgggtggatgtggtcctggagcatggcgggtgcgttacaacgatggctaagaataaacccaccctggacatcgagctccagaagacagaagccacccaactggctacacttcgcaaactgtgtattgagggaaagatcaccaacgtgacgacagattccagatgccctacccagggcgaagccattctcccggaggaacagaatcagaactatgtgtgtaaacacacctacgtcgaccggggctgggggaatggatgcggcctgtttgggaagggaagccttgtgacatgcgcgaagttccaatgtctggagtctatcgagggcaaagccgttcagcacgaaaacctcaagtataccgtgattatcacagtccatacgggggatcagcaccaggtgggaaatgagacccaaggcgttacagctgaaatcaccccccaggcctccacagtggaggctattctgcctgaatacggcaccctggggctcgagtgcagcccccgcacgggactggactttaacgagatgatccttctgaccatgaaaaataaggcctggatggtccatagacagtggttctttgacctccctctgccctggacatctggcgccaccacagaaaccccgacgtggaacaaaaaggagcttctggtgacattcaaaaatgctcacgcgaagaagcaagaagtcgtggttctcgggtcccaggagggagccatgcacaccgctctgacaggcgccaccgaaattcagaccagcgggggcacatctatctttgccggacatctgaaatgtcggctcaagatggataaactggagcttaagggcatgtcctatgctatgtgcctgaacgccttcgtgctcaaaaaggaggtcagcgaaacgcagcacgggaccattctgatcaaggtggagtacaaaggagaagacgcgccttgtaagatccccttctccacagaggatggccaagggaaagctcataacggacgcctgattaccgccaatcctatcgttacaaagaaagaggaacccgtgaacattgaggccgaacccccttttggcgagtctaatatcgtcattgggatcggcgacaaggctcttaagatcaactggtacaaaaagggaagctccattggcaaaatgttcgaagccaccgctagaggggcccggagaatggcgatcctcggagatacggcctgggactttggcagcgtggggggagtgctgaattctctgggcaagatggttcaccagattttcgggtccgcttatacagccctctttagcggcgtctcttggatcatgaaaattggaatcggcgtgctgcttacctggattgggctgaacagcaagaatacctccatgtctttcagctgcatcgtgatcggaattatcacactctacctgggcgctgtcgtgcaggccgatatggggtgtgttattaactggaagggaaaagagctgaagtgcggctccgggatctttgtgaccaatgaggtccatacatggacggaacagtataaattccaagcggacagcccgaagcgccttgccaccgctattgccggcgcttgggagaacggagtgtgtggcatccggtctacaaccagaatggaaaatctcctgtggaaacagatcgccaacgagctgaattacattctctgggaaaacaatatcaagctgacaattgttgtgggggatgtcatcggagtgcttgagcagggcaaacgcaccctgacgccccagcctatggagctcaagtattcctggaagacctgggggaaagccaagattgttacagctgaaacccaaaacagctcttttatcatcgacggacccaacacacctgagtgcccctccgcgagccgggcctggaatgtgtgggaagtcgaggattacggcttcggcgtgtttaccacaaacatttggctgaaactgagagaaaagtatacccagctttgtgaccaccgcctcatgtccgctgccgtgaaagacgagcgggccgtccacgctgatatggggtactggatcgagtctcagaagaatggaagctggaagctggaaaaagcctccctgattgaggttaagacgtgcacatggccgaaatctcataccctctggagcaacggcgtgctggaatccgacatgatcattcctaagagccttgcggggcccatctctcagcacaattacagacctggatatcatacccaaacagctggcccctggcacctggggaaactcgagctggatttcaactactgcgagggaaccacggtggtcatcacagaaaattgtggcattcgcggcccttccctgcggaccacaaccgtgagcgggaagcttatccacgagtggtgctgtagatcttgcacactccccccgctgcgctatatgggagaagacggctgttggtacgggatggagattcggcctatcaacgaaaaggaggagaatatggttaaatccctggtgagcgccggatctggcaagaccgataactttacgatgggggtcctctgcctggccattcttttcgaagaggtgatgagaggaaaattcggcaagaaacatatgatcgctggcgccctgtttaccttcgttctcctgctgagcgggcagattacatggcgggacatggcgcacacccttatcatgatcggatccaatgctagcgatcgcatgggcatgggggtgacatatctggccctcattgccacctttaagatccagcccttcctggctctcggatttttcctgagaaagcttacgtctcgggaaaacctgctcctgggcgtcgggctggccatggctacaacccttcaactgcccgaggacattgaacagatggccaatggaatcgcgctcggcctgatggccctcaaactgattacacagtttgagacctaccagctttggaccgctctgatctccctcatgtgtagcaacacaatcttcacgctgaccgtggcctggagaacagctaccctgattcttgccgttatctccctgctccctgtgtgccaatctagctccatgcgcaagacagattggctgccgatgaccgtcgccgctatgggcgtgccccctctccccctgtttattttctctcttaaagacacgctgaagcggagaagctggcctctgaatgagggggtgatggcggtcggactcgtttccatcctggcctctagctttcttcgcaacgatgtgcccatggctggccctctggtggccgggggactcctgattgcctgttatgtcatcacaggcacctccgctgacctcaccgtggaaaaagccgcggatgttacatgggaggaagaggctgaacagaccggggtgagccataacctgatgatcacagtcgacgacgatggaacgatgagaattaaggacgatgagaccgagaatatccttacagtgctgctgaaaaccgccctcctgattgtttctggcatcttcccctactccattccggccacacttctggtgtggcacacctggcagaagcagacgcaacggagcggcgtcctctgggacgtgccttctccccctgaaacccagaaggctgagctggaagagggggtctaccgcatcaaacagcagggaatttttggcaagacacaagtgggggttggagtgcagaaagagggcgtcttccataccatgtggcacgtgacaagaggggccgttctcacccacaacggaaagcggctggaacccaattgggcgaacgtgaaaaaggatcttatctcctatggcggcgggtggaagctgagcgctcagtggcaaaaaggagaggaagtccaggtgatcgccgtggagccgggcaagaatcctaaaaacttccagacaatgcccgggatttttcagacgaccacaggagaaatcggcgccattgctctggacttcaagcctgggacctctggatcccccatcattaatcgcgagggcaaagttgtcggcctctacgggaacggagtggtgaccaagaatggcgggtatgtcagcggaatcgcccaaacaaacgctgagcccgatggccctacgccggaactggaggaagagatgtttaagaaaagaaatcttaccatcatggacctgcatcccgggtccggcaagacacggaaatacctccctgccattgtgcgcgaagcgatcaagagacggctgcgcaccctcattctggcccccacaagagttgtggctgccgagatggaggaagctcttaaaggactgcctatccggtatcagaccacggccacaaagagcgagcacaccggcagagaaattgtcgatctgatgtgccatgccaccttcacaatgcgcctcctgtctcccgtgcgggttcctaactacaatcttatcgtgatggacgaggctcactttaccgatccggcgagcatcgccgctagagggtatatttccacacgcgtcggaatgggcgaagccgccgctatcttcatgaccgccacgccccctgggacagcggacgcttttccccagtctaacgcccctattcaggatgaggagcgggacatccccgaaagaagctggaattccggaaacgagtggattaccgacttcgccggcaagacagtgtggtttgttccgtctatcaaagctgggaacgatattgccaattgtctgcgcaagaacggcaaaaaggtgatccaactcagccggaaaaccttcgacacggaataccagaagaccaagctgaatgattgggactttgtcgtgacaaccgatatctccgagatgggagcgaacttcaaagccgacagagtgattgatcctcgccggtgcctgaagcccgtcatcctcacagacggccccgagagagttattcttgctgggcctatgcccgtgaccgtggcctctgctgcccagcggcgcggaagagtcggccggaatagccagaaagaaaacgatcaatacatcttcacagggcagcctctgaataacgacgaggatcatgctcactggaccgaagccaagatgctgctcgacaatattaacacgccggagggaatcatccccgcgctgtttgaacctgagcgcgagaaatccgccgctattgacggcgaatatagacttaagggggagagccggaaaacattcgtggaactgatgagacgcggcgatctccccgtttggctggcccacaaggtggcttctgagggaatcaagtacaccgaccggaaatggtgctttgatggcgaaagaaataaccagattctggaggagaatatggacgtcgaaatctggaccaaggagggggaaaaaaagaaactccgccctcggtggcttgatgccagaacatattccgaccccctggccctgaaggagttcaaggattttgctgcgggacgcaaaagcattgccctcgacctggtgaccgaaatcggccgggttccgtctcatcttgctcacagaacacgcaacgccctggataatctcgtgatgctgcatacgtccgagcacgggggaagagcctaccggcacgctgtcgaggaactgcctgagaccatggaaacactccttctgctgggcctcatgatcctgcttaccggcggggccatgctgttcctcattagcggaaagggcatcgggaaaacatccattggactgatctgtgtggtcgcgtctagcggcatgctgtggatggccgacgtgcccctccagtggattgcttccgccatcgttcttgagtttttcatgatggtgctgctgattcctgagcccgaaaagcaacgcacccctcaggataaccagctcgcttatgtggtcatcgggatcctgacgcttgccgcgattgttgccgctaatgagatgggactgctcgaaaccacaaaaagagacctgggcatgagcaaggagcccggcgtggtgtctccgacctcctacctggatgtcgacctccatcctgccagcgcttggacactttatgccgtggctaccacggttatcacacccatgctgcggcacaccattgaaaactctacagccaacgtgagcctggcggccatcgctaatcaagccgtcgtgctcatggggctggacaagggatggcccatttccaaaatggatcttggcgtccctctgctcgctctggggtgctactctcaggtgaacccgctgaccctcaccgccgccgttcttctgctggtgacacattacgcgatcatcggacccggcctccaggctaaggccacgcgcgaggctcagaaaagaaccgccgccgggattatgaagaatcctacagtcgacggaatcatgaccattgatctggaccccgtgatctatgatagcaaatttgagaagcaacttggccaggttatgctgctcgtgctgtgtgctgtccagctgctccttatgcggacatcctgggccttctgcgaagcgctgaccctggccacgggccctattacaaccctctgggaggggtctcccggaaagttttggaacaccacaatcgctgtgagcatggccaatatcttcagaggctcctacctggctggggccggacttgcgtttagcattatgaaatctgtgggcaccgggaagcgcggaacaggctcccagggcgaaacgctgggggagaaatggaagaaaaagctcaaccaactgagccggaaagaattcgacctgtataagaagtccggaatcaccgaggttgatagaacagaggccaaagaaggcctcaagcgcggggagattacccaccatgctgtctctcggggaagcgccaaacttcagtggttcgtggaaagaaatatggtgatccctgagggccgggtcattgacctggggtgtggacgcggcggctggtcctactattgcgctgggctgaagaaagttacagaagtgagaggatacaccaagggcgggccgggacacgaggagcccgtgcctatgtctacgtatggctggaacatcgtcaagctcatgagcgggaaagatgtgttttacctgccccctgaaaagtgtgacacccttctgtgcgatattggagagtccagcccctctccgacagttgaagagtcccggaccatccgcgtgctcaaaatggtcgagccttggctgaagaataaccagttctgtatcaaagtgctgaatccctacatgcccacagttattgaacacctcgagagacttcagcggaagcatggcggcatgctggtgcgcaaccctctgagcagaaattctacccacgaaatgtattggatctccaacgggacaggaaatattgtcagctctgtgaacatggtgagccggctcctgcttaaccgctttaccatgacgcatagacggcccacaatcgagaaggacgtcgatctgggcgccgggaccagacacgttaatgctgaacctgagaccccgaacatggacgtgattggagagcgcatccggagaatcaaagaagagcactcctctacatggcattacgacgatgaaaatccctataagacgtgggcctaccacggcagctatgaggtgaaagcgaccgggtccgccagctccatgattaacggagtcgtgaagctcctgacaaaaccttgggacgttgtgcccatggtcacccaaatggctatgacagataccacacctttcggccagcagcgcgtgtttaaggaaaaggttgacacccggacgcccagaccgatgcctggcacccgcaaagtgatggagatcacagccgagtggctgtggcggaccctcgggagaaataagcgcccccggctgtgcacaagagaagagttcattaaaaaggtccgcaccaacgctgccatgggagccgtgtttacggaagagaatcaatgggattctgcgcgggctgccgttgaagacgaggagttctggaaacttgtggatagagaacgcgagctgcataagctcggcaaatgtgggagctgcgtctacaacatgatgggaaagagagaaaagaaactgggcgagtttgggaaggccaaaggctcccgggctatctggtatatgtggcttggagcccgctacctggagttcgaagctctcggctttctgaatgaggaccactggttctctagagaaaacagccattccggggtggagggagaaggcctgcacaagctcgggtacattctgcgggatatctctaaaatccctggaggcgccatgtatgcggacgatacagccgggtgggacaccagaattacagaggacgatcttcacaatgaggaaaagatcacccagcagatggaccccgagcatcggcagctggctaacgccatttttaagctcacgtaccaaaataaagtcgtgaaggttcagcgccctacccccaaaggcacagtgatggatatcattagcagaaaggaccagcggggatccggccaggtcgggacctatggactgaacacattcaccaatatggaagctcaacttatccgccagatggagggcgaaggggtgctgagcaaagccgatctcgagaacccgcacctgctggagagaaaggtgacacagtggctcgaaaccaagggagttgagcggctgaaacgcatggcgatctctggcgacgattgcgtggtcaagcctattgacgatagattcgccaacgctcttctggccctcaatgacatggggaaagtgcggaaggatatcccccagtggcaaccctccaaaggctggcatgactggcagcaggttcctttttgtagccaccacttccatgaactgattatgaaggatggacgcaagcttgtggtcccgtgcagaccccaggacgagctgatcggccgggctcgcatttctcaaggggccggatggtccctcagagaaacggcttgtctgggcaaagcctacgcgcagatgtgggccctgatgtattttcaccggcgcgacctcagactggctagcaacgccatctgctctgccgtgcctgtccattgggtgcccacatcccggaccacctggagcattcacgctcatcaccagtggatgacaaccgaggatatgcttacagtttggaatagagtgtggatcgaggacaacccttggatggaagataagacgcccgtcaccacatgggaggacgtgccttacctggggaaacgcgaagatcaatggtgtggatccctcatcggcctgaccagccgggccacatgggcgcagaatattcttaccgctatccagcaggttagatctctgattgggaacgaggagttcctcgactatatgcccagcatgaagcgctttcggaaagaagaggaatccgagggcgccatctggtga

SEQ ID NO: 20895 - RNA, 9873 nt, synthetic construct
  misc_feature 1..9873: note = derived and/or modified CDS sequence (opt5) from DENV-3__JQ920482__SS-prME
  source 1..9873: mol_type = other RNA
accagcctgtgcctcatgatgatgctgcccgccacacttgctttccacctgacgtccagagacggcgagcctcggatgatcgtggggaagaacgaacgcggaaaatctctcctgtttaagaccgccagcggcattaatatgtgtacacttatcgcgatggatctgggggagatgtgcgacgataccgtcacatacaaatgtccgctcattaccgaagttgagcccgaagacatcgattgctggtgtaacctgacatccacctgggtgacgtatggaacctgcaatcaggctggcgagcatagacgggacaagcgctctgtggccctggcccctcacgtcgggatgggactcgatacaagaacccaaacatggatgagcgctgagggcgcctggcggcaggtggaaaaagttgagacctgggctttccgccatcccggctttacgattctggcccttttcctggcgcactacatcgggacatccctcacccagaaggtggtcatctttattctgcttatgctggtgacaccttctatgaccatgagatgtgttggagtgggcaaccgggacttcgtcgaagggctcagcggagccacctgggtggatgtggtcctggagcatggcgggtgcgttacaacgatggctaagaataaacccaccctggacatcgagctccagaagacagaagccacccaactggctacacttcgcaaactgtgtattgagggaaagatcaccaacgtgacgacagattccagatgccctacccagggcgaagccattctcccggaggaacaggaccagaattatgtgtgtaaacacacctacgtcgatcggggctgggggaacggatgcggcctgtttgggaagggaagccttgtgacatgcgcgaagttccaatgtctggagtctatcgagggcaaagccgttcagcacgaaaatctcaagtataccgtgattatcacagtccatacgggggaccagcaccaggtgggaaacgagacccaaggcgttacagctgaaatcaccccccaggcctccacagtggaggctattctgcctgaatacggcaccctggggctcgagtgcagcccccgcacgggactggactttaatgagatgatccttctgaccatgaaaaacaaggcctggatggtccatagacagtggttctttgatctccctctgccctggacatctggcgccaccacagaaaccccgacgtggaataaaaaggagcttctggtgacattcaaaaacgctcacgcgaagaagcaagaagtcgtggttctcgggtcccaggagggagccatgcacaccgctctgacaggcgccaccgaaattcagaccagcgggggcacatctatctttgccggacatctgaaatgtcggctcaagatggacaaactggagcttaagggcatgtcctatgctatgtgcctgaatgccttcgtgctcaaaaaggaggtcagcgaaacgcagcacgggaccattctgatcaaggtggagtacaaaggagaagatgcgccttgtaagatccccttctccacagaggacggccaagggaaagctcataacggacgcctgattaccgccaaccctatcgttacaaagaaagaggaacccgtgaatattgaggccgaacccccttttggcgagtctaacatcgtcattgggatcggcgataaggctcttaagatcaattggtacaaaaagggaagctccattggcaaaatgttcgaagccaccgctagaggggcccggagaatggcgatcctcggagacacggcctgggattttggcagcgtggggggagtgctgaactctctgggcaagatggttcaccagattttcgggtccgcttatacagccctctttagcggcgtctcttggatcatgaaaattggaatcggcgtgctgcttacctggattgggctgaatagcaagaacacctccatgtctttcagctgcatcgtgatcggaattatcacactctacctgggcgctgtcgtgcaggccgacatggggtgtgttattaattggaagggaaaagagctgaagtgcggctccgggatctttgtgaccaacgaggtccatacatggacggaacagtataaattccaagcggatagcccgaagcgccttgccaccgctattgccggcgcttgggagaatggagtgtgtggcatccggtctacaaccagaatggaaaacctcctgtggaaacagatcgccaatgagctgaactacattctctgggaaaataacatcaagctgacaattgttgtgggggacgtcatcggagtgcttgagcagggcaaacgcaccctgacgccccagcctatggagctcaagtattcctggaagacctgggggaaagccaagattgttacagctgaaacccaaaatagctcttttatcatcgatggacccaacacacctgagtgcccctccgcgagccgggcctggaacgtgtgggaagtcgaggactacggcttcggcgtgtttaccacaaatatttggctgaaactgagagaaaagtatacccagctttgtgaccaccgcctcatgtccgctgccgtgaaagatgagcgggccgtccacgctgacatggggtactggatcgagtctcagaagaacggaagctggaagctggaaaaagcctccctgattgaggttaagacgtgcacatggccgaaatctcataccctctggagcaatggcgtgctggaatccgatatgatcattcctaagagccttgcggggcccatctctcagcacaactacagacctggatatcatacccaaacagctggcccctggcacctggggaaactcgagctggacttcaattactgcgagggaaccacggtggtcatcacagaaaactgtggcattcgcggcccttccctgcggaccacaaccgtgagcgggaagcttatccacgagtggtgctgtagatcttgcacactccccccgctgcgctatatgggagaagatggctgttggtacgggatggagattcggcctatcaatgaaaaggaggagaacatggttaaatccctggtgagcgccggatctggcaagaccgacaattttacgatgggggtcctctgcctggccattcttttcgaagaggtgatgagaggaaaattcggcaagaaacatatgatcgctggcgccctgtttaccttcgttctcctgctgagcgggcagattacatggcgggatatggcgcacacccttatcatgatcggatccaacgctagcgaccgcatgggcatgggggtgacatatctggccctcattgccacctttaagatccagcccttcctggctctcggatttttcctgagaaagcttacgtctcgggaaaatctgctcctgggcgtcgggctggccatggctacaacccttcaactgcccgaggatattgaacagatggccaacggaatcgcgctcggcctgatggccctcaaactgattacacagtttgagacctaccagctttggaccgctctgatctccctcatgtgtagcaatacaatcttcacgctgaccgtggcctggagaacagctaccctgattcttgccgttatctccctgctccctgtgtgccaatctagctccatgcgcaagacagactggctgccgatgaccgtcgccgctatgggcgtgccccctctccccctgtttattttctctcttaaagatacgctgaagcggagaagctggcctctgaacgagggggtgatggcggtcggactcgtttccatcctggcctctagctttcttcgcaatgacgtgcccatggctggccctctggtggccgggggactcctgattgcctgttatgtcatcacaggcacctccgctgatctcaccgtggaaaaagccgcggacgttacatgggaggaagaggctgaacagaccggggtgagccataacctgatgatcacagtcgacgatgacggaacgatgagaattaaggatgacgagaccgagaacatccttacagtgctgctgaaaaccgccctcctgattgtttctggcatcttcccctactccattccggccacacttctggtgtggcacacctggcagaagcagacgcaacggagcggcgtcctctgggatgtgccttctccccctgaaacccagaaggctgagctggaagagggggtctaccgcatcaaacagcagggaatttttggcaagacacaagtgggggttggagtgcagaaagagggcgtcttccataccatgtggcacgtgacaagaggggccgttctcacccacaatggaaagcggctggaacccaactgggcgaatgtgaaaaaggaccttatctcctatggcggcgggtggaagctgagcgctcagtggcaaaaaggagaggaagtccaggtgatcgccgtggagccgggcaagaaccctaaaaatttccagacaatgcccgggatttttcagacgaccacaggagaaatcggcgccattgctctggatttcaagcctgggacctctggatcccccatcattaaccgcgagggcaaagttgtcggcctctacgggaatggagtggtgaccaagaacggcgggtatgtcagcggaatcgcccaaacaaatgctgagcccgacggccctacgccggaactggaggaagagatgtttaagaaaagaaaccttaccatcatggatctgcatcccgggtccggcaagacacggaaatacctccctgccattgtgcgcgaagcgatcaagagacggctgcgcaccctcattctggcccccacaagagttgtggctgccgagatggaggaagctcttaaaggactgcctatccggtatcagaccacggccacaaagagcgagcacaccggcagagaaattgtcgacctgatgtgccatgccaccttcacaatgcgcctcctgtctcccgtgcgggttcctaattacaaccttatcgtgatggatgaggctcactttaccgacccggcgagcatcgccgctagagggtatatttccacacgcgtcggaatgggcgaagccgccgctatcttcatgaccgccacgccccctgggacagcggatgcttttccccagtctaatgcccctattcaggacgaggagcgggacatccccgaaagaagctggaactccggaaatgagtggattaccgatttcgccggcaagacagtgtggtttgttccgtctatcaaagctgggaacgacattgccaactgtctgcgcaagaatggcaaaaaggtgatccaactcagccggaaaaccttcgatacggaataccagaagaccaagctgaacgactgggattttgtcgtgacaaccgacatctccgagatgggagcgaatttcaaagccgatagagtgattgaccctcgccggtgcctgaagcccgtcatcctcacagatggccccgagagagttattcttgctgggcctatgcccgtgaccgtggcctctgctgcccagcggcgcggaagagtcggccggaacagccagaaagaaaatgaccaatacatcttcacagggcagcctctgaacaatgatgaggaccatgctcactggaccgaagccaagatgctgctcgacaacattaatacgccggagggaatcatccccgcgctgtttgaacctgagcgcgagaaatccgccgctattgatggcgaatatagacttaagggggagagccggaaaacattcgtggaactgatgagacgcggcgacctccccgtttggctggcccacaaggtggcttctgagggaatcaagtacaccgatcggaaatggtgctttgacggcgaaagaaacaatcagattctggaggagaacatggatgtcgaaatctggaccaaggagggggaaaaaaagaaactccgccctcggtggcttgacgccagaacatattccgatcccctggccctgaaggagttcaaggactttgctgcgggacgcaaaagcattgccctcgatctggtgaccgaaatcggccgggttccgtctcatcttgctcacagaacacgcaatgccctggacaacctcgtgatgctgcatacgtccgagcacgggggaagagcctaccggcacgctgtcgaggaactgcctgagaccatggaaacactccttctgctgggcctcatgatcctgcttaccggcggggccatgctgttcctcattagcggaaagggcatcgggaaaacatccattggactgatctgtgtggtcgcgtctagcggcatgctgtggatggccgatgtgcccctccagtggattgcttccgccatcgttcttgagtttttcatgatggtgctgctgattcctgagcccgaaaagcaacgcacccctcaggacaatcagctcgcttatgtggtcatcgggatcctgacgcttgccgcgattgttgccgctaacgagatgggactgctcgaaaccacaaaaagagatctgggcatgagcaaggagcccggcgtggtgtctccgacctcctacctggacgtcgacctccatcctgccagcgcttggacactttatgccgtggctaccacggttatcacacccatgctgcggcacaccattgaaaattctacagccaacgtgagcctggcggccatcgctaaccaagccgtcgtgctcatggggctggataagggatggcccatttccaaaatggaccttggcgtccctctgctcgctctggggtgctactctcaggtgaatccgctgaccctcaccgccgccgttcttctgctggtgacacattacgcgatcatcggacccggcctccaggctaaggccacgcgcgaggctcagaaaagaaccgccgccgggattatgaagaaccctacagtcgatggaatcatgaccattgacctggatcccgtgatctatgacagcaaatttgagaagcaacttggccaggttatgctgctcgtgctgtgtgctgtccagctgctccttatgcggacatcctgggccttctgcgaagcgctgaccctggccacgggccctattacaaccctctgggaggggtctcccggaaagttttggaataccacaatcgctgtgagcatggccaacatcttcagaggctcctacctggctggggccggacttgcgtttagcattatgaaatctgtgggcaccgggaagcgcggaacaggctcccagggcgaaacgctgggggagaaatggaagaaaaagctcaatcaactgagccggaaagaattcgatctgtataagaagtccggaatcaccgaggttgacagaacagaggccaaagaaggcctcaagcgcggggagattacccaccatgctgtctctcggggaagcgccaaacttcagtggttcgtggaaagaaacatggtgatccctgagggccgggtcattgatctggggtgtggacgcggcggctggtcctactattgcgctgggctgaagaaagttacagaagtgagaggatacaccaagggcgggccgggacacgaggagcccgtgcctatgtctacgtatggctggaatatcgtcaagctcatgagcgggaaagacgtgttttacctgccccctgaaaagtgtgatacccttctgtgcgacattggagagtccagcccctctccgacagttgaagagtcccggaccatccgcgtgctcaaaatggtcgagccttggctgaagaacaatcagttctgtatcaaagtgctgaacccctacatgcccacagttattgaacacctcgagagacttcagcggaagcatggcggcatgctggtgcgcaatcctctgagcagaaactctacccacgaaatgtattggatctccaatgggacaggaaacattgtcagctctgtgaatatggtgagccggctcctgcttaaccgctttaccatgacgcatagacggcccacaatcgagaaggatgtcgacctgggcgccgggaccagacacgttaacgctgaacctgagaccccgaatatggacgtgattggagagcgcatccggagaatcaaagaagagcactcctctacatggcattacgatgacgaaaacccctataagacgtgggcctaccacggcagctatgaggtgaaagcgaccgggtccgccagctccatgattaatggagtcgtgaagctcctgacaaaaccttgggatgttgtgcccatggtcacccaaatggctatgacagacaccacacctttcggccagcagcgcgtgtttaaggaaaaggttgatacccggacgcccagaccgatgcctggcacccgcaaagtgatggagatcacagccgagtggctgtggcggaccctcgggagaaacaagcgcccccggctgtgcacaagagaagagttcattaaaaaggtccgcaccaatgctgccatgggagccgtgtttacggaagagaaccaatgggactctgcgcgggctgccgttgaagatgaggagttctggaaacttgtggacagagaacgcgagctgcataagctcggcaaatgtgggagctgcgtctacaatatgatgggaaagagagaaaagaaactgggcgagtttgggaaggccaaaggctcccgggctatctggtatatgtggcttggagcccgctacctggagttcgaagctctcggctttctgaacgaggatcactggttctctagagaaaatagccattccggggtggagggagaaggcctgcacaagctcgggtacattctgcgggacatctctaaaatccctggaggcgccatgtatgcggatgacacagccgggtgggacaccagaattacagaggatgaccttcacaacgaggaaaagatcacccagcagatggatcccgagcatcggcagctggctaatgccatttttaagctcacgtaccaaaacaaagtcgtgaaggttcagcgccctacccccaaaggcacagtgatggacatcattagcagaaaggatcagcggggatccggccaggtcgggacctatggactgaatacattcaccaacatggaagctcaacttatccgccagatggagggcgaaggggtgctgagcaaagccgacctcgagaatccgcacctgctggagaagaaggtgacacagtggctcgaaaccaaaggagttgagagactgaagcggatggcgatctctggcgatgactgcgtggtcaaacctattgatgaccgcttcgccaacgctcttctggccctcaacgatatggggaaggtgagaaaagacatcccccagtggcaaccctccaagggctggcatgattggcagcaggttcctttttgtagccaccacttccatgaactgattatgaaggacggacggaaacttgtggtcccgtgccgcccccaggacgagctgatcggcagagctcggatttctcaaggggccggatggtccctccgcgaaacggcttgtctgggcaaggcctacgcgcagatgtgggccctgatgtattttcacagacgggatctccgcctggctagcaatgccatctgctctgccgtgcctgtccattgggtgcccacatccagaaccacctggagcattcacgctcatcaccagtggatgacaaccgaggacatgcttacagtttggaaccgggtgtggatcgaggataatccttggatggaagacaaaacgcccgtcaccacatgggaggatgtgccttacctggggaagagagaagaccaatggtgtggatccctcatcggcctgaccagccgcgccacatgggcgcagaacattcttaccgctatccagcaggttcggtctctgattgggaatgaggagttcctcgattatatgcccagcatgaaaagatttcgcaaggaagaggaatccgagggcgccatctggtga

SEQ ID NO: 20896 - RNA, 9873 nt, synthetic construct
  misc_feature 1..9873: note = derived and/or modified CDS sequence (opt5) from DENV-3__JQ920484__SS-prME
  source 1..9873: mol_type = other RNA
accagcctgtgcctcatgatgatgctgcccgccacacttgctttccacctgacgtccagagacggcgagcctcggatgatcgtggggaagaacgaacgcggaaaatctctcctgtttaagaccgccagcggcattaatatgtgtacacttatcgcgatggatctgggggagatgtgcgacgataccgtcacatacaaatgtccgctcattaccgaagttgagcccgaagacatcgattgctggtgtaacctgacatccacctgggtgacgtatggaacctgcaatcaggctggcgagcatagacgggacaagcgctctgtggccctggcccctcacgtcgggatgggactcgatacaagaacccaaacatggatgagcgctgagggcgcctggcggcaggtggaaaaagttgagacctgggctttccgccatcccggctttacgattctggcccttttcctggcgcactacatcgggacatccctcacccagaaggtggtcatctttattctgcttatgctggtgacaccttctatgaccatgagatgtgttggagtgggcaaccgggacttcgtcgaagggctcagcggagccacctgggtggatgtggtcctggagcatggcgggtgcgttacaacgatggctaagaataaacccaccctggacatcgagctccagaagacagaagccacccaactggctacacttcgcaaactgtgtattgagggaaagatcaccaacgtgacgacagattccagatgccctacccagggcgaagccattctcccggaggaacaggaccagaattatgtgtgtaaacacacctacgtcgatcggggctgggggaacggatgcggcctgtttgggaagggaagccttgtgacatgcgcgaagttccaatgtctggagtctatcgagggcaaagccgttcagcacgaaaatctcaagtataccgtgattatcacagtccatacgggggaccagcaccaggtgggaaacgagacccaaggcgttacagctgaaatcaccccccaggcctccacagtggaggctattctgcctgaatacggcaccctggggctcgagtgcagcccccgcacgggactggactttaatgagatgatccttctgaccatgaaaaacaaggcctggatggtccatagacagtggttctttgatctccctctgccctggacatctggcgccaccacagaaaccccgacgtggaataaaaaggagcttctggtgacattcaaaaacgctcacgcgaagaagcaagaagtcgtggttctcgggtcccaggagggagccatgcacaccgctctgacaggcgccaccgaaattcagaccagcgggggcacatctatctttgccggacatctgaaatgtcggctcaagatggacaaactggagcttaagggcatgtcctatgctatgtgcctgaatgccttcgtgctcaaaaaggaggtcagcgaaacgcagcacgggaccattctgatcaaggtggagtacaaaggagaagatgcgccttgtaagatccccttctccacagaggacggccaagggaaagctcataacggacgcctgattaccgccaaccctatcgttacaaagaaagaggaacccgtgaatattgaggccgaacccccttttggcgagtctaacatcgtcattgggatcggcgataaggctcttaagatcaattggtacaaaaagggaagctccattggcaaaatgttcgaagccaccgctagaggggcccggagaatggcgatcctcggagacacggcctgggattttggcagcgtggggggagtgctgaactctctgggcaagatggttcaccagattttcgggtccgcttatacagccctctttagcggcgtctcttggatcatgaaaattggaatcggcgtgctgcttacctggattgggctgaatagcaagaacacctccatgtctttcagctgcatcgtgatcggaattatcacactctacctgggcgctgtcgtgcaggccgacatggggtgtgttattaattggaagggaaaagagctgaagtgcggctccgggatctttgtgaccaacgaggtccatacatggacggaacagtataaattccaagcggatagcccgaagcgccttgccaccgctattgccggcgcttgggagaatggagtgtgtggcatccggtctacaaccagaatggaaaacctcctgtggaaacagatcgccaatgagctgaactacattctctgggaaaataacatcaagctgacaattgttgtgggggacgccatcggagtccttgagcagggcaaacgcaccctgacgccccagcctatggagctcaagtattcctggaagacctgggggaaagctaagattgtgacagcggaaacccaaaatagctcttttatcatcgatggacccaacacacctgagtgcccctccgccagccgggcttggaacgtttgggaagtggaggactacggcttcggcgtctttaccacaaatatttggctgaaactgagagaaaagtatacccagctttgtgaccaccgcctcatgtccgccgccgtgaaagatgagcgggctgtgcacgccgacatggggtactggatcgagtctcagaagaacggaagctggaagctggaaaaagcgtccctgattgaggtcaagacgtgcacatggccgaaatctcataccctctggagcaatggcgttctggaatccgatatgatcattcctaagagccttgctgggcccatctctcagcacaactacagacctggatatcatacccaaacagccggcccctggcacctggggaaactcgagctggacttcaattactgcgagggaaccacggtggtgatcacagaaaactgtggcattcgcggcccttccctgcggaccacaaccgtcagcgggaagcttatccacgagtggtgctgtagatcttgcacactccccccgctgcgctatatgggagaagatggctgttggtacgggatggagattcggcctatcaatgaaaaggaggagaacatggtgaaatccctggttagcgccggatctggcaagaccgacaattttacgatgggggtgctctgcctggctattcttttcgaagaggtcatgagaggaaaattcggcaagaaacatatgatcgccggcgcgctgtttaccttcgtgctcctgctgagcgggcagattacatggcgggatatggctcacacccttatcatgatcggatccaacgccagcgaccgcatgggcatgggggttacatatctggccctcattgctacctttaagatccagcccttcctggccctcggatttttcctgagaaagcttacgtctcgggaaaatctgctcctgggcgtggggctggctatggccacaacccttcaactgcccgaggatattgaacagatggcgaacggaatcgccctcggcctgatggctctcaaactgattacacagtttgagacctaccagctttggaccgccctgatctccctcatgtgtagcaatacaatcttcacgctgaccgtcgcttggagaacagccaccctgattcttgccgtgatctccctgctccctgtttgccaatctagctccatgcgcaagacagactggctgccgatgaccgtggctgcgatgggcgtcccccctctccccctgtttattttctctcttaaagatacgctgaagcggagaagctggcctctgaacgagggggtgatggccgtgggactcgtctccatcctggcttctagctttcttcgcaatgacgttcccatggccggccctctggtggccgggggactcctgattgcttgttatgtgatcacaggcacctccgccgatctcaccgtcgaaaaagcggctgacgtgacatgggaggaagaggccgaacagaccggggttagccataacctgatgatcacagtggacgatgacggaacgatgagaattaaggatgacgagaccgagaacatccttacagtcctgctgaaaaccgccctcctgattgtgtctggcatcttcccctactccattccggctacacttctggtttggcacacctggcagaagcagacgcaacggagcggcgtgctctgggatgtcccttctccccctgaaacccagaaggccgagctggaagagggggtgtaccgcatcaaacagcagggaatttttggcaagacacaagtcggggtgggagttcagaaagagggcgtgttccataccatgtggcacgtcacaagaggggcggtgctcacctataatggaaagcggctggaacccaactgggctaatgttaaaaaggaccttatctcctacggcggcgggtggaagctgagcgcccagtggcaaaaaggagaggaagtgcaggtcatcgccgtggagccgggcaagaaccctaaaaatttccagacaatgcccgggatttttcagacgaccacaggagaaatcggcgctattgccctggatttcaagcctgggacctctggatcccccatcattaaccgcgagggcaaagtggttggcctctatgggaatggagtcgtgaccaagaacggcgggtacgtgagcggaatcgctcaaacaaatgccgagcccgacggccctacgccggaactggaggaagagatgtttaagaaaagaaaccttaccatcatggatctgcaccccgggtccggcaagacacggaaatatctccctgcgattgtccgcgaagccatcaagagacggctgcgcaccctcattctggctcccacaagagtggttgccgctgagatggaggaagcccttaaaggactgcctatccggtaccagaccacggccacaaagagcgagcataccggcagagaaattgtggacctgatgtgccacgctaccttcacaatgcgcctcctgtctcccgtccgggtgcctaattataaccttatcgttatggatgaggcgcattttaccgacccggccagcatcgctgccagagggtacatttccacacgcgtgggaatgggcgaagccgctgccatcttcatgaccgcgacgccccctgggacagctgatgcctttccccagtctaatgcccctattcaggacgaggagcgggacatccccgaaagaagctggaactccggaaatgagtggattaccgatttcgctggcaagacagtctggtttgtgccgtctatcaaagccgggaacgacattgcgaactgtctgcgcaagaatggcaaaaaggttatccaactcagccggaaaaccttcgatacggaataccagaagaccaagctgaacgactgggattttgtggtcacaaccgacatctccgagatgggagccaatttcaaagctgatagagtgattgaccctcgccggtgcctgaagcccgtgatcctcacagatggccccgagagagtcattcttgccgggcctatgcccgttaccgtggcttctgccgctcagcggcgcggaagagtgggccggaacagccagaaagaaaatgaccaatatatcttcacagggcagcctctgaacaatgatgaggaccacgcccattggaccgaagcgaagatgctgctcgacaacattaatacgccggagggaatcatccccgccctgtttgaacctgagcgcgagaaatccgctgccattgatggcgaatacagacttaagggggagagccggaaaacattcgtcgaactgatgagacgcggcgacctccccgtgtggctggctcacaaggttgcctctgagggaatcaagtataccgatcggaaatggtgctttgacggcgaaagaaacaatcagattctggaggagaacatggatgtggaaatctggaccaaggagggggaaaaaaagaaactccgccctcggtggcttgacgccagaacatactccgatcccctggctctgaaggagttcaaggactttgcggccggacgcaaaagcattgctctcgatctggtcaccgaaatcggccgggtgccgtctcaccttgcccatagaacacgcaatgccctggacaacctcgttatgctgcacacgtccgagcatgggggaagagcttatcggcacgccgtggaggaactgcctgagaccatggaaacactccttctgctgggcctcatgatcctgcttaccggcggggcgatgctgttcctcattagcggaaagggcatcgggaaaacatccattggactgatctgtgtcgtggcctctagcggcatgctgtggatggctgatgtccccctccagtggattgcctccgctatcgtgcttgagtttttcatgatggttctgctgattcctgagcccgaaaagcaacgcacccctcaggacaatcagctcgcctacgtggtgatcgggatcctgacgcttgcggccattgtcgctgccaacgagatgggactgctcgaaaccacaaaaagagatctgggcatgagcaaggagcccggcgttgtgtctccgacctcctatctggacgtggacctccaccctgctagcgcctggacactttacgctgtcgccaccacggtgatcacacccatgctgcggcataccattgaaaattctacagcgaacgttagcctggccgctatcgccaaccaagctgtggtcctcatggggctggataagggatggcccatttccaaaatggaccttggcgtgcctctgctcgccctggggtgctactctcaggtcaatccgctgaccctcaccgccgcggtgcttctgctggttacacactatgctatcatcggacccggcctccaggccaaggctacgcgcgaggcccagaaaagaaccgccgctgggattatgaagaaccctacagtggatggaatcatgaccattgacctggatcccgtcatctacgacagcaaatttgagaagcaacttggccaggtgatgctgctcgttctgtgtgccgtgcagctgctccttatgcggacatcctgggcgttctgcgaagccctgaccctggctacgggccctattacaaccctctgggaggggtctcccggaaagttttggaataccacaatcgccgtcagcatggctaacatcttcagaggctcctatctggccggggcgggacttgcctttagcattatgaaatctgtgggcaccgggaagcgcggaacaggctcccagggcgaaacgctgggggagaaatggaagaaaaagctcaatcaactgagccggaaagaattcgatctgtacaagaagtccggaatcaccgaggtggacagaacagaggctaaagaaggcctcaagcgcggggagattacccatcacgccgtttctcggggaagcgctaaacttcagtggttcgtcgaaagaaacatggtgatccctgagggccgggtgattgatctggggtgtggacgcggcggctggtcctattactgcgccgggctgaagaaagtcacagaagttagaggatataccaagggcgggccgggacatgaggagcccgtgcctatgtctacgtacggctggaatatcgtgaagctcatgagcgggaaagacgtcttttacctgccccctgaaaagtgtgatacccttctgtgcgacattggagagtccagcccctctccgacagtggaagagtcccggaccatccgcgttctcaaaatggtggagccttggctgaagaacaatcagttctgtatcaaagtcctgaacccctatatgcccacagtgattgaacacctcgagagacttcagcggaagcacggcggcatgctggttcgcaatcctctgagcagaaactctacccatgaaatgtactggatctccaatgggacaggaaacattgtgagctctgtcaatatggtgagccggctcctgcttaaccgctttaccatgacgcacagacggcccacaatcgagaaggatgtggacctgggcgctgggaccagacatgtcaacgccgaacctgagaccccgaatatggacgttattggagagcgcatccggagaatcaaagaagagcactcctctacatggcactatgatgacgaaaacccctacaagacgtgggcgtatcatggcagctacgaggtgaaagccaccgggtccgctagctccatgattaatggagtggtcaagctcctgacaaaaccttgggatgtggttcccatggtgacccaaatggccatgacagacaccacacctttcggccagcagcgcgtctttaaggaaaaggtggatacccggacgcccagaccgatgcctggcacccgcaaagttatggagatcacagctgagtggctgtggcggaccctcgggagaaacaagcgcccccggctgtgcacaagagaagagttcattaaaaaggtgcgcaccaatgccgccatgggagcggtctttacggaagagaaccaatgggactctgctcgggccgccgtggaagatgaggagttctggaaacttgttgacagagaacgcgagctgcacaagctcggcaaatgtgggagctgcgtgtataatatgatgggaaagagagaaaagaaactgggcgagtttgggaaggctaaaggctcccgggccatctggtacatgtggcttggagctcgctacctggagttcgaagccctcggctttctgaacgaggatcattggttctctagagaaaatagccactccggggtcgagggagaaggcctgcataagctcgggtatattctgcgggacatctctaaaatccctggaggcgcgatgtacgccgatgacacagctgggtgggacaccagaattacagaggatgaccttcacaacgaggaaaagatcacccagcagatggatcccgagcaccggcagctggccaatgctatttttaagctcacgtatcaaaacaaagtggtcaaggtgcagcgccctacccccaaaggcacagttatggacatcattagcagaaaggatcagcggggatccggccaggtggggacctacggactgaatacattcaccaacatggaagcccaacttatccgccagatggagggcgaaggggtcctgagcaaagcggacctcgagaatccgcatctgctggagaagaaggtgacacagtggctcgaaaccaaaggagtggagagactgaagcggatggccatctctggcgatgactgcgttgtgaaacctattgatgaccgcttcgctaacgcccttctggctctcaacgatatggggaaggtcagaaaagacatcccccagtggcaaccctccaagggctggcacgattggcagcaggtgcctttttgtagccatcacttccacgaactgattatgaaggacggacggaaacttgttgtgccgtgccgcccccaggacgagctgatcggcagagcccggatttctcaaggggctggatggtccctccgcgaaacggcctgtctgggcaaggcgtatgcccagatgtgggctctgatgtactttcatagacgggatctccgcctggccagcaatgccatctgctctgctgtccctgtgcactgggtccccacatccagaaccacctggagcattcatgcccaccatcagtggatgacaaccgaggacatgcttacagtgtggaaccgggtttggatcgaggataatccttggatggaagacaaaacgcccgtgaccacatgggaggatgtcccttatctggggaagagagaagaccaatggtgtggatccctcatcggcctgaccagccgcgcgacatgggctcagaacattcttaccgccatccagcaggtgcggtctctgattgggaatgaggagttcctcgattacatgcccagcatgaaaagatttcgcaaggaagaggaatccgagggcgccatctggtga

SEQ ID NO: 20897 - RNA, 9873 nt, synthetic construct
  misc_feature 1..9873: note = derived and/or modified CDS sequence (opt5) from DENV-3__JQ920486__SS-prME
  source 1..9873: mol_type = other RNA
accagcctgtgcctcatgatgatgctgcccgccacacttgctttccacctgacgtccagagacggcgagcctcggatgatcgtggggaagaacgaacgcggaaaatctctcctgtttaagaccgccagcggcattaatatgtgtacacttatcgcgatggatctgggggagatgtgcgacgataccgtcacatacaaatgtccgctcattaccgaagttgagcccgaagacatcgattgctggtgtaacctgacatccacctgggtgacgtatggaacctgcaatcaggctggcgagcatagacgggacaagcgctctgtggccctggcccctcacgtcgggatgggactcgatacaagaacccaaacatggatgagcgctgagggcgcctggcggcaggtggaaaaagttgagacctgggctttccgccatcccggctttacgattctggcccttttcctggcgcactacatcgggacatccctcacccagaaggtggtcatctttattctgcttatgctggtgacaccttctatgaccatgagatgtgttggagtgggcaaccgggacttcgtcgaagggctcagcggagccacctgggtggatgtggtcctggagcatggcgggtgcgttacaacgatggctaagaataaacccaccctggacatcgagctccagaagacagaagccacccaactggctacacttcgcaaactgtgtattgagggaaagatcaccaacgtgacgacagattccagatgccctacccagggcgaagccattctcccggaggaacaggaccagaattatgtgtgtaaacacacctacgtcgatcggggctgggggaacggatgcggcctgtttgggaagggaagccttgtgacatgcgcgaagttccaatgtctggagtctatcgagggcaaagccgttcagcacgaaaatctcaagtataccgtgattatcacagtccatacgggggaccagcaccaggtgggaaacgagacccaaggcgttacagctgaaatcaccccccaggcctccacagtggaggctattctgcctgaatacggcaccctggggctcgagtgcagcccccgcacgggactggactttaatgagatgatccttctgaccatgaaaaacaaggcctggatggtccatagacagtggttctttgatctccctctgccctggacatctggcgccaccacagaaaccccgacgtggaataaaaaggagcttctggtgacattcaaaaacgctcacgcgaagaagcaagaagtcgtggttctcgggtcccaggagggagccatgcacaccgctctgacaggcgccaccgaaattcagaccagcgggggcacatctatctttgccggacatctgaaatgtcggctcaagatggacaaactggagcttaagggcatgtcctatgctatgtgcctgaatgccttcgtgctcaaaaaggaggtcagcgaaacgcagcacgggaccattctgatcaaggtggagtacaaaggagaagatgcgccttgtaagatccccttctccacagaggacggccaagggaaagctcataacggacgcctgattaccgccaaccctatcgttacaaagaaagaggaacccgtgaatattgaggccgaacccccttttggcgagtctaacatcgtcattgggatcggcgataaggctcttaagatcaattggtacaaaaagggaagctccattggcaaaatgttcgaagccaccgctagaggggcccggagaatggcgatcctcggagacacggcctgggattttggcagcgtggggggagtgctgaactctctgggcaagatggttcaccagattttcgggtccgcttatacagccctctttagcggcgtctcttggatcatgaaaattggaatcggcgtgctgcttacctggattgggctgaatagcaagaacacctccatgtctttcagctgcatcgtgatcggaattatcacactctacctgggcgctgtcgtgcaggccgacatggggtgtgttattaattggaagggaaaagagctgaagtgcggctccgggatctttgtgaccaacgaggtccatacatggacggaacagtataaattccaagcggatagcccgaagcgccttgccaccgctattgccggcgcttgggagaatggagtgtgtggcatccggtctacaaccagaatggaaaacctcctgtggaaacagatcgccaatgagctgaactacattctctgggaaaataacatcaagctgacaattgttgtgggggacgccatcggagtccttgagcagggcaaacgcaccctgacgccccagcctatggagctcaagtattcctggaagacctgggggaaagctaagattgtgacagcggaaacccaaaatagctcttttatcatcgatggacccaacacacctgagtgcccctccgccagccgggcttggaacgtttgggaagtggaggactacggcttcggcgtctttaccacaaatatttggctgaaactgagagaaaagtatacccagctttgtgaccaccgcctcatgtccgccgccgtgaaagatgagcgggctgtgcacgtcgacatggggtactggatcgagtctcagaagaacggaagctggaagctggaaaaagcctccctgattgaggttaagacgtgcacatggccgaaatctcataccctctggagcaatggcgtgctggaatccgatatgatcattcctaagagccttgcggggcccatctctcagcacaactacagacctggatatcatacccaaacagctggcccctggcacctggggaaactcgagctggacttcaattactgcgagggaaccacggtggtcatcacagaaaactgtggcattcgcggcccttccctgcggaccacaaccgtgagcgggaagcttatccacgagtggtgctgtagatcttgcacactccccccgctgcgctatatgggagaagatggctgttggtacgggatggagattcggcctatcaatgaaaaggaggagaacatggttaaatccctggtgagcgccggatctggcaagaccgacaattttacgatgggggtcctctgcctggccattcttttcgaagaggtgatgagaggaaaattcggcaagaaacatatgatcgctggcgccctgtttaccttcgttctcctgctgagcgggcagattacatggcgggatatggcgcacacccttatcatgatcggatccaacgctagcgaccgcatgggcatgggggtgacatatctggccctcattgccacctttaagatccagcccttcctggctctcggatttttcctgagaaagcttacgtctcgggaaaatctgctcctgggcgtcgggctggccatggctacaacccttcaactgcccgaggatattgaacagatggccaacggaatcgcgctcggcctgatggccctcaaactgattacacagtttgagacctaccagctttggaccgctctgatctccctcatgtgtagcaatacaatcttcacgctgaccgtggcctggagaacagctaccctgattcttgccgttatctccctgctccctgtgtgccaatctagctccatgcgcaagacagactggctgccgatgaccgtcgccgctatgggcgtgccccctctccccctgtttattttctctcttaaagatacgctgaagcggagaagctggcctctgaacgagggggtgatggcggtcggactcgtttccatcctggcctctagctttcttcgcaatgacgtgcccatggctggccctctggtggccgggggactcctgattgcctgttatgtcatcacaggcacctccgctgatctcaccgtggaaaaagccgcggacgttacatgggaggaagaggctgaacagaccggggtgagccataacctgatgatcacagtcgacgatgacggaacgatgagaattaaggatgacgagaccgagaacatccttacagtgctgctgaaaaccgccctcctgattgtttctggcatcttcccctactccattccggccacacttctggtgtggcacacctggcagaagcagacgcaacggagcggcgtcctctgggatgtgccttctccccctgaaacccagaaggctgagctggaagagggggtctaccgcatcaaacagcagggaatttttggcaagacacaagtgggggttggagtgcagaaagagggcgtcttccataccatgtggcacgtgacaagaggggccgttctcacccacaatggaaagcggctggaacccaactgggcgaatgtgaaaaaggaccttatctcctatggcggcgggtggaagctgagcgctcagtggcaaaaaggagaggaagtccaggtgatcgccgtggagccgggcaagaaccctaaaaatttccagacaatgcccgggatttttcagacgaccacaggagaaatcggcgccattgctctggatttcaagcctgggacctctggatcccccatcattaaccgcgagggcaaagttgtcggcctctacgggaatggagtggtgaccaagaacggcgggtatgtcagcggaatcgcccaaacaaatgctgagcccgacggccctacgccggaactggaggaagagatgtttaagaaaagaaaccttaccatcatggatctgcatcccgggtccggcaagacacggaaatacctccctgccattgtgcgcgaagcgatcaagagacggctgcgcaccctcattctggcccccacaagagttgtggctgccgagatggaggaagctcttaaaggactgcctatccggtatcagaccacggccacaaagagcgagcacaccggcagagaaattgtcgacctgatgtgccatgccaccttcacaatgcgcctcctgtctcccgtgcgggttcctaattacaaccttatcgtgatggatgaggctcactttaccgacccggcgagcatcgccgctagagggtatatttccacacgcgtcggaatgggcgaagccgccgctatcttcatgaccgccacgccccctgggacagcggatgcttttccccagtctaatgcccctattcaggacgaggagcgggacatccccgaaagaagctggaactccggaaatgagtggattaccgatttcgccggcaagacagtgtggtttgttccgtctatcaaagctgggaacgacattgccaactgtctgcgcaagaatggcaaaaaggtgatccaactcagccggaaaaccttcgatacggaataccagaagaccaagctgaacgactgggattttgtcgtgacaaccgacatctccgagatgggagcgaatttcaaagccgatagagtgattgaccctcgccggtgcctgaagcccgtcatcctcacagatggccccgagagagttattcttgctgggcctatgcccgtgaccgtggcctctgctgcccagcggcgcggaagagtcggccggaacagccagaaagaaaatgaccaatacatcttcacagggcagcctctgaacaatgatgaggaccatgctcactggaccgaagccaagatgctgctcgacaacattaatacgccggagggaatcatccccgcgctgtttgaacctgagcgcgagaaatccgccgctattgatggcgaatatagacttaagggggagagccggaaaacattcgtggaactgatgagacgcggcgacctccccgtttggctggcccacaaggtggcttctgagggaatcaagtacaccgatcggaaatggtgctttgacggcgaaagaaacaatcagattctggaggagaacatggatgtcgaaatctggaccaaggagggggaaaaaaagaaactccgccctcggtggcttgacgccagaacatattccgatcccctggccctgaaggagttcaaggactttgctgcgggacgcaaaagcattgccctcgatctggtgaccgaaatcggccgggttccgtctcatcttgctcacagaacacgcaatgccctggacaacctcgtgatgctgcatacgtccgagcacgggggaagagcctaccggcacgctgtcgaggaactgcctgagaccatggaaacactccttctgctgggcctcatgatcctgcttaccggcggggccatgctgttcctcattagcggaaagggcatcgggaaaacatccattggactgatctgtgtggtcgcgtctagcggcatgctgtggatggccgatgtgcccctccagtggattgcttccgccatcgttcttgagtttttcatgatggtgctgctgattcctgagcccgaaaagcaacgcacccctcaggacaatcagctcgcttatgtggtcatcgggatcctgacgcttgccgcgattgttgccgctaacgagatgggactgctcgaaaccacaaaaagagatctgggcatgagcaaggagcccggcgtggtgtctccgacctcctacctggacgtcgacctccatcctgccagcgcttggacactttatgccgtggctaccacggttatcacacccatgctgcggcacaccattgaaaattctacagccaacgtgagcctggcggccatcgctaaccaagccgtcgtgctcatggggctggataagggatggcccatttccaaaatggaccttggcgtccctctgctcgctctggggtgctactctcaggtgaatccgctgaccctcaccgccgccgttcttctgctggtgacacattacgcgatcatcggacccggcctccaggctaaggccacgcgcgaggctcagaaaagaaccgccgccgggattatgaagaaccctacagtcgatggaatcatgaccattgacctggatcccgtgatctatgacagcaaatttgagaagcaacttggccaggttatgctgctcgtgctgtgtgctgtccagctgctccttatgcggacatcctgggccttctgcgaagcgctgaccctggccacgggccctattacaaccctctgggaggggtctcccggaaagttttggaataccacaatcgctgtgagcatggccaacatcttcagaggctcctacctggctggggccggacttgcgtttagcattatgaaatctgtgggcaccgggaagcgcggaacaggctcccagggcgaaacgctgggggagaaatggaagaaaaagctcaatcaactgagccggaaagaattcgatctgtataagaagtccggaatcaccgaggttgacagaattgaggccaaagaaggcctcaagcgcggggagatcacacaccatgctgtctctcggggaagcgccaaacttcagtggttcgtggaaagaaacatggtgattcctgagggccgggtcatcgatctggggtgtggacgcggcggctggtcctactattgcgctgggctgaagaaagttaccgaagtgagaggatacacaaagggcgggccgggacacgaggagcccgtgcctatgtctacctatggctggaatattgtcaagctcatgagcgggaaagacgtgttttacctgccccctgaaaagtgtgatacgcttctgtgcgacatcggagagtccagcccctctccgaccgttgaagagtcccggacaatccgcgtgctcaaaatggtcgagccttggctgaagaacaatcagttctgtattaaagtgctgaacccctacatgcccaccgttatcgaacacctcgagagacttcagcggaagcatggcggcatgctggtgcgcaatcctctgagcagaaactctacacacgaaatgtattggatttccaatgggaccggaaacatcgtcagctctgtgaatatggtgagccggctcctgcttaaccgctttacaatgacccatagacggcccacgattgagaaggatgtcgacctgggcgccgggacaagacacgttaacgctgaacctgagaccccgaatatggacgtgatcggagagcgcatccggagaattaaagaagagcactcctctacctggcattacgatgacgaaaacccctataagacatgggcctaccacggcagctatgaggtgaaagcgacggggtccgccagctccatgatcaatggagtcgtgaagctcctgaccaaaccttgggatgttgtgcccatggtcacacaaatggctatgaccgacacaacccctttcggccagcagcgcgtgtttaaggaaaaggttgatacacggacccccagaccgatgcctggcacgcgcaaagtgatggagattaccgccgagtggctgtggcggacactcgggagaaacaagcgcccccggctgtgcaccagagaagagttcatcaaaaaggtccgcacaaatgctgccatgggagccgtgtttaccgaagagaaccaatgggactctgcgcgggctgccgttgaagatgaggagttctggaaacttgtggacagagaacgcgagctgcataagctcggcaaatgtgggagctgcgtctacaatatgatgggaaagagagaaaagaaactgggcgagtttgggaaggccaaaggctcccgggctatttggtatatgtggcttggagcccgctacctggagttcgaagctctcggctttctgaacgaggatcactggttctctagagaaaatagccattccggggtggagggagaaggcctgcacaagctcgggtacatcctgcgggacatctctaaaattcctggaggcgccatgtatgcggatgacacggccgggtgggacacaagaatcaccgaggatgaccttcacaacgaggaaaagattacacagcagatggatcccgagcatcggcagctggctaatgccatctttaagctcacctaccaaaacaaagtcgtgaaggttcagcgccctacgcccaaaggcaccgtgatggacattatcagcagaaaggatcagcggggatccggccaggtcgggacatatggactgaataccttcacaaacatggaagctcaacttatccgccagatggagggcgaaggggtgctgagcaaagccgacctcgagaatccgcacctgctggagaagaaggtgacccagtggctcgaaacaaaaggagttgagagactgaagcggatggcgatttctggcgatgactgcgtggtcaaacctatcgatgaccgcttcgccaacgctcttctggccctcaacgatatggggaaggtgagaaaagacattccccagtggcaaccctccaagggctggcatgattggcagcaggttcctttttgtagccaccacttccatgaactgatcatgaaggacggacggaaacttgtggtcccgtgccgcccccaggacgagctgattggcagagctcggatctctcaaggggccggatggtccctccgcgaaaccgcttgtctgggcaaggcctacgcgcagatgtgggccctgatgtattttcacagacgggatctccgcctggctagcaatgccatttgctctgccgtgcctgtccattgggtgcccacgtccagaacaacctggagcatccacgctcatcaccagtggatgaccacagaggacatgcttaccgtttggaaccgggtgtggatcgaggataatccttggatggaagacaaaacacccgtcacgacctgggaggatgtgccttacctggggaagagagaagaccaatggtgtggatccctcattggcctgacaagccgcgccacctgggcgcagaacatccttacagctattcagcaggttcggtctctgatcgggaatgaggagttcctcgattatatgcccagcatgaaaagatttcgcaaggaagaggaatccgagggcgccatttggtga

SEQ ID NO: 20898 - RNA, 9873 nt, synthetic construct
  misc_feature 1..9873: note = derived and/or modified CDS sequence (opt5) from DENV-3__JQ920485__SS-prME
  source 1..9873: mol_type = other RNA
accagcctgtgcctcatgatgatgctgcccgccacccttgctttccacctgacgtccagagacggagaacctcggatgatcgtggggaagaacgaacgcggaaagtctctcctgtttaagaccgccagcggcattaatatgtgtacgcttatcgcgatggatctgggggagatgtgcgacgataccgtcacctacaaatgtccgctcattaccgaagttgagcccgaagacatcgattgctggtgtaacctgacatccacctgggtgacgtatggaacctgcaatcaggctggcgagcatagacgggacaagcgctctgtggccctggcccctcacgtcgggatgggactcgatacaagaacccagacatggatgagcgctgagggcgcctggcggcaggtcgaaaaagttgagacctgggctttccgccatcccggctttacgattctggcccttttcctggcgcactacatcgggacatccctcacccagaaggtggtcatctttattctgcttatgctggtgacaccttctatgaccatgagatgtgttggagtgggcaaccgggacttcgtcgaagggctcagcggagccacctgggtggatgtggtcctggagcatggcgggtgcgttacaacgatggctaagaataaacccaccctggacatcgagctccagaagacagaagccacccagctggctacacttcgcaaactgtgtattgagggaaagatcaccaacattacgacagattccagatgccctacccagggcgaagccatcctcccggaggaacaggaccagaattatgtgtgtaaacacacctacgtggatcggggctgggggaacggatgcggcctgtttgggaagggaagccttgtcacatgcgcgaagttccaatgtctggagtctattgagggcaaagccgtgcagcacgaaaatctcaagtataccgttatcatcacagtgcatacgggggaccagcaccaggtcggaaacgagacccaaggcgtgacagctgaaattacaccccaggcctccacagttgaggctatcctgcctgaatacggcaccctggggctcgagtgcagcccccgcacgggactggactttaatgagatgattcttctgaccatgaaaaacaaggcctggatggtgcatagacagtggttctttgatctccctctgccctggacatctggcgccaccacagaaaccccgacgtggaataaaaaggagcttctggtcacattcaaaaacgctcacgcgaagaagcaagaagtggtcgtgctcgggtcccaggagggagccatgcacaccgctctgacaggcgccaccgaaatccagaccagcgggggcacatctatttttgccggacatctgaaatgtcggctcaagatggacaaactggagcttaagggcatgtcctatgctatgtgcctgaatgccttcgttctcaaaaaggaggtgagcgaaacgcagcacgggaccatcctgatcaaggtcgagtacaaaggagaagatgcgccttgtaagattcccttctccacagaggacggccaagggaaagctcataacggacgcctgatcaccgccaaccctattgtgacaaagaaagaggaacccgttaatatcgaggccgaacccccttttggcgagtctaacattgtgatcgggatcggcgataaggctcttaagattaattggtacaaaaagggaagctccatcggcaaaatgttcgaagccaccgctagaggggcccggagaatggcgattctcggagacacggcctgggattttggcagcgtcgggggagtgctgaactctctgggcaagatggtgcaccagatcttcgggtccgcttatacagccctctttagcggcgtttcttggattatgaaaatcggaattggcgtcctgcttacctggatcgggctgaatagcaagaacacctccatgtctttcagctgcatcgtgattggaatcattacactctacctgggcgctgtggtccaggccgacatggggtgtgtgatcaattggaagggaaaagagctgaagtgcggctccgggatttttgttaccaacgaggtgcatacatggacggaacagtataaattccaagcggatagcccgaagcgccttgccaccgctatcgccggcgcttgggagaatggagtctgtggcatccggtctacaaccagaatggaaaacctcctgtggaaacagattgccaatgagctgaactacatcctctgggaaaataacattaagctgacaatcgtggttggggacgtgattggagtccttgagcagggcaaacgcaccctgacgccccagcctatggagctcaagtattcctggaagacctgggggaaagccaagatcgtgacagctgaaacccaaaatagctcttttatcattgatggacccaacacacctgagtgcccctccgcgagccgggcctggaacgtttgggaagtggaggactacggcttcggcgtctttaccacaaatatctggctgaaactgagagaaaagcacacccagctttgtgaccaccgcctcatgtccgctgccgtgaaagatgagcgggccgtgcatgctgacatggggtattggattgagtctcagaagaacggaagctggaagctggaaaaagcctccctgatcgaggtcaagacgtgcacatggccgaaatctcacaccctctggagcaatggcgttctggaatccgatatgattatccctaagagccttgcggggcccatctctcagcataactacagacctggataccacacccaaacagctggcccctggcacctggggaaactcgagctggacttcaattattgcgagggaaccacggtggtgattacagaaaactgtggcatccgcggcccttccctgcggaccacaaccgtcagcgggaaacttattcatgagtggtgctgtagatcttgcacactgcccccgctgcgctacatgggagaagatggctgttggtatgggatggagatccggcctattaatgaaaaggaggagaacatggtgaaatccctggttagcgccggatctggcaagaccgacaattttacgatgggggtgctctgcctggccatccttttcgaagaggtcatgagaggaaaattcggcaagaaacacatgattgctggcgccctgtttaccttcgtgctcctgctgagcgggcagatcacatggcgggatatggcgcatacccttatcatgattggatccaacgctagcgaccgcatgggcatgggggttacatacctggccctcatcgccacctttaagattcagcccttcctggctctcggatttttcctgagaaaacttacgtctcgggaaaatctgctcctgggcgtggggctggccatggctacaacccttcaactgcccgaggatatcgaacagatggccaacggaattgcgctcggcctgatggccctcaaactgatcacacagtttgagacctatcagctttggaccgctctgatctccctcatgtgtagcaatacaattttcacgctgaccgtcgcctggagaacagctaccctgatccttgccgtgatttccctgctccctgtttgccaatctagctccatgcgcaagacagactggctgccgatgaccgtggccgctatgggcgtgccccctctccccctgtttatcttctctcttaaagatacgctgaagcggagaagctggcctctgaacgagggggtgatggcggtgggactcgtctccattctggcctctagctttcttcgcaatgacgttcccatggctggccctctggtggccgggggactcctgatcgcctgttacgtgatcacaggcacctccgctgatctcaccgtcgaaaaagccgcggacgtgacatgggaggaagaggctgaacagaccggggttagccacaacctgatgattacagtggacgatgacggaacgatgagaatcaaggatgacgagaccgagaacattcttacagtcctgctgaaaaccgccctcctgatcgtgtctggcattttcccctattccatcccggccacacttctggtttggcatacctggcagaagcagacgcaacggagcggcgtgctctgggatgtcccttctccccctgaaacccagaaggctgagctggaagagggggtgtaccgcattaaacagcagggaatctttggcaagacacaagtcggggtgggagttcagaaagagggcgtgttccacaccatgtggcacgtcacaagaggggccgtgctcacccataatggaaagcggctggaacccaactgggcgaatgttaaaaaggaccttatctcctacggcggcgggtggaagctgagcgctcagtggcaaaaaggagaggaagtgcaggtcattgccgtggagccgggcaagaaccctaaaaatttccagacaatgcccgggatctttcagacgaccacaggagaaattggcgccatcgctctggatttcaagcctgggacctctggatcccccattatcaaccgcgagggcaaagtggttggcctctatgggaatggagtcgtgaccaagaacggcgggtacgtgagcggaatcgcccaaacaaatgctgagcccgacggccctattccggaactggaggaagagatgtttaagaaaagaaaccttacgatcatggatctgcaccccgggtccggcaagacccggaaatatctccctgccattgtccgcgaagcgatcaagagacggctgcgcacactcattctggcccccaccagagtggttgctgccgagatggaggaagctcttaaaggactgcctatccggtaccagacaaccgccacaaagagcgagcatacaggcagagaaatcgtggacctgatgtgccacgccaccttcaccatgcgcctcctgtctcccgtccgggtgcctaattataaccttattgttatggatgaggctcattttacagacccggcgagcatcgccgctagagggtacatttccacccgcgtgggaatgggcgaagccgccgctatcttcatgacagccacaccccctgggacggcggatgcttttccccagtctaatgcccctattcaggacgaggagcgggacatccccgaaagaagctggaactccggaaatgagtggattacagatttcgccggcaagaccgtctggtttgtgccgtctatcaaagctgggaacgacatcgccaactgtctgcgcaagaatggcaaaaaggttattcaactcagccggaaaacattcgataccgaatatcagaagacgaagctgaacgactgggattttgtggtcaccacagacatctccgagatgggagcgaatttcaaagccgatagagtgattgaccctcgccggtgcctgaagcccgtgatcctcaccgatggccccgagagagtcattcttgctgggcctatgcccgttacagtggcctctgctgcccagcggcgcggaagagtgggccggaacagccagaaagaaaatgaccaatacatcttcaccgggcagcctctgaacaatgatgaggaccacgctcactggacagaagccaagatgctgctcgacaacatcaataccccggagggaattatccccgcgctgtttgaacctgagcgcgagaaatccgccgctattgatggcgaatacagacttaagggggagagccggaaaacgttcgtcgaactgatgagacgcggcgacctccccgtgtggctggcccataaggttgcttctgagggaatcaagtatacagatcggaaatggtgctttgacggcgaaagaaacaatcagattctggaggagaacatggatgtggaaatctggaccaaggagggggagaagaagaaactccgccctcggtggcttgacgccagaacctactccgatcccctggccctgaaggagttcaaggactttgctgcgggacgcaaaagcatcgccctcgatctggtcacagaaattggccgggtgccgtctcaccttgctcatagaacccgcaatgccctggacaacctcgttatgctgcacacatccgagcacgggggcagagcctatcggcatgctgtggaggaactgcctgagacgatggaaaccctccttctgctgggcctcatgatcctgcttacaggcggggccatgctgttcctcattagcggaaagggcatcgggaaaacctccattggactgatctgtgtcgtggcgtctagcggcatgctgtggatggccgatgtccccctccagtggattgcttccgccatcgtgcttgagtttttcatgatggttctgctgatccctgagcccgaaaagcaacgcacacctcaggacaatcagctcgcttacgtggtgattgggatcctgacccttgccgcgattgtcgccgctaacgagatgggactgctcgaaacgaccaaaagagatctgggcatgagcaaggagcccggcgttgtgtctccgacatcctatctggacgtggacctccaccctgccagcgcttggaccctttacgccgtcgctacaaccgtgatcacgcccatgctgcggcatacaattgaaaattctaccgccaacgttagcctggcggccatcgctaaccaagccgtggtcctcatggggctggataagggatggcccatctccaaaatggaccttggcgtgcctctgctcgctctggggtgctattctcaggtcaatccgctgacactcaccgccgccgtgcttctgctggttacccactacgcgattatcggacccggcctccaggctaaggccacacgcgaggctcagaaaagaacggccgccgggattatgaagaaccctaccgtggatggaatcatgacaattgacctggatcccgtcatctacgacagcaaatttgagaagcaacttggccaggtgatgctgctcgttctgtgtgctgtgcagctgctccttatgcggacctcctgggccttctgcgaagcgctgacactggccaccggccctatcacgacactctgggaggggtctcccggaaagttttggaataccaccattgctgtcagcatggccaacatcttcagaggctcctatctggctggggccggacttgcgtttagcattatgaaatctgtgggcacagggaagcgcggaaccggctcccagggcgaaacactgggggagaaatggaagaaaaagctcaatcaactgagccggaaagagttcgatctgtacaagaagtccggaatcacggaggtggacagaattgaggccaaagaaggcctcaagcgcggggagatcacccatcacgctgtttctcggggaagcgccaaacttcagtggttcgtcgaaagaaacatggtgattcctgagggccgggtgatcgatctggggtgtggacgcggcggctggtcctattactgcgctgggctgaagaaagtcacagaagttagaggatataccaagggcgggccgggacacgaggagcccgtgcctatgtctacatacggctggaatatcgtgaagctcatgagcgggaaagacgtcttttatctgccccctgaaaagtgtgatacccttctgtgcgacattggagagtccagcccctctccgacggtggaagagtcccggaccatccgcgttctcaaaatggtggagccttggctgaagaacaatcagttctgtattaaagtcctgaacccctacatgcccacagtgatcgaacatctcgagagacttcagcggaagcacggcggcatgctggttcgcaatcctctgagcagaaactctacccatgaaatgtactggatttccaatgggacaggaaacatcgtgagctctgtcaatatggtgagccggctcctgcttaaccgctttaccatgacacacagacggcccaccatcgagaaggatgtggacctgggcgccgggacgagacacgtcaacgctgaacctgagacaccgaatatgaacgttattggagagcgcatccggagaattaaagaagaacattcctctacctggcactatgacgatgaaaatccctacaagacctgggcctatcatggcagctacgaggtgaaagcgacagggtccgccagctccatgatcaacggagtggtcaagctcctgacgaaaccttgggacgtggttcccatggtgacccaaatggctatgacagataccacacctttcggccagcagcgcgtctttaaggaaaaggtggacacccggacacccagaccgatgcctggcacccgcaaagttatggagattacggccgagtggctgtggcggaccctcgggagaaataagcgcccccggctgtgcacaagagaagagttcatcaaaaaggtgcgcaccaacgctgccatgggagccgtctttacagaagagaatcaatgggattctgcgcgggctgccgtggaagacgaggagttctggaaacttgttgatagagaacgcgagctgcacaagctcggcaaatgtgggagctgcgtgtataacatgatgggaaagagagaaaagaaactgggcgagtttgggaaggccaaaggctcccgggctatctggtacatgtggcttggagcccgctatctggagttcgaagctctcggctttctgaatgaggaccattggttctctagagaaaacagccactccggggtcgagggagaaggcctgcacaagctcgggtacattctgcgggatatctctaaaattcctggaggcgccatgtacgcggacgataccgccgggtgggacacgagaatcacagaggacgatcttcataatgaggaaaagattacccagcagatggaccccgagcaccggcagctggctaacgccatctttaagctcacatatcaaaataaagtggtcaaggtgcagcgccctacccccaaaggcacggttatggatatcattagcagaaaggaccagcggggatccggccaggtggggacctacggactgaacacattcaccaatatggaagctcaacttatccgccagatggagggcgaaggggtcctgagcaaagccgatctcgagaacccgcatctgctggagaagaaggtgacacagtggctcgaaaccaaaggagtggagagactgaagcggatggcgatttctggcgacgattgcgttgtgaaacctatcgacgatcgcttcgccaacgcccttctcgctctcaatgacatggggaaggtcagaaaagatattccccagtggcaaccctccaagggctggcacgactggcaacaggtgcctttttgtagccaccatttccacgaactgatcatgaaggatggacggaaacttgttgtgccgtgccgcccccaggacgagctgattggcagagctcggatctctcaaggggccggatggtccctccgcgaaacagcttgtctgggcaaggcctatgcgcagatgtgggccctgatgtactttcatagacgggacctccgcctggctagcaacgccatctgctctgccgtccctgtgcactgggtccccacctccagaacgacatggagcattcatgctcaccaccagtggatgaccaccgaggatatgcttacagtgtggaatcgggtttggatcgaggacaacccttggatggaagataaaacccccgtgacaacgtgggaggacgtcccttatctggggaagagagaagatcaatggtgtggatccctcattggcctgaccagccgcgccacatgggcgcagaatatccttaccgctattcaacaggtgcggtctctgatcgggaacgaggagttcctcgactacatgcccagcatgaaaagatttcgcaaggaagaggaaccggagggcgccatctggtga

SEQ ID NO: 20899 - RNA, 9873 nt, synthetic construct
  misc_feature 1..9873: note = derived and/or modified CDS sequence (opt5) from DENV-3__FJ644564__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccagaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgccccctgtaaaattcctttcagcaccgaggacggccaagggaaggcgcataacggaagactgatcacagctaatcccgttgtgaccaaaaaggaggaacccgtcaacattgaggccgaacctccgttcggcgagtccaatatcgtgattgggatcggcgataacgccctgaaaatcaattggtataagaagggatctagcattggcaaaatgtttgaagctacggcccggggggctagacgcatggccatccttggagacacagcgtgggatttcggctccgtggggggagttctcaacagcctgggcaagatggtccaccagatttttgggtctgcctacaccgctctgttctccggcgtgagctgggtgatgaaaatcggaattggcgtcctcctgacctggatcgggcttaattctaagaacacaagcatgtccttttcttgcattgccatcggaatcattaccctgtatctcggcgctgtggttcaggccgacatggggtgtgtgatcaattggaaaggaaaggagctgaagtgcggcagcgggattttcgtcacaaacgaggtgcatacgtggaccgaacagtacaaatttcaagcggattcccccaagcggctggccacagctatcgccggcgcttgggagaatggagtttgtggcattagaagcaccacacgcatggaaaaccttctctggaaacagatcgccaatgagctgaactatatcctgtgggaaaataacattaagctcaccgtggtcgtgggggacacgatcggagttctggagcagggcaaacggacccttacacctcagcccatggagctgaagtactcttggaaaacctgggggaaggccaagattgtgacagctgaaacccaaaactccagcttcatcattgatggacctaatacacccgagtgcccgtctgcgtccagagcctggaacgtctgggaagtggaggactatggctttggcgtgttcaccacgaatatctggctcaaactgcgcgaagtctacacacagatgtgtgaccaccggctgatgagcgctgccgttaaggatgagagagccgtgcacgctgacatggggtactggatcgagtcccagaaaaacggatcttggaagcttgaaaaagccagcctcattgaggtgaagacctgcacctggcctaagtcccatacactgtggtctaatggcgtcctggaaagcgatatgatcattcccaaatccctcgcggggcctatcagccagcacaaccatcgccccggatatcacacccaaacggctggcccttggcacctggagaatcttgagctggactttacatactgcgaagggaccacagtggttattaccgagaactgtggaacacggggcccctctctcagaaccacgaccgtgtccggcaagctgatccatgaatggtgctgtcgcagctgcacactgccgcctcttcggtatatgggggaggatggatgttggtacggcatggaaatcagacccatttctgagaaagaggaaaatatggtcaagtccctcgtgagcgccgggtctggaaaagttgacaacttcaccatgggcatcctgtgcctggccattctctttgaggaagtgatgcgggggaagttcggaaagaaacacatgatcgctggcgtcttctttacattcgtgctgcttctgagcggccagattacctggcgcgatatggcccatacgctcatcatgattgggtccaatgcgagcgacagaatgggaatgggcgttacatatctggctctgatcgccacctttaagatccagcccttccttgccctggggtttttcctccggaaactgacatctagagagaacctcctgcttggagtgggcctggctatggccaccaccctccaactgcctgaagatattgagcagatggctaatgggatcgccctgggacttatggcgctgaagctcattacacagtttgagacgtaccagctgtggaccgccctcatctccctgacatgtagcaacaccattttcacacttaccgtcgcttggcgcacggccacactgatcctcgctggcgtgtccctgctgccggtgtgccaatctagctccatgcggaaaaccgactggcttcccatgaccgtcgccgccatgggcgttcctcccctgcctctctttatcttctctctgaaggatacactcaagagacgcagctggcccctgaatgaaggggtgatggctgtgggacttgtctccattctggcgtctagcctgctcagaaacgacgtgcctatggccggccccctggttgctgggggacttctgatcgcctgttatgtgattaccggcacatccgccgatctcacggtcgagaaagctgccgacgtgacctgggaagaggaagcggagcagacaggggttagccacaacctgatgatcaccgtggacgatgacggaacaatgcggattaaggatgacgagaccgaaaatatcctcacggtcctgcttaaaaccgctctgctgatcgtgtctggcatttttccgtactccatccctgccacactcctggtctggcatacctggcagaagcagacacaacgcagcggcgtgctttgggatgttccctctcctcccgagacccagaaagccgaactggaggagggggtgtacagaattaagcagcagggaatcctcggcaaaacacaagtcggggtgggagttcagaaggaaggcgtgttccacacgatgtggcacgtcacccggggggctgtgctgacacataacggaaagcgcctcgagccgaattgggcctccgtgaaaaaggacctgattagctatggcggcgggtggagactttctgcgcagtggcaaaaaggagaagaggttcaggtcatcgctgtggaacctggcaagaaccccaaaaattttcagaccatgcctgggaccttccagacaacgaccggagagattggcgccatcgccctggatttcaagcccgggacatccggaagccccatcattaaccgggagggcaaggtggtcggcctgtacgggaatggagtggttaccaaaaacggcgggtatgtgtccggaatcgctcaaacaaatgccgaacctgacggcccgacccccgagctcgaagaggaaatgtttaagaaacgcaacctgacgattatggatcttcaccctgggagcggcaagacaagaaaatacctgcccgctatcgtccgggaggccattaagcgcagactccggaccctgatcctcgcgcctaccagagtggttgccgctgagatggaagaggccctgaagggacttcccatccgctatcagacaaccgctacaaaatctgaacataccggccgggagattgtggacctgatgtgccacgccacgttcacaatgagactgctcagccctgtccgcgtgccgaattacaacctgatcattatggatgaagcccattttaccgaccccgcttccatcgcggcccgggggtatatttctacaagagttggaatgggcgaggctgccgccatcttcatgagcgctacccctcccgggacggccgatgcgtttcctcagtccaatgctcccatccaggacgaggaacgcgacattccggagcggtcttggaacagcggaaatgaatggatcaccgatttcgccggcaagacagtgtggtttgtcccttccattaaagccgggaacgacatcgctaactgtcttagaaagaatggcaaaaaggtgattcaactgtctcgcaagaccttcgatacagagtaccagaaaaccaagctcaacgactgggattttgtggtcacaaccgacatcagcgagatgggagccaatttcaaagcggatcgggttattgaccccagacggtgcctgaagcccgtgatcctgacggatggccctgaacgcgtgatcctcgccgggcccatgcctgtcacagctgcctccgctgcccagagacggggacgcgtgggcagaaacccgcagaaagagaatgaccaatacatttttaccgggcagccccttaacaatgatgaagaccacgctcactggaccgaggccaagatgctgctggacaacatcaatacacctgaaggaattatccccgcgctcttcgagcctgagcgggaaaagagcgccgctattgatggcgagtatagactgaaaggggaatctcgcaagaccttcgttgagcttatgcggagaggcgacctgcccgtgtggctcgcccataaagtcgcttccgaaggaatcaagtacacagatcgcaaatggtgctttgacggccagcggaacaatcagatcctggaggagaacatggatgtggaaatttggacgaaggagggggaaaaaaagaagctgagaccgcgctggctcgacgcccggacctatagcgatcctcttgccctgaaagagttcaaggactttgctgcgggaagaaaatctatcgccctggatctcgttacagaaattggccgcgtgccctcccacctggctcatagaacccggaatgcccttgacaacctggtcatgctccacacaagcgagcacgggggacgcgcctacagacatgctgtggaggaactgcctgagaccatggaaacgctgctccttctgggcctgatgatcctcctgaccggcggggccatgcttttcctgatttccggaaagggcatcgggaaaacatctatcggactcatttgtgtcatcgcgagctccggcatgctgtggatggccgagattcccctgcaatggatcgctagcgccattgtgctcgagtttttcatgatggttcttctgatccctgaacccgagaagcagcggaccccgcaggataatcaactggcttatgtggtgattgggatcctcacactggccgcgatcattgccgctaacgaaatgggacttctggagaccacgaagcgcgacctcggcatgtctaaagaacctggcgtcgtttcccccacaagctacctggatgtggacctgcaccccgcctctgcttggaccctctatgccgtggctacaaccgtcatcacccctatgcttagacatacaattgagaatagcacggccaacgtgtccctggcggccatcgctaaccaggccgttgtgctgatggggctcgacaagggatggccgatttctaaaatggatctgggcgtcccccttctggctctcgggtgctacagccaggtgaatcctctgaccctgacagccgccgtcctccttctgatcacccactacgcgatcattggacccggcctgcaggctaaggccacacgggaggctcaaaaaagaaccgccgccgggatcatgaagaaccctacggtggacggaattatcacaattgatctcgaccccgttatctatgattccaagtttgaaaaacagctgggccaggtgatgcttctggtcctctgtgctgtgcagctgctgctcatgcgcacctcttgggccctttgcgaggcgctgaccctggccacaggccctatcaccacactctgggaagggagcccgggaaagttctggaatacgaccattgctgtttccatggccaacatctttcggggcagctacctggctggggccggacttgcgttctctattatgaaatccgtgggcacagggaagagaggaaccggcagccaaggcgagacactgggggaaaaatggaagaagaaactcaatcagctgtcccgcaaggagtttgacctgtataaaaagtctggaatcaccgaggtcgatcggacggaagccaaagagggcctcaagagaggggaaaccacacatcacgctgtgagccggggatccgccaaacttcagtggctggtggagcgcaacatggttattcccgaaggcagagtcatcgacctggggtgtggacggggcggctggtcttactattgcgctgggctcaagaaggtgaccgaggtgcgcggatacacaaaaggcgggcctggacacgaggaacccgtccctatgagcacctatggctggaatattgttaagctgatgtccgggaaagatgtgttctaccttcccccggagaagtgtgacacactgctctgcgatatcggagaaagctctccttcccccaccgtggaggagagcagaacgatccgggtcctgaaaatggtggaaccctggctgaagaacaatcagttttgtattaaggttctcaacccttacatgcccgccgtgatcgagcatcttgaacgcctgcaaagaaaacacggcggcatgctggtccggaatcctctctctcgcaactccacacatgagatgtattggattagcaatgggaccggaaacatcgtgtctagcgttaatatggtgtccagactgcttctgaaccggttcaccatgacacacagacgcccgacgattgaaaaggacgtcgatctcggcgctgggacccggcacgtgaacgccgagcccgagacacctaatatggacgtgatcggagaaagaatcaaacgcattaaggaggaacataactctacctggcactacgacgatgagaatccctataaaacatgggcgtaccatggcagctatgaagtcaaggccaccgggtccgctagctccatgatcaacggagttgtgaagctgctgacaaaaccttgggacgtggtccccatggtgacccagatggccatgacggataccacaccgttcggccagcaacgggtttttaaggagaaagtggacaccagaacacctcgccccatgcctggcacccggaaggtcatggagattacggctgaatggctctggagaacactggggcgcaataaacggcccagactttgcacccgcgaggaattcacaaagaaggtgcggaccaacgccgccatgggagcggtttttacggaggaaaatcagtgggattctgctaaagccgccgtggaggacgaggaattctggaagctggtcgatagagagcgcgaactccacaaactgggcaagtgtgggagctgcgtgtacaacatgatgggaaaaagagagaagaaacttggcgagtttgggaaggctaagggctcccgggccatctggtatatgtggctgggatctcgctacctcgaattcgaggctctgggctttctgaatgaagaccattggttcagcagagagaactcctactctggggttgaaggagagggcctccacaaactggggtatattcttcgggatatcagcaagatccctggaggcgccatgtacgcggacgataccgccgggtgggacacaagaattaccgaggacgatctgcacaatgaagagaaaatcacacagcagatggaccccgaacatcggctcctggctaacgccatttttaagcttacctatcaaaataaagtggtcaaggtgcagcgcccgacacctaccggcacggtcatggatatcatttccagaaaggaccagcggggaagcggccaggtggggacatacggactgaacaccttcaccaatatggaggctcaactcgttcgccagatggaaggcgagggggtgctgtctaaagccgatctggagaacccccacctccccgaaaagaaaatcacacagtggctggagaccaagggagtcgaaagacttaaacggatggcgatctccggcgacgattgcgtggtgaagcctattgacgatcgctttgccaacgctctgctcgccctgaatgacatggggaaggttagaaaagatatcccgcagtggcaacccagcaagggctggcatgactggcagcaggtgcctttctgttctcaccactttcatgagcttattatgaaagatggacggaagctggtcgtgccctgccgccctcaggacgaactcatcggcagagctcggatttcccaaggggccggatggagcctgcgcgagacagcttgtctgggcaaagcctatgcgcagatgtggtctctcatgtacttccacagacgggacctgcgccttgcctccaacgctatctgcagcgccgttcccgtgcattgggtccctacgtccagaaccacatggagcattcacgcccatcaccagtggatgaccacagaggatatgctgaccgtgtggaatcgggtctggatcgaagacaacccctggatggaggataagacgccggtgaccacatgggaaaatgttccttatctcgggaagagagaggaccaatggtgtggatctctgatcggccttaccagccgcgctacatgggcccagaacattcccaccgcgatccagcaggtgcggtccctgattgggaatgaggaattcctcgattacatgccttctatgaaaagatttcgcaaggaggaagagagcgaaggcgctatctggtga

SEQ ID NO: 20900 - RNA, 9873 nt, synthetic construct
  misc_feature 1..9873: note = derived and/or modified CDS sequence (opt5) from DENV-3__HQ235027__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccatcgaaattcagaattccgggggcaccagcatcttcgccggacatctgaagtgtcgcctcaaaatggacaagctggagcttaaaggcatgtcttacgctatgtgcaccaagacatttgtgctgaaaaaggaggtctccgaaacgcagcacgggaccatcctcattaaggtggagtacaaaggagaagatgccccctgtaagatccctttcagcacagaggacggccaagggaaagcgtataacggaagactgattaccgctaaccccgttgtgacaaagaaagatgagcccgtcaatatcgaagccgagcctccgttcggcgaatccaacattgtgatcgggatcggcgacaatgccctgaagattaactggtacaagaaaggatctagcatcggcaagatgtttgaggctaccgcccggggggctagacgcatggccattcttggagatacggcgtgggacttcggctccgtggggggagttctcaatagcctgggcaaaatggtccatcagatctttgggtctgcctatacagctctgttctccggcgtgagctgggtgatgaagattggaatcggcgtcctcctgacctggattgggcttaactctaaaaatatcagcatgtccttttcttgcatcgccattggaatcattaccctgtacctcggcgctgtggttcaggccgatatggggtgtgtgatcaactggaagggaaaggaactgaaatgcggcagcgggattttcgtcacaaatgaggtgcacacctggacagagcagtataagtttcaagcggactcccccaaacggctggccacggctatcgccggcgcttgggaaaacggagtttgtggcatcagaagcaccacacgcatggagaatcttctctggaagcagattgccaacgaactgaattacatcctgtgggagaacaatattaaactcaccgtggtcgtgggggatacaatcggagttctggaacagggcaagcggacccttacgcctcagcccatggagctgaaatattcttggaagacctgggggaaggccaaaattgtgacagctgagacccaaaactccagcttcatcatcgacggacctaacacacccgaatgcccgtctgcgtccagagcctggaatgtctgggaggtggaagactacggctttggcgtgttcaccacaaacatttggctcaagctgcgcgaggtctacacccagctgtgtgatcatcggcttatgagcgctgccgttaaagacgaaagagccgtgcacgctgatatggggtattggatcgagtcccagaagaatggatcttggaaactcgagaaggccagcctgattgaagtgaagacgtgcacatggcctaaatcccacaccctgtggtctaacggcgtcctcgagagcgacatgatcattcccaagtccctggcggggcctatcagccagcataatcaccgccccggataccatacccaaacagctggcccttggcaccttgggaaactggaactcgattttaactattgcgagggaaccacggtggttatcacagagaattgtggcacccggggcccctctctgagaacaaccacagtgtccgggaagctgattcacgaatggtgctgtcgcagctgcacccttccgcctctccggtacatgggagaggacggctgttggtatgggatggaaatcagacccatttctgagaaagaagagaacatggtcaagtccctggtgagcgccggatctggcaaggttgataatttcacgatgggggtgctgtgcctcgccatcctgtttgaggaagtcatgcggggaaaattcggcaagaaacatatgattgctggcgtgttctttaccttcgttcttctgctcagcgggcagatcacatggcgcgacatggcccacaccctgattatgatcggatccaacgcgagcgatagaatgggcatgggggtgacatacctggctcttatcgccacctttaagattcagcccttcctggccctcggatttttcctgcggaaactcacgtctagagagaatctgcttctgggcgtcgggctcgctatggccacaaccctgcaactgcctgaagacatcgagcagatggctaacggaattgcccttggcctgatggcgctcaagctgatcacacagtttgaaacctatcagctctggaccgccctgatttcccttacatgtagcaatacgatgttcaccctgacagtggcttggcgcaccgccacactcatcctggctggcgtgtccctgcttccggtctgccaatctagctccatgcggaagaccgattggctgcccatggccgttgccgctatgggggtgcctcccctccctctgtttatcttctctctcaaagacacgctgaagagacgcagctggccccttaacgagggagtgatggcggtcggcctggtgtccattctggcctctagcctcctgagaaatgatgttcctatggctgggccccttgtggccggaggcctgctcatcgcctgttacgtcattacagggacctccgctgacctgaccgtggagaaagccgcggacatcacatgggaagaggaagctgagcagaccggagttagccataacctcatgattacagtggatgacgatggcacgatgcggatcaaggacgatgaaaccgagaacatcctgacagtccttctgaaaaccgccctgctcgtggtctctggcgtgtttccgtactccattcctgccacactgcttgtttggcacacctggcagaagcagacgcaacgcagcggggtgctgtgggacgtcccctctcctcccgagacccagaaagctgaactcgaggaaggagtgtatagaatcaagcagcagggcattttcgggaagacacaagttggagtgggcgtccagaaagagggggtgtttcataccatgtggcacgtgacacggggagccgttctgacctacaatggcaagcgcctcgagccgaactgggcgtccgtcaaaaaggatctgatcagctatggcgggggatggagactttctgctcagtggcaaaaaggcgaagaggtgcaggtgattgccgtcgaacctgggaagaatcccaagaacttccagacaatgcctggaacgttccagaccacaaccggcgagatcggggccattgctctggactttaaacccggaacctccggcagccccatcatcaatcgggaaggcaaggtggttgggctgtacggaaacggcgtggtcacaaaaaatgggggatatgtgtccggcattgcccaaacgaacgctgagcctgatgggccgacccccgagctcgaagaggaaatgttcaagaaacgcaatctgacaatcatggaccttcaccctggcagcggaaagaccagaaagtacctgcccgccattgttcgggaggcgatcaaacgcagactccggacactgattctcgcccctaccagagtggtcgctgccgaaatggaggaggctctgaagggccttcccatccgctatcagacgacagccaccaaatctgaacataccgggcgggagatcgtggatctgatgtgccacgccacatttaccatgagactgctcagccctgttcgcgtgccgaactacaatctgattatcatggacgaagctcatttcacagatcccgcgtccattgccgctcggggatacatctctaccagagtcggcatgggggaggccgccgctatttttatgacggccacacctcccggaaccgcggacgctttccctcagagcaacgcccccatccaggacgaagagcgcgatatcccggagcggtcctggaattctggcaacgaatggattacagactttgccgggaagaccgtgtggttcgtgcctagcatcaaagctggcaatgatattgccaactgtcttagaaagaacggaaagaaagtcatccaactgtcccgcaagacgtttgacaccgagtatcagaaaacaaagctcaatgattgggacttcgttgtgaccacagatatttctgaaatgggcgcgaactttaaagccgaccgggtgatcgatcccagacggtgcctgaagcccgtcattctgaccgacgggcctgagcgcgtgatcctcgctggacccatgcctgttacagccgctagcgccgctcagagacggggccgcgtggggagaaatccgcagaaggagaacgatcaatacatcttcaccggacagccccttaataacgacgaagaccacgcccattggacggaggcgaaaatgctgctggataatattaacacacctgaaggcatcattcccgccctcttcgagcctgaacgggagaagtccgctgccatcgacggggagtatagactgaaaggcgaaagccgcaagacctttgtcgagcttatgcggagaggagatctgcccgtgtggctcgctcacaaagttgcctctgaaggcattaagtacaccgaccgcaaatggtgcttcgatgggcagcggaataaccagatcctggaggaaaatatggacgtggagatctggacaaaggagggagaaaagaaaaagctgagaccgcgctggctcgatgcccggacctattccgaccctcttgctctgaaagagtttaaggatttcgcggccggcagaaaaagcattgctctggacctcgtcacagaaatcgggcgcgtgccctctcacctggcccatagaacgcggaacgcccttgataatctggtcatgctccacacctccgagcatggaggccgcgcttacagacacgccgtggaagagctgcctgagacaatggaaaccctgctccttctgggcctgatgattctcctgacagggggagcgatgctttttctgatcagcggcaaggggattggaaagacctccatcggcctcatctgtgttattgcctctagcgggatgctgtggatggctgagatccccctgcaatggattgcctccgctatcgtgctcgaattctttatgatggtgcttctgattcctgagcccgagaaacagcggacgccgcaggacaaccaactggcctatgtcgttatcggaattctcaccctggcggccatcatcgctgccaatgaaatgggccttctggagacaaccaagcgcgatctcggcatgagcaaagaacctggggtggtgtctcccacatcctacctggacgtcgacctgcaccccgctagcgcctggaccctctacgctgtggccacgacagttattacccctatgcttagacatacaatcgagaactctaccgcgaatgtgagcctggccgctattgccaaccaggctgtcgtgctgatgggactcgataagggctggccgatctccaaaatggacctgggggtcccccttctggccctcggatgctattctcaggtgaaccctctgaccctgacagccgcggttctccttctgattacgcactacgctatcatcggccccgggctgcaggccaaggctacccgggaagcccaaaagagaacagccgctggaattatgaaaaatcctaccgtggatggcatcatgacaattgacctcgatcccgtcatctatgacagcaagttcgagaaacagctgggccaggtgatgcttctggttctctgtgccgtgcagctgctgctcatgcgcacctcctgggcgctttgcgaggccctgacgctggctacagggcctattaccaccctctgggaaggatctccgggcaagttttggaacacaaccatcgccgtcagcatggctaatatcttccgggggtcctacctggccggagcgggccttgcctttagcattatgaaatctgtggggacaggaaagagaggcacgggctcccaaggggagaccctgggagaaaagtggaaaaagaaactcaaccagctgagccgcaaggagttcgatcggtataaaaagtccggcatcacagaagtggacagaaccgaggctaaagaggggctgaagcggggagaaacaacccatcacgccgtttctcgcggcagcgctaagctccagtggtttgtcgagagaaatatggtgattcccgaagggcgggtgatcgatcttggatgtggccgcggcgggtggtcctactattgcgccggactgaaaaaggtcacggaggttagaggctacaccaaagggggacctggccatgaagagcccgtgcctatgtctacatacgggtggaacattgtgaagctgatgagcggaaaagacgtcttctatctccccccggagaagtgtgataccctgctttgcgacatcggcgaatccagcccttctcccacagtggaggaatcccggaccattcgcgttctgaagatggtggagccctggctcaaaaataaccagttctgtatcaagatcctgaatccttacatgcccacagtcattgagcacctggaaagactccaacggaaacacggcgggatgcttgtgcgcaaccctctgagcagaaattctacccatgagatgtattggatctccaacggaacgggcaatattgttgctagcgtgaacatggtctctcggctgctcctgaatagatttacaatgacccaccgccggccgaccatcgaaaaggatgtggaccttggggccggaacaagacatgtgaacgcggagcccgaaacgcctaacatggacgtcattggcgagcgcatcaaacggatcaaggaggaacacaatagcacctggcactacgatgacgagaacccctataagacatgggcctaccatgggtcctatgaagttaaagctaccggatctgccagctccatgattaatggcgtggtgaagctgctcacaaaaccttgggatgtcgtgcccatggttacccagatggctatgacagacaccacgccgttcggccagcaaagagtgtttaaggagaaagtcgatacccgcacacctcggagcatgcccgggaccagacgcgtgatgggaatcacagccgaatggctgtggcggaccctgggcagaaacaagaagcctcgcctctgcacgcgggaggagttcacaaaaaaggttagaaccaatgccgcgatgggggctgtgtttacagaagagaaccagtgggactccgccaaagccgctgtcgaagatgaggacttctggaagctggtggatcgcgaaagagagcttcacaaactgggaaagtgtggctcttgcgtttacaatatgatggggaaacgggagaagaagctcggcgaatttggaaaagccaagggcagccgcgctatttggtacatgtggctgggggccagatatcttgagttcgaagcgctgggatttctcaacgaggaccattggttctcccgggagaattcttacagcggcgtggaaggggagggactgcacaaactgggctatatcctcagagatatttccaagatccccgggggcgccatgtacgctgacgacaccgccggatgggatacgcggatcaccgaagacgatctgcataacgaggaaaaaattacacagcagatggaccctgagcaccgccaacttgctaatgccatctttaagctgacctatcagaacaaggtcgtgaaagtccagagacccacaccgaccggcacagtgatggatattatctctcggaaggaccagcgcgggagcggacaagttggcacctacgggctcaatacgttcacaaacatggaggcgcagctgattagacagatggaaggagagggcgtgctttccaaagccgatctggaaaatcctcacctccccgagaagaaaatcacccagtggctggaaaccaagggggtcgagcggctgaagcgcatggctatcagcggcgacgattgcgtggtgaaacccattgacgatagatttgccaacgctctcctggcccttaacgacatgggaaaggttcggaaagatatccctcaatggcagccgtctaagggctggcatgactggcagcaggtgcccttctgttcccaccatttccacgagctgattatgaaagacgggcgcaagctcgtcgtgccttgcagaccccaagatgaactgatcggacgggctcgcattagccagggcgccgggtggtctcttagagagacagcgtgtctgggaaaggcctatgctcagatgtggtccctcatgtactttcaccggcgcgacctgagactggccagcaatgccatctgctctgctgttcctgtgcattgggtccccacctcccggacaacgtggagcattcacgcccatcaccaatggatgaccacagaagatatgctcaccgtgtggaacagagtctggatcgaggacaatccttggatggaagataaaacacccgtgaccacgtgggaggacgttccgtacctgggcaagcgcgaggatcagtggtgtgggtcccttatcggcctgaccagccgggcgacatgggctcagaacattcctaccgccatccagcaagtgagatctctcattggaaatgaagagttcctggactatatgcccagcatgaaacgctttcggaaggaagaggagtccgaaggcgccatctggtga

SEQ ID NO: 20901 - RNA, 9873 nt, synthetic construct
  misc_feature 1..9873: note = derived and/or modified CDS sequence (opt5) from DENV-3__JQ920476__SS-prME
  source 1..9873: mol_type = other RNA
accagcctgtgcctcatgatgatgctgcccgccacccttgctttccacctgacgagcagagacggagaacctcggatgatcgtggggaagaacgaacgcggaaagtctctcctgtttaagaccgccagcggcattaatatgtgtacccttatcgcgatggatctgggggagatgtgcgacgataccgtgacatacaagtgtccgctcattaccgaagttgagcccgaagacatcgattgctggtgtaacctgacatccacctgggtgacgtatggaacctgcaatcaggctggcgagcatagacgggacaagcgctctgtggccctggcccctcacgttgggatgggactcgatacaagaacccagacatggatgagcgctgagggcgcctggagacaggtggaaaaggttgagacctgggctttccgccatcccggctttacgattctggcccttttcctggcgcactacatcgggacatccctcacccagaaggtggtgatctttattctgcttatgctggtgacaccttctatgaccatgagatgtgttggagtgggcaaccgggacttcgtcgaagggctcagcggagccacctgggtggatgtggtcctggagcatggcgggtgcgttacaacgatggctaagaataagcccaccctggacatcgagctccagaagacagaagccacccagctggctacacttcgcaaactgtgtattgagggaaagatcaccaacgtgacgacagattccagatgccctacccagggcgaagccattctcccggaggaacaggaccagaattatgtgtgtaaacacacctacgtcgatcggggctgggggaacggatgcggcctgtttgggaagggaagccttgtgacatgcgcgaagttccaatgtctggagtctatcgagggcaaagccgttcagcacgaaaatctcaagtataccgtgattatcacagtccatacgggggaccagcaccaggtgggaaacgagacccaaggcgttacagctgaaatcacaccccaggcctccacagtggaggctattctgcctgaatacggcaccctggggctcgagtgcagcccccgcacgggactggactttaatgagatgatccttctgaccatgaaaaacaaggcctggatggtccatagacagtggttctttgatctccctctgccctggacatctggcgccaccacagaaaccccgacgtggaataaaaaggagcttctggtgacattcaaaaacgctcacgcgaagaagcaagaagtcgtggttctcgggtcccaggagggagccatgcacaccgctctgacaggcgccaccgaaattcagaccagcgggggcacatctatctttgccggacatctgaaatgtcggctcaagatggacaaactggagcttaagggcatgtcctatgctatgtgcctgaatgccttcgtgctcaaaaaggaggtcagcgaaacgcagcacgggaccattctgatcaaggtggagtacaaaggagaagatgcgccttgtaagatccccttctccacagaggacggccaagggaaagctcataacggacgcctgattaccgccaaccctatcgttacaaagaaagaggaacccgtgaatattgaggccgaacccccttttggcgagtctaacatcgtcattgggatcggcgataaggctcttaagatcaattggtacaaaaagggaagctccattggcaaaatgttcgaagccaccgctagaggggcccggagaatggcgatcctcggagacacggcctgggattttggcagcgtcgggggagtgctgaactctctgggcaagatggttcaccagattttcgggtccgcttatacagccctctttagcggcgtctcttggatcatgaaaattggaatcggcgtgctgcttacctggattgggctgaatagcaagaacacctccatgtctttcagctgcatcgtgatcggaattatcacactctacctgggcgctgtcgtgcaggccgacatggggtgtgttattaattggaagggaaaagagctgaagtgcggctccgggatctttgtgaccaacgaggtccatacatggacggaacagtataaattccaagcggatagcccgaagcgccttgccaccgctattgccggcgcttgggagaatggagtgtgtggcatccggtctacaaccagaatggaaaacctcctgtggaaacagatcgccaatgagctgaactacattctctgggaaaataacatcaagctgacaattgttgtgggggacgtcatcggagtgcttgagcagggcaaacgcaccctgacgccccagcctatggagctcaagtattcctggaagacctgggggaaagccaagattgttacagctgaaacccaaaatagctcttttatcatcgatggacccaacacacctgagtgccccaacgcgtcccgggcctggaatgtgtgggaagtcgaggactacggcttcggcgtgtttaccacaaacatttggctgaaactgagagaaatgtatacccagctttgtgaccaccgcctcatgagcgctgccgtgaaggatgagcgggccgtccacgctgacatggggtactggatcgagtcccagaaaaatggatcttggaagctggaaaaggccagcctgattgaggttaaaacgtgcacatggccgaagtcccataccctctggtctaacggcgtgctggaaagcgatatgatcattcctaaatcccttgcggggcccatcagccagcacaattacagacctggatatcatacccaaacagctggcccctggcacctggggaagctcgagctggacttcaactactgcgagggaaccacggtggtcatcacagaaaattgtggcacccgcggcccttctctgcggacaaccacagtgtccgggaaacttattcacgagtggtgctgtagaagctgcaccctgcccccgctgcgctatatgggagaagatggctgttggtacgggatggagatccggcctattaacgaaaaggaggagaatatggttaagtctctggtgtccgccggaagcggcaaagccgacaactttacgatgggggtcctctgcctggctatccttttcgaagaggtgatgagaggaaagttcggcaaaaagcatatgattgccggcgcgctgtttaccttcgttctcctgctgtctgggcagatcacatggcgggatatggctcacacccttattatgatcggaagcaatgcctccgaccgcatgggcatgggggtgacatatctggccctcatcgctacctttaaaattcagcccttcctggccctcggatttttcctgagaaaacttacgagccgggaaaacctgctcctgggcgtcgggctggctatggccacaacccttcaactgcccgaggatatcgaacagatggcgaatggaattgccctcggcctgatggctctcaagctgatcacacagtttgagacctaccagctttggaccgccctggtgtctctcatgtgttccaacacaattttcacgctgaccgttgcttggagaacagccaccctgatccttgccgtgatcagcctgctccctgtctgccaatcctctagcatgcgcaaaacagactggctgccgatgaccgtggctgcgatgggcgtgccccctctccccctgtttattttctcccttaaggatacgctgaaacggagatcttggcctctgaatgagggggtcatggccgttggactcgtgagcatcctggcttcctcttttcttcgcaacgacgtgcccatggccggccctctggtcgccgggggactcctgattgcttgttatgtgatcacaggcaccagcgccgatctcaccgttgaaaaggcggctgacgtgacatgggaggaagaggccgaacagaccggggtctcccataacctgatgattacagtggacgatgacggaacgatgagaatcaaagatgacgagaccgagaatatccttacagttctgctgaagaccgccctcctgattgtgagcggcatcttcccctactctattccggctacacttctggtctggcacacctggcagaaacagacgcaacggtccggcgtgctctgggatgtcccttctccccctgaaacccagaaggccgagctggaagagggggtgtaccgcatcaagcagcagggaatttttggcaaaacacaagttggggtgggagtccagaaggagggcgtgttccataccatgtggcacgttacaagaggggcggtgctcacccacaacggaaaacggctggaacccaattgggctaacgtcaagaaagaccttatctcctatggcggcgggtggaagctgtccgcccagtggcaaaagggagaggaagtccaggtgattgccgttgagccgggcaaaaatcctaagaacttccagacaatgcccgggatctttcagacgaccacaggagaaatcggcgctattgccctggatttcaaacctgggaccagcggatctcccatcattaatcgcgagggcaaggtcgtgggcctctacgggaacggagtggtcaccaaaaatggcgggtatgtgtccggaatcgctcaaacaaacgccgagcccgacggccctacgccggaactggaggaagagatgtttaagaagagaaatcttaccattatggatctgcatcccgggagcggcaaaacacggaagtacctccctgcgatcgttcgcgaagccatcaaaagacggctgcgcaccctcattctggctcccacaagagtggtcgccgctgagatggaggaagcccttaagggactgcctatccggtatcagaccacggccacaaaatccgagcacaccggcagagaaattgtggacctgatgtgccatgctaccttcacaatgcgcctcctgagccccgttcgggtgcctaactacaatcttatcgtcatggatgaggcgcactttaccgacccggcctctattgctgccagagggtatatcagcacacgcgtgggaatgggcgaagccgctgccatcttcatgaccgcgacgccccctgggacagctgatgcctttccccagtccaacgcccctattcaggacgaggagcgggacatccccgaaagatcttggaatagcggaaacgagtggattaccgatttcgctggcaagacagtttggtttgtgccgtccatcaaggccgggaacgacattgcgaattgtctgcgcaaaaacggcaagaaagtcatccaactctctcggaagaccttcgatacggaataccagaaaaccaagctgaatgactgggattttgtggtgacaaccgacattagcgagatgggagccaacttcaaggctgatagagtcatcgaccctcgccggtgcctgaaacccgttatcctcacagatggccccgagagagtgattcttgccgggcctatgcccgtgaccgtcgcttccgccgctcagcggcgcggaagagtgggccggaatcctcagaaggaaaacgaccaatacatcttcacagggcagccgctgaataacgatgaggaccatgcccactggaccgaagcgaaaatgctgctcgacaatattaacacgcccgagggaatcattcctgccctgtttgaacccgagcgcgagaagtctgctgccatcgatggcgaatatagacttaaaggggagagccggaagacattcgttgaactgatgagacgcggcgacctccctgtgtggctggctcacaaagtcgcctccgagggaatcaagtacaccgatcggaagtggtgctttgacggcgaaagaaataaccagattctggaggagaatatggatgtggaaatctggaccaaagagggggaaaagaaaaagctccgcccccggtggcttgacgccagaacatatagcgatccgctggctctgaaagagttcaaggactttgcggccggacgcaagtctattgctctcgatctggttaccgaaatcggccgggtgccttcccatcttgcccacagaacacgcaacgccctggacaatctcgtcatgctgcatacgagcgagcacgggggccgggcttaccggcacgccgtggaggaactgcccgagaccatggaaacactccttctgctgggcctcatgattctgcttaccggcggggcgatgctgttcctcatctctggaaaaggcatcgggaagacatccattggactgatctgtgtcgtggccagctccggcatgctgtggatggctgatgttcctctccagtggattgcctctgctatcgtgcttgagtttttcatgatggtgctgctgattcccgagcctgaaaaacaacgcacaccccaggacaaccagctcgcctatgtcgttatcgggattctgacgcttgcggccatcgtggctgccaatgagatgggactgctcgaaaccacaaagagagatctgggcatgagcaaagagtccggcgtggtcagcccgacctcttacctggacgtggacctccatcctgcttccgcctggacactttatgctgttgccaccacggtgatcacacccatgctgcggcacaccattgaaaacagcacagcgaacgtctctctggccgctatcgccaatcaagctgtggtcctcatggggctggataagggatggcccattagcaagatggaccttggcgtgcctctgctcgccctggggtgctactcccaggttaacccgctgaccctcaccgccgcggtgcttctgctggtcacacattacgctatcattggacccggcctccaggccaaagctacgcgcgaggcccagaagagaaccgccgctgggatcatgaaaaatcctacagtggatggaatcatgaccattgacctggatcccgttatctatgactctaagtttgagaaacaacttggccaggtgatgctgctcgtcctgtgtgccgtgcagctgctccttatgcggacaagctgggcgttctgcgaagccctgaccctggctacgggccctattacaaccctctgggaggggtcccccggaaagttttggaacaccacaatcgccgtgtctatggctaatattttcagaggcagctacctggccggggcgggacttgccttttccatcatgaaaagcgttggcaccgggaaacgcggaacaggctctcagggcgaaacgctgggggagaagtggaaaaagaaactcaaccaactgtcccggaaggagttcgatctgtataaaaagagcggaatcaccgaggtcgacagaacagaggctaaggaaggcctcaaacgcggggagattacccaccatgccgtgtcccggggatctgctaaacttcagtggttcgtggaaagaaatatggtcatccctgagggccgggttattgatctggggtgtggacgcggcggctggagctactattgcgccgggctgaaaaaggtgacagaagtgagaggatacaccaaaggcgggccgggacacgaggagcccgtccctatgtccacgtatggctggaacatcgtgaagctcatgtctgggaaggacgtcttttacctgccccctgaaaaatgtgatacccttctgtgcgacattggagagagctcccccagcccgacagtggaagagtctcggaccatccgcgtcctcaagatggtggagccttggctgaaaaataaccagttctgtattaaggttctgaatccctacatgcccacagtgatcgaacacctcgagagacttcagcggaaacatggcggcatgctggtccgcaaccctctgtccagaaatagcacccacgaaatgtattggatctctaacgggacaggaaatattgtgtccagcgtgaacatggtctctcggctcctgcttaaccgctttaccatgacgcatagacggcccacaatcgagaaggatgttgacctgggcgctgggaccagacacgtgaatgccgaacctgagaccccgaacatggacgtgattggagagcgcatccggagaattaaggaagaacacagctccacatggcattacgatgacgaaaatccctataaaacgtgggcgtaccacggctcttatgaggtcaaggccaccgggagcgcttccagcatgatcaacggagtggttaaactcctgacaaagccttgggatgtggtccccatggtgacccaaatggccatgacagacaccacacctttcggccagcagcgcgtttttaaagaaaaggtggatacccggacgcccagaccgatgcctggcacccgcaaggtcatggagatcacagctgagtggctgtggcggaccctcgggagaaataaacgcccccggctgtgcacaagagaagagttcattaagaaagtgcgcaccaacgccgccatgggagcggtttttacggaagagaatcaatgggactccgctcgggccgccgtggaagatgaggagttctggaaacttgtcgacagagaacgcgagctgcataaactcggcaagtgtgggtcttgcgtgtacaacatgatgggaaaaagagaaaagaagctgggcgagtttgggaaagctaagggcagccgggccatctggtatatgtggcttggagctcgctacctggagttcgaagccctcggctttctgaatgaggatcactggttctccagagaaaactctcatagcggggtcgagggagaaggcctgcacaaactcgggtacattctgcgggacatctccaagattcctggaggcgcgatgtatgccgatgacacagctgggtgggacaccagaatcacagaggatgaccttcacaatgaggagaagatcacccagcagatggatcccgagcatcggcagctggccaacgctatttttaagctcacgtaccaaaataaggtggttaaagtgcagcgccctacccccaagggcacagtcatggacatcatttctagaaaagatcagcggggaagcggccaggtggggacctatggactgaacacattcaccaatatggaagcccaacttatccgccagatggagggcgaaggggtgctgtccaaggcggacctcgagaacccgcacctcctggagaaaaaggttacacagtggctcgaaaccaagggagtggagagactgaaacggatggccattagcggcgatgactgcgtcgtgaagcctatcgatgaccgcttcgctaacgcccttctggctctcaatgatatggggaaagttagaaaggacatcccccagtggcaaccctctaaaggctggcatgattggcaacaggtgcctttttgttcccaccacttccatgaactgattatgaaggacggacggaaacttgtcgtgccgtgccgcccccaggacgagctgatcggcagagcccggattagccaaggggctggatggtctctccgcgaaacggcctgtctgggcaaagcgtacgcccagatgtgggctctgatgtattttcacagacgggatctccgcctggcctccaacgccatctgcagcgctgtccctgtgcattgggttcccacatctagaaccacctggtccattcacgcccatcaccagtggatgacaaccgaggacatgcttacagtgtggaatcgggtctggatcgaggataacccttggatggaagacaagacgcccgtgaccacatgggaggatgttccttacctggggaaaagagaagaccaatggtgtggaagcctcattggcctgacctcccgcgcgacatgggctcagaatatccttaccgccatccaacaggtgcggagcctgattgggaacgaggagttcctcgattatatgccctctatgaagagatttcgcaaagaagaggaaagcgagggcgccatctggtga

SEQ ID NO: 20902 - RNA, 9873 nt, synthetic construct
  misc_feature 1..9873: note = derived and/or modified CDS sequence (opt5) from DENV-3__JQ920477__SS-prME
  source 1..9873: mol_type = other RNA
accagcctgtgcctcatgatgatgctgcccgccacccttgctttccacctgacgagcagagacggagaacctcggatgatcgtggggaagaacgaacgcggaaaatctctcctgtttaagaccgccagcggcattaatatgtgtacacttatcgcgatggatctgggggagatgtgcgacgataccgtgacatacaaatgtccgctcattaccgaagttgagcccgaagacatcgattgctggtgtaacctgacatccacctgggtgacgtatggaacctgcaatcaggctggcgagcacagacgggacaagcgctctgtggccctggcccctcacgtggggatgggactcgatacaagaacccagacatggatgagcgctgagggcgcctggagacaggtggaaaaagttgagacctgggctttccgccatcccggctttacgattctggcccttttcctggcgcactacatcgggacatccctcacccagaaggtggtcatctttattctgcttatgctggtgacaccttctatgaccatgagatgtgttggagtgggcaaccgggacttcgtcgaagggctcagcggagccacctgggtggatgtggtcctggagcatggcgggtgcgttacaacgatggctaagaataaacccaccctggacatcgagctccagaagacagaagccacccagctggctacacttcgcaaactgtgtattgagggaaagatcaccaacgtgacgacagattccagatgccctacccagggcgaagccattctcccggaggaacaggaccagaattatgtgtgtaaacacacctacgtcgatcggggctgggggaacggatgcggcctgtttgggaagggaagccttgtgacatgcgcgaagttccaatgtctggagtctatcgagggcaaagccgttcagcacgaaaatctcaagtataccgtgattatcacagtccatacgggggaccagcaccaggtgggaaacgagacccaaggcgttacagctgaaatcacaccccaggcctccacagtggaggctattctgcctgaatacggcaccctggggctcgagtgcagcccccgcacgggactggactttaatgagatgatccttctgaccatgaaaaacaaggcctggatggtccatagacagtggttctttgatctccctctgccctggacatctggcgccaccacagaaaccccgacgtggaataaaaaggagcttctggtgacattcaaaaacgctcacgcgaagaagcaagaagtcgtggttctcgggtcccaggagggagccatgcacaccgctctgacaggcgccaccgaaattcagaccagcgggggcacatctatctttgccggacatctgaaatgtcggctcaagatggacaaactggagcttaagggcatgtcctatgctatgtgcctgaatgccttcgtgctcaaaaaggaggtcagcgaaacgcagcacgggaccattctgatcaaggtggagtacaaaggagaagatgcgccttgtaagatccccttctccacagaggacggccaagggaaagctcataacggacgcctgattaccgccaaccctatcgttacaaagaaagaggaacccgtgaatattgaggccgaacccccttttggcgagtctaacatcgtcattgggatcggcgataaggctcttaagatcaattggtacaaaaagggaagctccattggcaaaatgttcgaagccaccgctagaggggcccggagaatggcgatcctcggagacacggcctgggattttggcagcgtcgggggagtgctgaactctctgggcaagatggttcaccagattttcgggtccgcttatacagccctctttagcggcgtctcttggatcatgaaaattggaatcggcgtgctgcttacctggattgggctgaatagcaagaacacctccatgtctttcagctgcatcgtgatcggaattatcacactctacctgggcgctgtcgtgcaggccgacatggggtgtgttattaattggaagggaaaagagctgaagtgcggctccgggatctttgtgaccaacgaggtccatacatggacggaacagtataaattccaagcggatagcccgaagcgccttgccaccgctattgccggcgcttgggagaatggagtgtgtggcatccggtctacaaccagaatggaaaacctcctgtggaaacagatcgccaatgagctgaactacattctctgggaaaataacatcaagctgacaattgttgtgggggacgtcatcggagtgcttgagcagggcaaacgcaccctgacgccccagcctatggagctcaagtattcctggaagacctgggggaaagccaagattgttacagctgaaacccaaaatagctcttttatcatcgatggacccaacacacctgagtgcccctccgcgctgcgggcctggaacgtgtgggaagtcgaggactacggcttcggcgtgtttaccacaaatatttggctgaaacttagagaaaagtatacccagctctgtgaccaccgcctgatgagcgctgccgtgaaagatgagcgggccgtccacgctgacatggggtactggatcgagtcccagaagaacggatcttggaagctggaaaaagccagcctcattgaggttaagacgtgcacatggccgaaatcccataccctgtggtctaatggcgtgcttgaaagcgatatgatcattcctaagtccctggcggggcccatcagccagcacaactacagacctggatatcatacccaaacagctggcccctggcacctcgggaaactggagctggacttcaattactgcgagggaaccacggtggtcatcacagaaaactgtggcacccgcggcccttctcttcggacaaccacagtgtccgggaagctcattcacgagtggtgctgtagaagctgcaccctgcccccgctgcgctatatgggagaagatggctgttggtacgggatggagatccggcctattaatgaaaaggaggagaacatggttaaatctctcgtgtccgccggaagcggcaagacggacaattttaccatgggggtcctgtgccttgccatcctgttcgaagaggtgatgagaggaaaattcggcaagaaacatatgattgctggcgccctctttacattcgttctgctgctttctgggcagatcacctggcgggatatggcgcacacactgattatgatcggaagcaacgcttccgaccgcatgggcatgggggtgacctatctcgccctgatcgccacgtttaagattcagcccttcctcgctctgggatttttccttagaaagctgacaagccgggaaaatctcctgctgggcgtcgggcttgccatggctaccacactgcaactccccgaggatatcgaacagatggccaacggaattgcgctgggcctcatggccctgaaacttatcacccagtttgagacctaccagctgtggacagctctcgtgtctctgatgtgttccaatacgattttcaccctgacagttgcctggagaaccgctacacttatcctggccgtgatcagcctcctgcctgtctgccaatcctctagcatgcgcaagaccgactggctcccgatgacggtggccgctatgggcgtgccccctctgcccctttttattttctccctgaaagatacactgaagcggagatcttggcctctcaacgagggggtcatggcggttggactggtgagcatccttgcctcctcttttctgcgcaatgacgtgcccatggctggccctctcgtcgccgggggactgctcattgcctgttatgtgatcaccggcaccagcgctgatctgacagttgaaaaagccgcggacgtgacctgggaggaagaggctgaacagacaggggtctcccataaccttatgattacggtggacgatgacggaaccatgagaatcaaggatgacgagacagagaacatcctgaccgttctgctcaaaacagccctgcttattgtgagcggcatcttcccctactctattccggccaccctgctcgtctggcacacgtggcagaagcagacccaacggtccggcgtgctgtgggatgtcccttctccccctgaaacacagaaggctgagctcgaagagggggtgtaccgcatcaaacagcagggaatttttggcaagacccaagttggggtgggagtccagaaagagggcgtgttccatacaatgtggcacgttaccagaggggccgtgctgacacacaatggaaagcggcttgaacccaactgggcgaatgtcaaaaaggacctgatctcctatggcggcgggtggaagctgtccgctcagtggcaaaaaggagaggaagtccaggtgattgccgttgagccgggcaagaaccctaaaaatttccagacgatgcccgggatctttcagaccacaaccggagaaatcggcgccattgctctcgatttcaagcctgggaccagcggatctcccatcattaaccgcgagggcaaagtcgtgggcctgtacgggaatggagtggtcacaaagaacggcgggtatgtgtccggaatcgcccaaacgaatgctgagcccgacggccctaccccggaacttgaggaagagatgtttaagaaaagaaacctgacaattatggatctccatcccgggagcggcaagacccggaaatacctgcctgccatcgttcgcgaagcgatcaagagacggctccgcacactgattcttgcccccaccagagtggtcgctgccgagatggaggaagctctgaaaggactgcctatccggtatcagacgacagccaccaagtccgagcacaccggcagagaaattgtggacctcatgtgccatgccacattcaccatgcgcctgcttagccccgttcgggtgcctaattacaacctgatcgtcatggatgaggctcactttacagacccggcgtctattgccgctagagggtatatcagcacccgcgtgggaatgggcgaagccgccgctatctccatgacggccacaccccctgggaccgcggatgctttcccccagtctaatgcccctattcaggacgaggagcgggacatccccgaaagaagctggaactccggaaatgagtggattacagattttgccggcaagaccgtttggttcgtgccgtctatcaaagctgggaacgacattgccaactgtctccgcaagaatggcaaaaaggtcatccaactgagccggaaaacgtttgataccgaataccagaagacaaagctgaacgactgggatttcgtggtgaccacagacatttccgagatgggagcgaattttaaagccgatagagtcatcgaccctcgccggtgcctcaagcccgttatccttaccgatggccccgagagagtgattctggctgggcctatgcccgtgacagtcgcctctgctgcccagcggcgcggaagagtgggccggaacagccagaaagaaaatgaccaatacatcttcaccgggcagcctctgaacaatgatgaggaccatgctcactggacggaagccaagatgctcctggacaacattaatacaccggagggaatcattcccgcgcttttcgaacctgagcgcgagaaatccgccgctatcgatggcgaatatagactgaagggggagagccggaaaacctttgttgaactcatgagacgcggcgacctgcccgtgtggctggcccacaaggtcgcttctgagggaatcaagtacaccgatcggaaatggtgcttcgacggcgaaagaaacaatcagattctcgaggagaacatggatgtggaaatctggacaaaggagggggagaaaaagaaacttcgccctcggtggctggacgccagaacctattccgatcccctggccctcaaggagtttaaggacttcgctgcgggacgcaaaagcattgccctggatcttgttacagaaatcggccgggtgccgtctcatctggctcacagaacgcgcaatgccctcgacaacctggtcatgctgcatacctccgagcacgggggccgggcctaccggcacgctgtggaggaactccctgagacaatggaaacccttctgctgctcggcctgatgattcttctgacaggcggggccatgctctttctgatcagcggaaagggcatcgggaaaacctccattggactgatctgtgtcgtggcgtctagcggcatgctctggatggccgatgttccccttcagtggattgcttccgccatcgtgctggagttctttatgatggtgctgctcattcctgagcccgaaaagcaacgcacgcctcaggacaatcagctggcttatgtcgttatcgggattcttaccctggccgcgatcgtggccgctaacgagatgggactcctggaaacaaccaaaagagatctgggcatgagcaaggagcccggcgtggtctctccgacatcctacctcgacgtggaccttcatcctgccagcgcttggaccctgtatgccgttgctacgacagtgatcacccccatgctgcggcacacaattgaaaattctaccgccaacgtcagcctcgcggccatcgctaaccaagccgtggtcctgatggggcttgataagggatggcccatttccaaaatggacctgggcgtgcctctcctggctctggggtgctactctcaggttaatccgctcacccttacagccgccgtgctgctgctcgtcacgcattacgcgatcattggacccggcctgcaggctaaggccacccgcgaggctcagaaaagaacagccgccgggatcatgaagaaccctaccgtggatggaatcatgacaattgaccttgatcccgttatctatgacagcaaattcgagaagcaactgggccaggtgatgctcctggtcctgtgtgctgtgcagctccttctgatgcggacctcctgggccttttgcgaagcgctgacgctcgccacaggccctattaccaccctgtgggaggggtctcccggaaagttctggaatacaaccatcgctgtgagcatggccaacatttttagaggctcctaccttgctggggccggactggcgttcagcatcatgaaatctgttggcacagggaagcgcggaacgggctcccagggcgaaaccctcggggagaaatggaagaaaaagctgaatcaactgagccggaaagaatttgatctctataagaagtccggaatcacagaggtcgacagaaccgaggccaaagaaggccttaagcgcggggagattacacaccatgctgtgtctcggggaagcgccaaactgcagtggttcgtggaaagaaacatggtcatccctgagggccgggttattgatctggggtgtggacgcggcggctggtcctactattgcgctgggctcaagaaagtgaccgaagtgagaggatacacgaagggcgggccgggacacgaggagcccgtccctatgtctacctatggctggaatatcgtgaagctgatgagcgggaaagacgttttctaccttccccctgaaaagtgtgatacactgctctgcgacattggagagtccagcccctctccgaccgtggaagagtcccggacaatccgcgtcctgaaaatggtggagccttggctgaagaacaatcagttttgtattaaagttctcaacccctacatgcccaccgtgatcgaacaccttgagagactgcagcggaagcatggcggcatgctggtccgcaatcctctcagcagaaactctacacacgaaatgtattggatctccaatgggaccggaaacattgtgagctctgtgaatatggtcagccggctgcttctgaaccgcttcacgatgacacatagacggcccaccatcgagaaggatgttgacctcggcgccgggaccagacacgtgaacgctgaacctgagacaccgaatatggacgtgattggagagcgcatccggagaattaaagaggaacactcctctacgtggcattacgatgacgaaaacccctataagacctgggcctaccacggcagctatgaggtcaaagcgacagggtccgccagctccatgatcaatggagtggttaagctgctgaccaaaccttgggatgtggtccccatggtgacacaaatggctatgaccgacacaaccccttttggccagcagcgcgttttcaaggaaaaggtggatacgcggacccccagaccgatgcctggcacacgcaaagtcatggagatcaccgccgagtggctctggcggacactggggagaaacaagcgcccccggctttgcaccagagaagagtttattaaaaaggtgcgcacgaatgctgccatgggagccgttttcacagaagagaaccaatgggactctgcgcgggctgccgtggaagatgaggagttttggaaactggtcgacagagaacgcgagctccataagctgggcaaatgtgggagctgcgtgtacaatatgatgggaaagagagaaaagaaacttggcgagttcgggaaggccaaaggctcccgggctatctggtatatgtggctgggagcccgctacctcgagtttgaagctctgggcttcctgaacgaggatcactggttttctagagaaaatagccattccggggtcgagggagaaggcctccacaagctggggtacattcttcgggacatctctaaaattcctggaggcgccatgtatgcggatgacaccgccgggtgggacacaagaatcaccgaggatgacctgcacaacgaggaaaagatcacgcagcagatggatcccgagcatcggcagctcgctaatgccattttcaagctgacctaccaaaacaaagtggttaaggtgcagcgccctacacccaaaggcaccgtcatggacatcattagcagaaaggatcagcggggatccggccaggtggggacatatggacttaatacctttacaaacatggaagctcaactgatccgccagatggagggcgaaggggtgctcagcaaagccgacctggagaatccgcatctgctcgagaagaaggttacccagtggctggaaacgaaaggagtggagagacttaagcggatggcgatttctggcgatgactgcgtcgtgaaacctatcgatgaccgcttcgccaacgctctgctcgccctgaacgatatggggaaggttagaaaagacatcccccagtggcaaccctccaagggctggcatgattggcaacaggtgcctttctgtagccaccactttcatgaacttattatgaaggacggacggaaactggtcgtgccgtgccgcccccaggacgagctcatcggcagagctcggatttctcaaggggccggatggtccctgcgcgaaacagcttgtctgggcaaggcctacgcgcagatgtgggccctcatgtatttccacagacgggatctgcgccttgctagcaatgccatctgctctgccgtccctgtgcattgggttcccacctccagaaccacatggagcattcacgctcatcaccagtggatgaccacagaggacatgctgacggtgtggaaccgggtctggatcgaggataatccttggatggaagacaaaacccccgtgacaacctgggaggatgttccttacctcgggaagagagaagaccaatggtgtggatccctgattggccttacaagccgcgccacctgggcgcagaacatcctgacggctatccaacaggtgcggtctctcattgggaatgaggagtttctggattatatgcccagcatgaaaagattccgcaaggaagaggaatccgagggcgccatctggtga

SEQ ID NO: 20903 - RNA, 9873 nt, synthetic construct
  misc_feature 1..9873: note = derived and/or modified CDS sequence (opt5) from DENV-3__JQ920478__SS-prME
  source 1..9873: mol_type = other RNA
accagcctctgcctcatgatgatgctgcccgccacccttgctttccacctgacgagccgggacggcgaacctcggatgatcgtggggaagaacgaacgcggaaagtctctcctgtttaagaccgccagcggcattaatatgtgtacccttatcgcgatggatctgggggagatgtgcgacgataccgtcacatacaagtgtccgctcattaccgaagttgagcccgaagacatcgattgctggtgtaacctgacatccacctgggtgacgtatggaacctgcaatcaggctggcgagcatcggcgggacaagcgctctgtggccctggcccctcacgtcgggatgggactcgatacaagaacccagacatggatgagcgctgagggcgcctggagacaggtggaaaaggttgagacctgggctttccgccatcccggctttacgattctggcccttttcctggcgcactacatcgggacatccctcacccagaaggtggtcatctttattctgcttatgctggtgacaccttctatgaccatgagatgtgttggagtgggcaaccgggacttcgtcgaagggctcagcggagccacctgggtggatgtggtcctggagcatggcgggtgcgttacaacgatggctaagaataaacccaccctggacatcgagctccagaagacagaagccacccagctggctacacttcgcaaactgtgtattgagggaaagatcaccaacgtgacgacagattccagatgccctacccagggcgaagccattctcccggaggaacaggaccagaattatgtgtgtaaacacacctacgtcgatcggggctgggggaacggatgcggcctgtttgggaagggaagccttgtgacatgcgcgaagttccaatgtctggagtctatcgagggcaaagccgttcagcacgaaaatctcaagtataccgtgattatcacagtccatacgggggaccagcaccaggtgggaaacgagacccaaggcgttacagctgaaatcacaccccaggcctccacagtggaggctattctgcctgaatacggcaccctggggctcgagtgcagcccccgcacgggactggactttaatgagatgatccttctgaccatgaaaaacaaggcctggatggtccatagacagtggttctttgatctccctctgccctggacatctggcgccaccacagaaaccccgacgtggaataaaaaggagcttctggtgacattcaaaaacgctcacgcgaagaagcaagaagtcgtggttctcgggtcccaggagggagccatgcacaccgctctgacaggcgccaccgaaattcagaccagccgggggacatctatctttgccggccatctgaaatgtcgcctcaagatggacaaactggagcttaagggaatgtcctatgctatgtgcctgaatgccttcgtgctcaaaaaggaggtcagcgaaacgcagcacggcaccattctgatcaaggtggagtacaaaggggaagatgcgccttgtaagatccccttctccacagaggacggacaaggcaaagctcataacgggagactgattaccgccaaccctatcgttacaaagaaagaggaacccgtgaatattgaggccgaacccccttttggagagtctaacatcgtcattggcatcggggataaggctcttaagatcaattggtacaaaaagggcagctccattggaaaaatgttcgaagccaccgctcggggcgccagacgcatggcgatcctcggggacacggcctgggattttggaagcgtgggcggggtgctgaactctctgggaaagatggttcaccagattttcggctccgcttatacagccctctttagcggggtctcttggatcatgaaaattggcatcggagtgctgcttacctggattggcctgaatagcaagaacacctccatgtctttcagctgcatcgtgatcgggattatcacactctacctgggagctgtcgtgcaggccgacatgggctgtgttattaattggaaggggaaagagctgaagtgcggatccggcatctttgtgaccaacgaggtccatacatggacggaacagtataaattccaagcggatagcccgaagcggcttgccaccgctattgccggggcttgggagaatggcgtgtgtggaatcagatctacaacccgcatggaaaacctcctgtggaaacagatcgccaatgagctgaactacattctctgggaaaataacatcaagctgacaattgttgtgggcgacgtcatcggggtgcttgagcagggaaaacggaccctgacgccccagcctatggagctcaagtattcctggaagacctggggcaaagccaagattgttacagctgaaacccaaaatagctcttttatcatcgatgggcccaacacacctgagtgcccctccgcgctgagagcctggaacgtgtgggaagtcgaggactacggattcggcgtgtttaccacaaatatttggctgaaacttcgcgaaaagtatacccagctctgtgaccaccggctgatgagcgctgccgtgaaagatgagagagccgtccacgctgacatgggctactggatcgagtcccagaagaacgggtcttggaagctggaaaaagccagcctcattgaggttaagacgtgcacatggccgaaatcccataccctgtggtctaatggagtgcttgaaagcgatatgatcattcctaagtccctggcgggccccatcagccagcacaactaccgccctgggtatcatacccaaacagctggaccctggcacctcggcaaactggagctggacttcaattactgcgaggggaccacggtggtcatcacagaaaactgtggaacccggggcccttctcttagaacaaccacagtgtccggcaagctcattcacgagtggtgctgtcgcagctgcaccctgcccccgctgcggtatatgggggaagatggatgttggtacggcatggagatcagacctattaatgaaaaggaggagaacatggttaaatctctcgtgtccgccgggagcggaaagacggacaattttaccatgggcgtcctgtgccttgccatcctgttcgaagaggtgatgcgggggaaattcggaaagaaacatatgattgctggcgccctctttacattcgttctgctgctttctggccagatcacctggcgcgatatggcgcacacactgattatgatcgggagcaacgcttccgacagaatgggaatgggcgtgacctatctcgccctgatcgccacgtttaagattcagcccttcctcgctctggggtttttccttcggaagctgacaagcagagaaaatctcctgctgggagtcggccttgccatggctaccacactgcaactccccgaggatatcgaacagatggccaacgggattgcgctgggactcatggccctgaaacttatcacccagtttgagacctaccagctgtggacagctctcatttctctgatgtgttccaatacgatcttcaccctgacagtggcctggcgcaccgctacacttatcctggccgttattagcctcctgcctgtgtgccaatcctctagcatgcggaagaccgactggctcccgatgacggtcgccgctatgggcgtgccccctctgcccctttttatcttctccctgaaagatacactgaagagacgctcttggcctctcaacgagggcgtgatggcggtcgggctggttagcattcttgcctcctcttttctgagaaatgacgtgcccatggctggacctctcgtggccggcgggctgctcatcgcctgttatgtcattaccggaaccagcgctgatctgacagtggaaaaagccgcggacgttacctgggaggaagaggctgaacagacaggcgtgtcccataaccttatgatcacggtcgacgatgacgggaccatgcggatcaaggatgacgagacagagaacattctgaccgtgctgctcaaaacagccctgcttatcgttagcggaattttcccctactctatcccggccaccctgctcgtgtggcacacgtggcagaagcagacccaacgctccggcgtcctgtgggatgtgccttctccccctgaaacacagaaggctgagctcgaagagggcgtctacagaattaaacagcaggggatctttggaaagacccaagtgggcgttggggtgcagaaagagggagtcttccatacaatgtggcacgtgacccggggcgccgttctgacacacaatgggaagcgccttgaacccaactgggcgaatgtgaaaaaggacctgatttcctatggaggcggctggaagctgtccgctcagtggcaaaaaggggaggaagtccaggtgatcgccgtggagccgggaaagaaccctaaaaatttccagacgatgcccggcatctttcagaccacaaccggggaaattggagccatcgctctcgatttcaagcctggcaccagcgggtctcccattatcaacagagagggaaaagttgtcggcctgtacggcaatggggtggtgacaaagaacggaggctatgtctccgggattgcccaaacgaatgctgagcccgacggacctaccccggaacttgaggaagagatgtttaagaaacggaacctgacaatcatggatctccatcccggcagcgggaagacccgcaaatacctgcctgccatcgtgagagaagcgattaagcggcgcctcagaacactgatccttgcccccacccgggttgtggctgccgagatggaggaagctctgaaaggcctgcctattagatatcagacgacagccaccaagtccgagcacaccggacgcgaaatcgtcgacctcatgtgccatgccacattcaccatgcggctgcttagccccgtgagagttcctaattacaacctgattgtgatggatgaggctcactttacagacccggcgtctatcgccgctcgcggctatatcagcacccgggtcgggatgggagaagccgccgctattttcatgacggccacaccccctggcaccgcggatgcttttccccagtccaatgcccctatccaggacgaggagagagacattcccgaacgctcttggaacagcgggaatgagtggatcacagatttcgccggaaagaccgtgtggtttgttccgtccattaaagctggcaacgacatcgccaactgtctccggaagaatgggaaaaaggtgattcaactgtctagaaaaacgttcgataccgaataccagaagacaaagctgaacgactgggattttgtcgtgaccacagacatcagcgagatgggcgcgaatttcaaagccgatcgcgtgatcgaccctcggagatgcctcaagcccgtcattcttaccgatggacccgagcgggttatcctggctggccctatgcccgtgacagtggcctccgctgcccagcgcagagggcgggtcggacgcaactctcagaaagaaaatgaccaatacattttcaccggccagcctctgaacaatgatgaggaccatgctcactggacggaagccaagatgctcctggacaacatcaatacaccggaggggattatccccgcgctttttgaacctgagagagagaaaagcgccgctatcgatggagaatatcggctgaagggcgagtccagaaaaaccttcgtggaactcatgcgcagaggggacctgcccgtttggctggcccacaaggtggctagcgagggcattaagtacaccgatagaaaatggtgctttgacggagaacgcaacaatcagatcctcgaggagaacatggatgtcgaaatttggacaaaggagggcgagaagaagaaacttcggcctagatggctggacgcccgcacctattctgatcccctggccctcaaggagttcaaggactttgctgcggggcggaaatccatcgccctggatcttgtgacagaaattggaagagttccgagccatctggctcaccgcacgagaaatgccctcgacaacctggtgatgctgcatacctctgagcacggcgggcgggcctaccgccacgctgtcgaggaactccctgagacaatggaaacccttctgctgctcggactgatgatccttctgacaggcggcgccatgctgttcctgatctccgggaagggaattggcaaaaccagcatcgggctgatttgtgtggtcgcgtcctctggaatgctctggatggccgatgtgccccttcagtggatcgctagcgccattgttctggagtttttcatgatggtgctgctcatccctgagcccgaaaagcaaagaacgcctcaggacaatcagctggcttatgtggtcattggcatccttaccctggccgcgatcgttgccgctaacgagatggggctcctggaaacaaccaaacgggatctgggaatgtccaaggagcccggcgtggtgagcccgacatcttacctcgacgtcgaccttcatcctgcctccgcttggaccctgtatgccgtggctacgacagttattacccccatgctgcgccacacaatcgaaaatagcaccgccaacgtgtctctcgcggccattgctaaccaagccgtcgtgctgatgggccttgataaggggtggcccatcagcaaaatggacctgggagtccctctcctggctctgggctgctactcccaggtgaatccgctcacccttacagccgccgttctgctgctcgtgacgcattacgcgattatcgggcccggactgcaggctaaggccaccagagaggctcagaaacggacagccgccggcatcatgaagaaccctaccgtcgatgggattatgacaatcgaccttgatcccgtgatttatgactctaaatttgagaagcaactgggacaggttatgctcctggtgctgtgtgctgtccagctccttctgatgagaaccagctgggccttctgcgaagcgctgacgctcgccacaggccctatcaccaccctgtgggagggctcccccgggaagttttggaatacaaccattgctgtgtctatggccaacatcttccgcggaagctaccttgctggcgccgggctggcgttttccatcatgaaaagcgtgggaacaggcaagcgggggacgggatctcagggcgaaaccctcggcgagaaatggaagaaaaagctgaatcaactgtccagaaaagagttcgatctctataaaaagagcgggattacagaggttgaccgcaccgaggccaaagaaggacttaagcggggcgagatcacacaccatgctgtctccagagggtctgccaaactgcagtggttcgtggaacggaacatggtgattcctgagggacgcgtcatcgatctgggctgtgggagaggaggctggagctactattgcgctggcctcaagaaagttaccgaagtgcgggggtacacgaagggaggcccggggcacgaggagcccgtgcctatgtccacctatggatggaatattgtcaagctgatgtctggcaaagacgtgttttaccttccccctgaaaagtgtgatacactgctctgcgacatcggggagagctcccccagcccgaccgttgaagagtctcgcacaattagagtgctgaaaatggtcgagccttggctgaagaacaatcagttctgtatcaaagtgctcaacccctacatgcccaccgttatcgaacaccttgagcggctgcagcgcaagcatggaggcatgctggtgagaaatcctctctcccggaacagcacacacgaaatgtattggatttctaatggcaccgggaacatcgtctccagcgtgaatatggtgtctcgcctgcttctgaacagatttacgatgacacatcggagacccaccattgagaaggatgtcgacctcggagccggcacccgccacgttaacgctgaacctgagacaccgaatatggacgtgatcggggagcggattagacgcatcaaagaagaacacagctccacgtggcattacgatgacgaaaacccctataagacctgggcctaccacggatcttatgaggtgaaagcgacaggcagcgcctccagcatgatcaatggggtcgtgaagctgctgaccaaaccttgggatctcgttcccatggtgacacaaatggctatgaccgacacaacccctttcggacagcagcgggtctttaaggaaaaggtggatacgagaacaccccgcccgatgcctggcacacggaaagttatggagattaccgccgagtggctgtggagaacacttggccgcaacaagcggcccagactgtgcacccgcgaagagttcatcaaaaaggtgcggacgaatgctgccatgggggccgtctttacagaagagaaccaatgggactccgcgagagctgccgtggaagatgaggagttctggaaactcgttgaccgcgaaagagagctgcataaacttggaaaatgtggctcttgcgtgtacaatatgatggggaagcgggaaaagaaactgggagagtttggcaaggccaaagggagccgcgctatttggtatatgtggctcggcgccagatacctggagttcgaagctctgggatttctcaacgaggatcactggttctcccgggaaaattctcatagcggcgtcgagggggaaggactgcacaaacttggctacatcctgagagacatttccaaaatccctgggggagccatgtatgcggatgacaccgccggctgggacacacggatcaccgaggatgacctccacaacgaggaaaagattacgcagcagatggatcccgagcatcgccagctggctaatgccatctttaaacttacctaccaaaacaaagtggtcaaggtgcagagacctacacccaaagggaccgttatggacattatctctcggaaggatcagcgcggcagcggacaggtgggcacatatgggctgaataccttcacaaacatggaagctcaactcattagacagatggagggagaaggcgtcctgtccaaagccgacctggagaatccgcacctcctggagaagaaggtgacccagtggcttgaaacgaaaggggtggagcggctgaagcgcatggcgatcagcggagatgactgcgttgtgaaacctatcgatgacagattcgccaacgctctcctggcccttaacgatatgggcaaggtccggaaagacattccccagtggcaaccctctaaggggtggcatgattggcaacaggtgcctttttgttcccaccacttccatgaactgatcatgaaggacggccgcaaactcgttgtgccgtgcagaccccaggacgagctgattggacgggctcgcatcagccaaggcgccgggtggtctctgagagaaacagcttgtctcggaaaggcctacgcgcagatgtgggccctgatgtattttcaccggcgcgatcttagactggcttccaatgccatttgcagcgccgtccctgtgcattgggtccccacctctcggaccacatggtccatccacgctcatcaccagtggatgaccacagaggacatgctcacggtgtggaacagagtttggattgaggataatccttggatggaagacaaaacccccgtgacaacctgggaggatgtcccttacctgggcaagcgcgaagaccaatggtgtgggagccttatcggactgacatcccgggccacctgggcgcagaacatcctcacggctattcaacaggtgagaagcctgatcggcaatgaggagttcctggattatatgccctctatgaaacgctttcggaaggaagaggaaagcgagggggccatttggtga

SEQ ID NO: 20904 - RNA, 9873 nt, synthetic construct
  misc_feature 1..9873: note = derived and/or modified CDS sequence (opt5) from DENV-3__JQ920480__SS-prME
  source 1..9873: mol_type = other RNA
accagcctgtgcctcatgatgatgctgcccgccacccttgctttccacctgacgagcagagacggcgaacctcggatgatcgtggggaagaacgaacgcggaaagtctctcctgtttaagaccgccagcggcattaatatgtgtacacttatcgcgatggatctgggggagatgtgcgacgataccgtgacatacaagtgtccgctcattaccgaagttgagcccgaagacatcgattgctggtgtaacctgacatccacctgggtgacgtatggaacctgcaatcaggctggcgagcatagacgggacaagcgctctgtggccctggcccctcacgtggggatgggactcgatacaagaacccagacatggatgagcgctgagggcgcctggagacaggtggaaaaggttgagacctgggctttccgccatcccggctttacgattctggcccttttcctggcgcactacatcgggacatccctcacccagaaggtggtcatctttattctgcttatgctggtgacaccttctatgaccatgagatgtgttggagtgggcaaccgggacttcgtcgaagggctcagcggagccacctgggtggatgtggtcctggagcatggcgggtgcgttacaacgatggctaagaataagcccaccctggacatcgagctccagaagacagaagccacccagctggctacacttcgcaagctgtgtattgagggaaagatcaccaacgtgacgacagattccagatgccctacccagggcgaagccattctcccggaggaacaggaccagaattatgtgtgtaaacacacctacgtcgatcggggctgggggaacggatgcggcctgtttgggaagggaagccttgtgacatgcgcgaagttccaatgtctggagtctatcgagggcaaagccgttcagcacgaaaatctcaagtataccgtgattatcacagtccatacgggggaccagcaccaggtgggaaacgagacccaaggcgttacagctgaaatcacaccccaggcctccacagtggaggctattctgcctgactacggcaccctggggctcgaatgcagcccccgcacgggactggattttaatgagatgatccttctgaccatgaaaaacaaggcctggatggtccatagacagtggttcctcgacctgcctcttccctggacatctggcgccaccacagagaccccgacgtggaataaaaaggaactgctcgtgacatttaaaaacgctcacgcgaagaagcaagaggtcgtggttctggggtcccaggaaggagccatgcacaccgctctgacaggcgccaccgagattcagaccagcgggggcacatctatcttcgccggacatctcaaatgtcggctgaagatggataaacttgaactgaagggcatgtcctatgctatgtgcctcaatgcctttgtgctgaaaaaggaggtcagcgagacgcagcacgggaccattctgatcaaggtggaatacaaaggagaggacgcgccttgtaagatccccttctccacagaagatggccaagggaaagctcataacggacgccttattaccgccaaccctatcgttacaaagaaagaggagcccgtgaatattgaagccgagccccctttcggcgaatctaacatcgtcattgggatcggcgacaaggctctcaagatcaattggtacaaaaagggaagctccattggcaaaatgtttgaggccaccgctagaggggcccggagaatggcgatcctgggagatacggcctgggacttcggcagcgtcgggggagtgctgaactctctcggcaagatggttcaccagatttttgggtccgcttatacagccctgttcagcggcgtctcttggatcatgaaaattggaatcggcgtgcttctgacctggattgggctcaatagcaagaacacctccatgtcttttagctgcatcgtgatcggaattatcacactgtacctgggcgctgtcgtgcaggccgatatggggtgtgttattaattggaagggaaaagaacttaagtgcggctccgggatcttcgtgaccaacgaggtccatacatggacggagcagtataaatttcaagcggacagcccgaagcgcctcgccaccgctattgccggcgcttgggaaaatggagtgtgtggcatccggtctacaaccagaatggagaacctgctgtggaaacagatcgccaatgaactcaactacattctgtgggagaataacatcaaacttacaattgttgtgggggatgtcatcggagtgctggaacagggcaaacgcaccctcacgccccagcctatggagctgaagtattcctggaagacctgggggaaagccaagattgttacagctgagacccaaaatagctctttcatcatcgacggacccaacacacctgaatgcccctccgcgctgcgggcctggaacgtgtgggaggtcgaagactacggctttggcgtgttcaccacaaatatttggcttaaactcagagagaagtatacccagctgtgtgatcaccgcctgatgagcgctgccgtgaaagacgaacgggccgtccacgctgatatggggtactggatcgagtcccagaagaacgagtcttggaagctcgaaaaagccagcctgattgaggttaagacgtgcacatggccgaaatcccataccctttggtctaatggagtgctggaaagcgacatgatcattcctaagtccctcgcgggccccatcagccagcacaactacagacctgggtatcatacccaaacagctggaccctggcacctgggcaaactggagcttgattttaattactgcgaggggaccacggtggtcatcacagaaaactgtggaacccgcggcccttctctccggacaaccacagtgtccggcaagctgattcacgagtggtgctgtagaagctgcaccctgcccccgctccgctatatgggggaagacggatgttggtacggcatggagatccggcctattaatgaaaaggaggagaacatggttaaatctctggtgtccgccgggagcggaaagacggataatttcaccatgggcgtcctttgcctggccatcctctttgaagaggtgatgagagggaaattcggaaagaaacatatgattgctggcgccctgttcatgtttgttctgcttctgtctggccagatcacatggcgggacatggtgcacaccctcattatgatcgggagcaacgcgtccgatcgcatgggaatgggcgtcacatatctggctctcatcgccaccttcaagattcagccctttctggcccttgggttctttctgagaaagctcacgagccgggaaaatctgctgcttggagtgggcctggctatggccacaaccctccaactgcccgaggacatcgaacagatggctaacgggattgccctcggactgatggcgcttaaactgatcacacagttcgagacctaccagctctggaccgccctgatttctctgatgtgttccaatacaatctttacgcttaccgttgcttggagaacagccaccctgatcctcgctgtgattagcctgctccctgtctgccaatcctctagcatgcgcaagacagattggctgccgatgaccgtggccgccatgggcgtgccccctcttcccctgttcatcttttccctgaaagacacgctcaagcggagatcttggcctctgaacgagggcgtcatggctgttgggcttgtgagcattctggcgtcctctttcctccgcaatgatgtgcccatggccggacctctggtcgctggcgggctcctgatcgcctgttatgtgattacaggaaccagcgccgaccttaccgttgaaaaagctgccgacgtgacatgggaggaagaggcggaacagaccggcgtctcccataacctgatgatcacagtggatgacgatgggacgatgagaatcaaggacgatgagaccgagaacattctgacagttctcctgaaaaccgcccttctgatcgtgagcggaatttttccctactctatcccggccacactcctggtctggcacacctggcagaagcagacgcaacggtccggcgtgctctgggacgtcccttctccccctgaaacccagaaggccgagctggaagagggcgtgtaccgcattaaacagcaggggatcttcggaaagacacaagttggcgtgggggtccagaaagagggagtgtttcataccatgtggcacgttacaagaggcgctgtgcttacccacaatgggaagcggctggaacccaactgggccaatgtcaaaaaggatctgatttcctatggaggcggctggaagctctccgcgcagtggcaaaaaggggaggaagtccaggtgatcgctgttgagccgggaaagaaccctaaaaatttccagacaatgcccggcatcttccagacgaccacaggggaaattggagccatcgccctggactttaagcctggcaccagcgggtctcccattatcaaccgcgagggaaaagtcgtgggcctttacggcaatggggtggtcaccaagaacggaggctatgtgtccgggattgctcaaacaaatgccgagcccgatggacctacgccggaactggaggaagagatgttcaagaaaagaaacctcaccatcatggacctgcatcccggcagcgggaagacacggaaatacctccctgctatcgttcgcgaagccattaagagacggctgcgcacccttatcctggcgcccacaagagtggtcgccgctgagatggaggaagccctgaaaggcctccctattcggtatcagaccacggctacaaagtccgagcacaccggaagagaaatcgtggatctgatgtgccatgccacctttacaatgcgccttctgagccccgttcgggtgcctaattacaacctcattgtcatggacgaggcccacttcaccgatccggcttctatcgcggccagaggctatatcagcacacgcgtggggatgggagaagctgccgccatttttatgaccgctacgccccctggcacagccgacgcgttcccccagtccaatgctcctatccaggacgaggagcgggatattcccgaaagatcttggaacagcgggaatgagtggatcaccgactttgccggaaagacagtttggttcgtgccgtccattaaagccggcaacgatatcgctaactgtctgcgcaagaatgggaaaaaggtcattcaactgtctcggaaaacctttgacacggaataccagaagaccaagctcaacgattgggacttcgtggtgacaaccgatatcagcgagatgggcgccaattttaaagcggacagagtcatcgatcctcgccggtgccttaagcccgttattctgacagacggacccgagagagtgatcctggccggccctatgcccgtgaccgtcgcttccgccgctcagcggcgcgggagagtgggacggaactctcagaaagaaaatgatcaatacattttcacaggccagcctctcaacaatgacgaggaccatgcccactggaccgaagctaagatgctgcttgataacatcaatacgccggaggggattatccccgccctgttcgaacctgagcgcgagaaaagcgcggccatcgacggagaatatagactcaagggcgagtcccggaaaacatttgttgaactgatgagacgcggggatctgcccgtgtggctcgctcacaaggtcgccagcgagggcattaagtacaccgaccggaaatggtgcttcgatggagaaagaaacaatcagatccttgaggagaacatggacgtggaaatttggaccaaggagggcgagaagaagaaactgcgccctcggtggctggatgctagaacatattctgaccccctcgccctgaaggagtttaaggatttcgccgctgggcgcaaatccatcgcgcttgacctggttaccgaaattggacgggtgccgagccatctcgcccacagaacacgcaatgctctggataacctggtcatgctccatacgtctgagcacggcgggagagcctaccggcacgccgtggaggaacttcctgagaccatggaaacactgctgctcctgggacttatgatcctgctcaccggcggcgctatgctgtttctgatctccgggaagggaattggcaaaacaagcatcgggctcatttgtgtcgtggcctcctctggaatgctttggatggcggacgttcccctgcagtggatcgccagcgctattgtgctggagttctttatgatggtgctcctgatccctgagcccgaaaagcaacgcacccctcaggataatcagcttgcctatgtcgttattggcatcctgacgctcgctgccatcgtggcggccaacgagatggggctgctggaaaccacaaaaagagacctcggaatgtccaaggagcccggcgtggtcagcccgacctcttaccttgacgtggatctgcatcctgcttccgcctggacactgtatgctgttgccaccacggtgattacacccatgctccggcacaccatcgaaaatagcacagctaacgtctctctggccgcgattgccaaccaagctgtggtccttatgggcctggacaaggggtggcccatcagcaaaatggatctcggagtgcctctgctggccctcggctgctactcccaggttaatccgcttaccctgaccgctgccgtgctgctcctggtcacacattacgccattatcgggcccggacttcaggcgaaggctacgcgcgaggcccagaaaagaaccgctgccggcatcatgaagaaccctacagtggacgggattatgaccatcgatctggaccccgttatttatgattctaaattcgagaagcaactcggacaggtgatgctgctggtcctctgtgccgtgcagcttctgctgatgcggacaagctgggctttttgcgaagccctcaccctggcgacgggccctatcacaaccctttgggagggctcccccgggaagttctggaataccacaattgccgtgtctatggctaacatctttagaggaagctacctggccggcgctgggctcgccttctccatcatgaaaagcgttggaaccggcaagcgcgggacaggatctcagggcgaaacgctgggcgagaaatggaagaaaaagctgaatcaactctcccggaaagaatttgacctttataaaaagagcgggattaccgaggtcgatagaacagaggcgaaagaaggactgaagcgcggcgagatcacccaccatgccgtgtcccgggggtctgctaaactgcagtggttcgtggaaagaaacatggtcattcctgagggacgggttatcgacctcggctgtgggcgcggaggctggagctactattgcgccggcctgaagaaagtgacagaagtgagagggtacaccaagggaggcccggggcacgaggagcccgtccctatgtccacgtatggatggaatattgtgaaacttatgtctggcaaagatgttttctacctgccccctgaaaagtgtgacaccctcctgtgcgatatcggggagagctcccccagcccgacagtggaagagtctcggaccattcgcgtcctgaaaatggtggagccttggctcaagaacaatcagttttgtatcaaagttcttaacccctacatgcccacagtgatcgaacacctggagagactgcagcggaagcatggaggcatgctcgtccgcaatcctctgtccagaaacagcacccacgaaatgtattggatttctaatggcacagggaacatcgtgtccagcgtgaatatggtctctcggcttctgctcaaccgcttcaccatgacgcatagacggcccacaattgagaaggacgttgacctgggagctggcaccagacacgtgaacgccgaacctgagaccccgaatatggatgtgatcggggagcgcattcggagaatcaaagaggaacacagctccacatggcattacgacgatgaaaacccctataagacgtgggcttaccacggatcttatgaggtcaaagccaccggcagcgcgtccagcatgatcaatggggtggttaagctgctcacaaaaccttgggacgtggtccccatggtgacccaaatggccatgacagataccacaccttttggacagcagcgcgttttcaaggaaaaggtggacacccggacgcccagaccgatgcctggcacccgcaaagtcatggagattacagctgagtggctgtggcggacccttggcagaaacaagcgcccccggctgtgcacaagagaagagtttatcaaaaaggtgcgcaccaatgccgctatgggggccgttttcacggaagagaaccaatgggattccgcccgggcggctgtggaagacgaggagttttggaaactcgtcgatagagaacgcgagctgcataaacttggaaaatgtggctcttgcgtgtacaatatgatggggaagagagaaaagaaactgggagagttcggcaaggccaaagggagccgggccatttggtatatgtggctcggcgctcgctacctggagtttgaagccctgggattcctcaacgaggaccactggttttccagagaaaattctcatagcggcgtcgagggggaaggactgcacaaacttggctacatcctgcgggatatttccaaaatccctgggggagctatgtatgccgacgacacagcgggctgggataccagaatcacagaggacgatctccacaacgaggaaaagattacccagcagatggaccccgagcatcggcagctggccaatgctatcttcaaacttacgtaccaaaacaaagtggttaaggtgcagcgccctacccccaaagggacagtcatggatattatctctagaaaggaccagcggggcagcggacaggtgggcacctatgggctgaatacatttaccaacatggaagcccaactcattcgccagatggagggagaaggcgtgctgtccaaagctgatctggagaatccgcacctcctggagaagaaggttacacagtggcttgaaaccaaaggggtggagagactgaagcggatggccatcagcggagacgattgcgtcgtgaaacctatcgacgatcgcttcgcgaacgccctcctggctcttaacgacatgggcaaggttagaaaagatattccccagtggcaaccctctaaggggtggcatgactggcaacaggtgcctttctgttcccaccactttcatgaactgatcatgaaggacggccggaaactcgtcgtgccgtgccgcccccaggatgagctgattggacgggctcggatcagccaaggcgctgggtggtctctgcgcgaaacggcctgtctcggaaaggcttacgcccagatgtgggcgctgatgtatttccacagacgggaccttcgcctggcctccaatgctatttgcagcgccgtccctgtgcattgggttcccacatctagaaccacctggtccatccacgcccatcaccagtggatgacaaccgaggatatgctcacagtgtggaaccgggtctggattgaggacaatccttggatggaagataaaacgcccgtgaccacatgggaggacgttccttacctgggcaagagagaagatcaatggtgtgggagccttatcggactgacctcccgcgctacatgggcccagaacatcctcaccgcgattcaacaggtgcggagcctgatcggcaatgaggagtttctggactatatgccctctatgaaaagattccgcaaggaagaggaaagcgagggggctatttggtga

SEQ ID NO: 20905 - RNA, 9873 nt, synthetic construct
  misc_feature 1..9873: note = derived and/or modified CDS sequence (opt5) from DENV-3__JQ920479__SS-prME
  source 1..9873: mol_type = other RNA
accagcctgtgcctcatgatgatgctgcccgccacccttgctttccacctgacgtccagagacggagagcctcggatgatcgtggggaagaacgaacgcggaaagtctctcctgtttaagaccgccagcggcattaatatgtgtacacttatcgcgatggatctgggggagatgtgcgacgataccgtgacctacaagtgtccgctcattaccgaagttgagcccgaagacatcgattgctggtgtaacctgacatccacctgggtgacgtatggaacctgcaatcaggctggcgagcatagacgggacaagcgctctgtggccctggcccctcacgtggggatgggactcgatacaagaacccagacatggatgagcgctgagggcgcctggagacaggtggaaaaggttgagacctgggctttccgccatcccggctttacgattctggcccttttcctggcgcactacatcgggacatccctcacccagaaggtggtcatctttattctgcttatgctggtgacaccttctatgaccatgagatgtgttggagtgggcaaccgggacttcgtcgaagggctcagcggagccacctgggtggatgtggtcctggagcatggcgggtgcgttacaacgatggctaagaataagcccaccctggacatcgagctccagaagacagaagccacccagctggctacacttcgcaagctgtgtattgagggaaagatcaccaacgtgacgacagattccagatgccctacccagggcgaagccattctcccggaggaacaggaccagaattatgtgtgtaaacacacctacgtcgatcggggctgggggaacggatgcggcctgtttgggaagggaagccttgtgacatgcgcgaagttccaatgtctggagtctatcgagggcaaagccgttcagcacgaaaatctcaagtataccgtgattatcacagtccatacgggggaccagcaccaggtgggaaacgagacccaaggcgttacagctgaaatcacaccccaggcctccacagtggaggctattctgcctgaatacggcaccctggggctcgagtgcagcccccgcacgggactggactttaatgagatgatccttctgaccatgaaaaacaaggcctggatggtccatagacagtggttcctcgatctgcctcttccctggacatctggcgccaccacagaaaccccgacgtggaataaaaaggagctgctcgtgacatttaaaaacgctcacgcgaagaagcaagaagtcgtggttctggggtcccaggagggagccatgcacaccgctctgacaggcgccaccgaaattcagaccagcgggggcacatctatcttcgccggacatctcaaatgtcggctgaagatggacaaacttgagctgaagggcatgtcctatgctatgtgcctcaatgcctttgtgctgaaaaaggaggtcagcgaaacgcagcacgggaccattctgatcaaggtggagtacaaaggagaagatgcgccttgtaagatccccttctccacagaggacggccaagggaaagctcataacggacgccttattaccgccaaccctatcgttacaaagaaagaggaacccgtgaatattgaggccgaaccccctttcggcgagtctaacatcgtcattgggatcggcgataaggctctcaagatcaattggtacaaaaagggaagctccattggcaaaatgtttgaagccaccgctagaggggcccggagaatggcgatcctgggagacacggcctgggatttcggcagcgtcgggggagtgctgaactctctcggcaagatggttcaccagatttttgggtccgcttatacagccctgttcagcggcgtctcttggatcatgaaaattggaatcggcgtgcttctgacctggattgggctcaatagcaagaacacctccatgtcttttagctgcatcgtgatcggaattatcacactgtacctgggcgctgtcgtgcaggccgacatggggtgtgttattaattggaagggaaaagagcttaagtgcggctccgggatcttcgtgaccaacgaggtccatacatggacggaacagtataaatttcaagcggatagcccgaagcgcctcgccaccgctattgccggcgcttgggagaatggagtgtgtggcatccggtctacaaccagaatggaaaacctgctgtggaaacagatcgccaatgagctcaactacattctgtgggaaaataacatcaaacttacaattgttgtgggggacgtcatcggagtgctggagcagggcaaacgcaccctcacgccccagcctatggagctgaagtattcctggaagacctgggggaaagccaagattgttacagctgaaacccaaaatagctctttcatcatcgatggacccaacacacctgagtgcccctccgcgctgcgggcctggaacgtgtgggaagtcgaggactacggctttggcgtgttcaccacaaatatttggcttaaactcagagaaaagtatacccagctgtgtgaccaccgcctgatgagcgctgccgtgaaagatgagcgggccgtccacgctgacatggggtactggatcgagtcccagaagaacgaatcttggaagctcgagaaagccagcctgattgaagttaagacgtgcacatggccgaaatcccataccctttggtctaatggagtgctggagagcgatatgatcattcctaagtccctcgcgggccccatcagccagcacaactacagacctgggtatcatacccaaacagctggaccctggcacctgggcaaactggagcttgactttaattactgcgaagggaccacggtggtcatcacagagaactgtggcattcgcggcccttctctccggaccacaaccgtgtccggcaagctgatccacgaatggtgctgtagaagctgcacactgcccccgctccgctatatgggggaggatggatgttggtacggcatggaaattcggcctatcaatgagaaggaggaaaacatggttaaatctctggtgtccgccgggagcggaaagaccgacaatttcacgatgggcgtcctttgcctggccattctctttgaggaagtgatgagagggaaattcggaaagaaacatatgatcgctggcgccctgttcatgtttgttctgcttctgtctggccagattacctggcgggatatggtgcacacactcatcatgatcgggagcaacgcgtccgaccgcatgggaatgggcgtcacctatctggctctcattgccacattcaagatccagccctttctggcccttgggttctttctgagaaagctcaccagccgggagaatctgctgcttggagtgggcctggctatggccacgacactccaactgcccgaagatattgagcagatggctaacgggatcgccctcggactgatggcgcttaaactgattacccagttcgagacataccagctctggaccgccctgatctctctgatgtgttccaataccatctttacacttacggttgcttggagaaccgccacactgattctcgctgtgatcagcctgctccctgtctgccaatcctctagcatgcgcaagaccgactggctgccgatgacagtggccgccatgggcgtgccccctcttcccctgttcatttttagcctgaaagataccctcaagcggagatcttggcctctgaacgaaggcgtcatggctgttgggcttgtgagcatcctggcgtcctctttcctccgcaatgacgtgcccatggccggacctctggtcgctggcgggctcctgattgcctgttatgtgatcacgggaacaagcgccgatcttaccgttgagaaagctgccgacgtgacctgggaagaggaagcggagcagacaggcgtctcccataacctgatgatcaccgtggacgatgacgggacaatgagaattaaggatgacgagacggaaaacatcctgaccgttctcctgaaaacagcccttctgattgtgagcggaatctttccctactctattccggccaccctcctggtctggcacacatggcagaagcagacccaacggtccggcgtgctctgggatgtcccttctccccctgagacgcagaaggccgaactggaggagggcgtgtaccgcatcaaacagcaggggattttcggaaagacccaagttggcgtgggggtccagaaagaaggagtgtttcatacaatgtggcacgttaccagaggcgctgtgcttacacacaatgggaagcggctggagcccaactgggccaatgtcaaaaaggacctgatctcctatggaggcggctggaagctctccgcgcagtggcaaaaaggggaagaggtccaggtgatcgctgttgaaccgggaaagaaccctaaaaatttccagaccatgcccggcattttccagacaacgaccggggagatcggagccattgccctggattttaagcctggcacaagcgggtctcccatcattaaccgcgagggaaaagtcgtgggcctttacggcaatggggtggtcaccaagaacggaggctatgtgtccgggatcgctcaaaccaatgccgaacccgacggacctacaccggagctggaagaggaaatgttcaagaaaagaaacctcacgatcatggatctgcatcccggcagcgggaagacccggaaatacctccctgctattgttcgcgaggccatcaagagacggctgcgcacacttattctggcgcccaccagagtggtcgccgctgagatggaagaggccctgaaaggcctccctatccggtatcagacaaccgctacgaagtccgaacacacaggaagagagattgtggacctgatgtgccatgccacctttaccatgcgccttctgagccccgttcgggtgcctaattacaacctcatcgtcatggatgaagcccacttcacagacccggcttctatcgcggccagaggctatattagcacccgcgtggggatgggagaggctgccgccatctttatgacagctacaccccctggcacggccgatgcgttcccccagtccaatgctcctattcaggacgaggaacgggacatccccgagagatcttggaacagcgggaatgaatggattacagattttgccggaaagaccgtttggttcgtgccgtccatcaaagccggcaacgacattgctaactgtctgcgcaagaatgggaaaaaggtcatccaactgtctcggaaaacatttgataccgagtaccagaagacgaagctcaacgactgggatttcgtggtgaccacagacatcagcgagatgggcgccaattttaaagcggatagagtcattgaccctcgccggtgccttaagcccgttatcctgaccgatggacccgaaagagtgattctggccggccctatgcccgtgacagtcgcttccgccgctcagcggcgcgggagagtgggacggaactctcagaaagagaatgaccaatacatcttcaccggccagcctctcaacaatgatgaagaccatgcccactggacagaggctaagatgctgcttgacaacattaataccccggaagggatcatccccgccctgttcgagcctgagcgcgaaaagagcgcggccattgatggagagtatagactcaagggcgagtcccggaaaacgtttgttgagctgatgagacgcggggacctgcccgtgtggctcgctcacaaggtcgccagcgaaggcatcaagtacacagatcggaaatggtgcttcgacggagagagaaacaatcagattcttgaggaaaacatggatgtggagatctggaccaaggaaggcgagaaaaagaaactgcgccctcggtggctggacgctagaacctattctgatcccctcgccctgaaggaatttaaggacttcgccgctgggcgcaaatccattgcgcttgatctggttacagagatcggacgggtgccgagccatctcgcccacagaacccgcaatgctctggacaacctggtcatgctccatacatctgagcacggcgggagagcctaccggcacgccgtggaagaacttcctgaaacgatggagaccctgctgctcctgggacttatgatcctgctcacaggcggcgctatgctgtttctgatttccgggaagggaatcggcaaaaccagcattgggctcatctgtgtcgtggcctcctctggaatgctttggatggcggatgttcccctgcagtggattgccagcgctatcgtgctggagttctttatgatggtgctcctgattcctgaacccgagaagcaacgcacacctcaggacaatcagcttgcctatgtcgttatcggcatcctgaccctcgctgccattgtggcggccaacgaaatggggctgctggagacgaccaaaagagatctcggaatgtccaaggaacccggcgtggtcagcccgacatcttaccttgacgtggacctgcatcctgcttccgcctggaccctgtatgctgttgccacaaccgtgatcacgcccatgctccggcacacaattgagaatagcaccgctaacgtctctctggccgcgatcgccaaccaagctgtggtccttatgggcctggataaggggtggcccattagcaaaatggacctcggagtgcctctgctggccctcggctgctactcccaggttaatccgcttacactgaccgctgccgtgctgctcctggtcacccattacgccatcatcgggcccggacttcaggcgaaggctacacgcgaggcccagaaaagaacggctgccggcattatgaagaaccctaccgtggatgggatcatgacaattgacctggatcccgttatctatgactctaaattcgaaaagcaactcggacaggtgatgctgctggtcctctgtgccgtgcagcttctgctgatgcggaccagctgggctttttgcgaggccctcacactggcgaccggccctattacgacactttgggaaggctcccccgggaagttctggaataccaccatcgccgtgtctatggctaacatctttagaggaagctacctggccggcgctgggctcgccttctccattatgaaaagcgttggaacaggcaagcgcgggaccggatctcagggcgagacactgggcgaaaaatggaagaaaaagctgaatcaactctcccggaaagagtttgatctttataaaaagagcgggatcacggaggtcgacagaaccgaagcgaaagagggactgaagcgcggcgaaattacacaccatgccgtgtcccgggggtctgctaaactgcagtggttcgtggagagaaacatggtcatccctgaaggacgggttattgatctcggctgtgggcgcggaggctggagctactattccgccggcctgaagaaagtgaccgaggtgagagggtacacaaagggaggcccggggcacgaggaacccgtccctatgtctacctatggatggaatatcgtgaaacttatgagcggcaaagacgttttctacctgccccctgagaagtgcgatacgctcctgtgtgacattggggaatccagcccctctccgaccgtggaggagtcccggacaatccgcgtcctgaaaatggtggaaccttggctcaagaacaatcagttttgcatcaaagttcttaacccctacatgcccaccgtgattgagcacctggaaagactgcagcggaagcatggaggcatgctcgtccgcaatcctctgagcagaaactctacacacgagatgtattggatctccaatggcaccgggaacattgtgagctctgtgaatatggtcagccggcttctgctcaaccgcttcacaatgacccatagacggcccacgatcgaaaaggatgttgacctgggagctggcacaagacacgtgaacgccgagcctgagaccccgaatatggacgtgattggggaacgcatccggagaatcaaagaggaacactcctctacctggcattacgatgacgagaacccctataagacatgggcttaccacggaagctatgaagtcaaagccacgggctccgcgagctccatgattaatggggtggttaagctgctcaccaaaccttgggatgtggtccccatggtgacacaaatggccatgaccgacacaaccccttttggacagcagcgcgttttcaaggagaaggtggatacacggacccccagaccgatgcctggcacgcgcaaagtcatggagatcaccgctgaatggctgtggcggacacttggcagaaacaagcgcccccggctgtgtaccagagaggaatttattaaaaaggtgcgcacaaatgccgctatgggggccgttttcaccgaggaaaaccaatgggactctgcccgggcggctgtggaggatgaggaattttggaaactcgtcgacagagagcgcgaactgcataaacttggaaaatgcggcagctgtgtgtacaatatgatggggaagagagagaagaaactgggagagttcggcaaggccaaagggtcccgggccatctggtatatgtggctcggcgctcgctacctggaatttgaggccctgggattcctcaacgaagatcactggttttctagagagaatagccattccggcgtcgaaggggagggactgcacaaacttggctacattctgcgggacatctctaaaatccctgggggagctatgtatgccgatgacacggcgggctgggacacaagaattaccgaggatgacctccacaacgaagagaagatcacacagcagatggatcccgaacatcggcagctggccaatgctattttcaaacttacctaccaaaacaaagtggttaaggtgcagcgccctacgcccaaagggaccgtcatggacatcattagcagaaaggatcagcggggctccggacaggtgggcacatatgggctgaatacctttacaaacatggaggcccaactcatccgccagatggaaggagagggcgtgctgagcaaagctgacctggagaatccgcacctcctggaaaagaaggttacccagtggcttgagacaaaaggggtggaaagactgaagcggatggccatctctggagatgactgcgtcgtgaaacctattgatgaccgcttcgcgaacgccctcctggctcttaacgatatgggcaaggttagaaaagacatcccccagtggcaaccctccaaggggtggcatgattggcaacaggtgcctttctgcagccaccactttcatgagctgattatgaaggacggccggaaactcgtcgtgccgtgtcgcccccaggacgaactgatcggacgggctcggatttctcaaggcgctgggtggtccctgcgcgagaccgcctgcctcggaaaggcttacgcccagatgtgggcgctgatgtatttccacagacgggatcttcgcctggccagcaatgctatctgttctgccgtccctgtgcattgggttcccacgtccagaacaacctggagcattcacgcccatcaccagtggatgaccacagaggacatgctcaccgtgtggaaccgggtctggatcgaagataatccttggatggaggacaaaacacccgtgacgacctgggaagatgttccttacctgggcaagagagaggaccaatggtgcgggtcccttatcggactgacaagccgcgctacctgggcccagaacattctcacagcgatccaacaggtgcggtctctgattggcaatgaggaatttctggattatatgcccagcatgaaaagattccgcaaggaggaagagtccgaaggggctatctggtga

SEQ ID NO: 20906 - RNA, 9873 nt, synthetic construct
  misc_feature 1..9873: note = derived and/or modified CDS sequence (opt5) from DENV-3__KU216208__SS-prME
  source 1..9873: mol_type = other RNA
accagcctgtgcctcatgatgatcctgcccgccgctcttgccttccacctgacgtcccgggacggagaacctcggatgattgtggggaagaacgaacgcggaaagtctctcctgtttaagacggcgagcggcatcaatatgtgtacccttattgctatggatctgggggagatgtgcgacgatacagtcacctacaaatgtccgcacatcacagaagttgagcccgaagacattgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctggattgatgtggtgctggagcacggcgggtgcgtcaccacaatggccaagaataaacccacgctggacatcgagctccagaagaccgaagctacacaactggccacccttcgcaaactgtgtattgagggaaagatcacaaacattaccacggattccagatgccctacacagggcgaagcggttctcccggaggaacaggaccagaattatgtgtgtaaacacgcctacgtggatcggggctgggggaacggatgcggcctgttcgggaagggaagccttgtgacatgcgctaagtttcaatgtctggagcccatcgagggcaaagtggttcagtatgaaaatctcaagtacaccgtgatcattacagtccataccggggaccagcaccaggtgggaaacgagacacaaggcgttacggccgaaatcacccctcaggcttctacaaccgaggccattctgcccgaatatggcacactggggctcgagtgctcccctcgcaccggactggacttcaatgagatgatccttctgacgatgaaaaacaaggcctggatggtgcatagacagtggtttttcgatctccccctgccgtggaccagcggcgctacaaccgaaacacctacctggaatcggaaagagcttctggtcacgtttaagaacgcgcacgccaaaaagcaagaagtggtcgtgctcgggtctcaggagggagctatgcacacagccctgaccggcgccacagaaattcaaaattccgggggcaccagcatcttcgctggacatctgaagtgtcgcctcaaaatggacaagctggagcttaaaggcatgtcttacgccatgtgcaccaacacatttgttctgaagaaagaggtgtccgaaacgcagcacgggaccatcctcattaaggtcgagtacaagggagaagatgcgccctgtaaaatccctttcagcacagaggacggccaagggaaggctcataacggaagactgattaccgccaatcccgtggttaccaagaaggaggaacccgtgaacatcgaggccgaacctccgttcggcgagtccaatattgtcatcgggatcggcgataacgctctgaaaattaattggtataagaagggatctagcatcggcaaaatgtttgaagccaccgctagaggggccagacgcatggcgattcttggagacacggcctgggatttcggctccgtcgggggagtgctcaacagcctgggcaagatggttcaccagatctttgggtctgcttacacagccctgttctccggcgtcagctgggtgatgaaaattggaatcggcgtgctcctgacctggattgggcttaattctaagaacaccagcatgtccttttcttgcatcgctatcggaattatcacactgtatctcggcgccgtcgtgcaggcggacatggggtgtgttgtgaattggaaaggaaaggagctgaagtgcggcagcgggattttcgtcaccaacgaggtgcatacatggacggaacagtacaaatttcaagccgattcccccaagcggctggctaccgccatcgctggcgcctgggagaatggagtttgtggcattagaagcacaacccgcatggaaaaccttctctggaaacagatcgccaatgagctgaactatatcctgtgggaaaataacattaagctcacagtggtcgtgggggacaccatcggagttctggagcagggcaaacggacgcttacccctcagcccatggagctgaagtactcttggaaaacatgggggaaggctaagattgtgaccgcggaaacacaaaactccagcttcatcattgatggacctaatacccccgagtgcccgtctgcctccagagcttggaacgtctgggaagtggaggactatggctttggcgtgttcacaaccaatatctggctcaaactgcgcgaagtctacacgcagatgtgtgaccaccggctgatgagcgccgccgttaaggatgagagagctgtgcacgccgacatggggtactggatcgagtcccagaaaaacggatcttggaaacttgaaaaagcgagcctcattgaggtgaagacatgcacctggcctaagtcccataccctgtggtctaatggcgtcctggaaagcgatatgatcattcccaaatccctcgctgggcctatcagccagcacaactatcgccccggataccatacacaaaccgccggcccttggcacctggggaaacttgagctggactttaattattgcgagggaacgacagtggttattaccgaaaactgtggcacacggggcccctctctcagaaccacaaccgtgtccgggaaactgatccacgagtggtgctgtcgcagctgcacgctgccgcctcttcggtacatgggagaagatggctgttggtatgggatggagatcagacccatttctgaaaaggaggagaatatggtcaaatccctcgtgagcgccggatctggcaaggttgacaacttcaccatgggggtgctgtgcctggctatcctctttgaagaggtcatgcggggaaagttcggcaaaaagcatatgattgccggcgtgttctttacattcgttctgcttctgagcgggcagatcacctggcgcgatatggcgcacacactcattatgatcggatccaatgctagcgacagaatgggcatgggggtgacctacctggccctgattgccacgtttaaaatccagcccttccttgctctgggatttttcctccggaagctgacatctagagaaaacctcctgcttggcgtcgggctggccatggctaccacactccaactgcctgaggatatcgaacagatggccaatggaattgcgctgggccttatggccctgaaactcatcacccagtttgagacctatcagctgtggacagctctcatttccctgacgtgtagcaacaccatcttcacacttaccgtggcctggcgcacagctaccctgattctcgccggcgtgtccctgctgccggtctgccaatctagctccatgcggaagacggactggcttcccatgacagttgccgctatgggggtgcctcccctgcctctctttatcttctctctgaaggataccctcaaaagacgcagctggcccctgaatgagggagtgatggcggtcggccttgtgtccatcctggcctctagcctgctcagaaacgacgttcctatggctgggcccctggtggccggaggccttctgattgcctgttacgtcatcaccgggacatccgctgatctcaccgtggaaaaggccgcggacgttacatgggaggaagaggctgaacagacgggagtgagccataacctgatgattaccgtcgacgatgacggcacaatgcggatcaaagatgacgagaccgagaatattctcacagtgctgcttaagaccgccctgctgatcgtctctggcatctttccgtactccattcctgccacgctcctggtgtggcacacctggcagaaacagacacaacgcagcggggttctttgggatgtgccctctcctcccgaaacccagaaggctgagctggaagagggagtctatagaatcaaacagcagggcattctcgggaagacacaagtgggagttggcgtgcagaaggagggggtcttccataccatgtggcacgtgacacggggagccgtgctgacgcacaacggcaaacgcctcgaaccgaattgggcgtccgttaagaaagacctgatcagctacggcgggggatggagactttctgctcagtggcaaaagggcgaggaagtccaggtgattgccgtggagcctgggaaaaaccccaagaattttcagaccatgcctggaacattccagaccaccacaggcgaaatcggggccattgctctggatttcaagcccggaacgtccggcagccccatcatcaaccgggagggcaaagtcgtggggctgtatggaaatggcgttgtgaccaagaacgggggatacgtctccggcattgcccaaacaaatgctgagcctgacgggccgacccccgaactcgaggaagagatgtttaaaaagcgcaacctgacaatcatggatcttcatcctggcagcggaaaaaccagaaagtatctgcccgccattgtgcgggaagcgatcaagcgcagactccggacgctgattctcgcccctacaagagttgtggctgccgagatggaggaagctctgaaaggccttcccatccgctaccagaccaccgccacaaagtctgagcacaccgggcgggaaatcgtcgacctgatgtgccatgccacattcaccatgagactgctcagccctgtgcgcgttccgaattataacctgattatcatggatgaggctcactttacggaccccgcgtccattgccgctcggggatacatctctacaagagtgggcatgggggaagccgccgctattttcatgaccgccacacctcccggaaccgcggatgcttttcctcagagcaatgcccccatccaggacgaggagcgcgacatcccggaacggtcctggaactctggcaatgagtggattacggatttcgccgggaaaaccgtctggtttgtgcctagcatcaaggctggcaacgacattgccaactgtcttagaaagaatggaaagaaggtgatccaactgtcccgcaaaacattcgaaaccgagtaccagaagacaaaactcaacgattgggactttgtcgttaccacagatatttctgagatgggcgcgaatttcaaggccgaccgggtgatcgatcccagacggtgcctgaaacccgtgattctgaccgacgggcctgaacgcgtcatcctcgctggacccatgcctgtgacggccgctagcgccgctcagagacggggccgcgttgggagaaacccgcagaaggagaatgatcaatatatctttacaggacagccccttaacaatgacgaagatcatgcccactggaccgaggcgaagatgctgctggacaacattaatacccctgaaggcatcattcccgccctcttcgagcctgagcgggaaaaatccgctgccatcgacggggagtacagactgaagggcgaaagccgcaaaacattcgtggagcttatgcggagaggagatctgcccgtctggctcgcttataaggtggcctctgaaggcattaaatacaccgaccgcaagtggtgctttgatgggcagcggaacaatcagatcctggaggagaacatggacgttgaaatctggacaaaagagggagaaaagaagaaactgagaccgcgctggctcgatgcccggacgtattccgaccctcttgctctgaaggagttcaaagattttgcggccggcagaaagagcattgctctggacctcgtgaccgaaatcgggcgcgtcccctctcacctggcccatagaacacggaatgcccttgataacctggtgatgctccacacctccgagcatggaggccgcgcttacagacacgccgtcgaggaactgcctgagacaatggaaaccctgctccttctgggcctgatgattctcctgacagggggagcgatgcttttcctgatcagcggcaaagggattggaaagacctccatcggcctcatctgtgtgattgcctctagcgggatgctgtggatggctgagatccccctgcaatggattgcctccgctatcgttctcgagtttttcatgatggtgcttctgattcctgaacccgagaagcagcggacaccgcaggacaatcaactggcctatgtggtcatcggcattctcaccctggcggccatcatcgctgccaacgaaatgggccttctggagacaaccaaacgcgatctcggcatgagcaaggaacctggggttgtgtctcccacgtcctacctggacgtggatctgcaccccgctagcgcctggacactctacgctgtcgccaccacagtgattacccctatgcttagacataccatcgaaaattctacagcgaacgttagcctggccgctattgccaaccaggctgtggtcctgatgggactcgacaaaggctggccgatctccaagatggacctgggggtgccccttctggccctcggatgctattctcaggtcaatcctctgacgctgaccgccgcggtgctccttctgattacacactacgctatcatcggccccgggctgcaggccaaagctacccgggaggcccaaaagagaacagccgctggaattatgaagaaccctaccgttgatggcatcattacgatcgacctcgatcccgtgatttatgacagcaaatttgagaagcagctgggccaggtcatgcttctggtgctctgtgccgttcagctgctgctcatgcgcacatcctgggcgctttgcgaggccctgaccctggctaccgggcctatcacaaccctctgggaaggatctccgggcaaattctggaatacaacgatcgccgtgagcatggctaacatttttcgggggtcctacctggccggagcgggccttgccttcagcatcatgaagtctgtcgggaccggaaaaagaggcacaggctcccaaggggagaccctgggagaaaagtggaagaaaaagctcaatcagctgagccgcaaagagtttgatctgtataagaaatccggcattacagaggtggaccggaccgaagctaaggaggggctcaaaagaggagaaacgacccatcacgccgtgtctcggggcagcgctaaacttcagtggttcgttgagcgcaacatggtcatccccgaagggagagtgattgatctgggatgtggccggggcgggtggtcctactattgcgccggactgaagaaagtgacagaggtccgcggctacaccaaagggggacctggccatgaggaacccgttcctatggctacatacgggtggaatatcgtgaaactcatgtctggaaaggacgtgttttatctgcccccggagaaatgtgatacccttctgtgcgacattggcgaaagctcccctagccccacagtcgaggagtctagaaccatccgggtgctcaagatggttgaaccctggctgaagaacaatcagttctgtatcaaagtgctgaacccttacatgcccgccgtcattgagcacctcgaacgccttcaaagaaagcacggcgggatgctggtgcggaatcctctgtcccgcaacagcacgcatgagatgtattggatctctaatggaacaggcaacattgtttccagcgtgaatatggtctctagactcctgcttaaccggttcaccatgacccacagacgcccgacaatcgaaaaagatgtggacctgggggcgggaacgcggcatgtgaacgccgagcccgagacccctaatatggatgtcattggcgaaagaatcaagcgcatcaaagaggaacacaacagcacatggcactacgacgacgagaatccctataagacctgggcttaccatgggtcctatgaagttaaggccacaggatctgctagctccatgattaacggcgtggtgaaactcctgaccaagccttgggatgtcgtgcccatggttacacagatggccatgaccgacacgaccccgtttggccagcaacgggtgttcaaagagaaggtcgatacaagaacccctcgccccatgcctgggacacggaaagtgatggagatcaccgccgaatggctgtggagaacgctcggacgcaataagcggcccagactgtgcacacgcgaggaatttaccaagaaagttcggacaaacgcggctatgggcgccgtgttcaccgaggaaaatcagtgggacagcgccaaggctgccgtcgaggatgaggaattttggaaacttgtggacagagagcgcgaactgcacaagctcgggaaatgtggatcctgcgtttacaacatgatgggcaagagagagaaaaagctgggggagttcggcaaggctaaaggatctcgggccatttggtacatgtggcttggcgcgcgctatctggaatttgaggccctcgggttcctgaatgaagatcattggtttagcagagagaactcctactctggagtggaaggcgaggggctgcacaagctcggatatatcctgcgggacattagcaaaatccctggcggggctatgtacgccgatgacacggctggctgggataccagaatcacagaggacgaccttcataatgaagagaagattacccagcagatggatcccgaacaccggctgctcgccaacgcgatcttcaaactgacatatcaaaataaggtcgtgaaggtccagcgcccgacccctacaggaaccgtgatggacattatctccagaaaagatcagcggggctctgggcaggttggaacgtacggccttaacacatttaccaatatggaggcccaactggtgcgccagatggaaggggagggagtcctcagcaaggctgacctggagaacccccatctgcccgagaagaagattacccagtggctcgagacaaaaggcgtggaaagactgaagcggatggccatctccggggatgactgcgtggttaagcctatcgatgaccgcttcgctaacgcccttctggctctcaatgatatgggcaaagtgagaaaggacattccgcagtggcaacccagcaaaggatggcatgattggcagcaggtccctttttgttctcaccatttccacgagctgatcatgaaggacggccggaaacttgtggttccctgccgccctcaggatgaactgattgggagagcccggatctcccaaggagcgggctggagcctccgcgagaccgcctgtctggggaaggcttatgcccagatgtggtctctgatgtacttccacagacgggacctccgcctggcctccaacgctatttgcagcgccgtgcccgtccattgggtgcctacatctagaacgacctggtccatccacgcgcatcaccagtggatgacaaccgaggacatgcttacagtctggaatcgggtgtggattgaagataacccctggatggaggacaagaccccggttacgacctgggaaaatgtgccttacctgggaaaaagagaggatcaatggtgtggcagcctcatcgggctgacatcccgcgctacctgggcccagaacatccccacagccattcagcaggtccggagccttatcggcaatgaggaatttctggactatatgccttctatgaagagattccgcaaagaggaagagagcgaaggagctatttggtga

SEQ ID NO: 20907 - RNA, 9873 nt, synthetic construct
  misc_feature 1..9873: note = derived and/or modified CDS sequence (opt5) from DENV-3__GU370053__SS-prME
  source 1..9873: mol_type = other RNA
acaagcctgtgcctcatgatgatcctgcccgccgctcttgccttccacctgacatcccgggacggagaacctcggatgattgtggggaagaacgaacgcggaaaatctctcctgtttaagacggcgagcggcatcaatatgtgtacccttattgctatggatctgggggagatgtgcgacgatacagtgacctacaaatgtccgcatatcacagaagttgagcccgaagacattgattgctggtgtaacctcacctccacatgggtgacctatggaacgtgcaatcaggccggcgagcaccggcgggacaagcgctctgtggccctggctcctcatgtggggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtgggccagcggcgctacaaccgaaacacctacctggaatcggaaagagcttctggtgacgtttaagaacgcgcacgccaaaaagcaagaagtcgtggttctcgggtctcaggagggagctatgcacacagccctgaccggcgccacagaaatccaaaattccgggggcaccagcattttcgctggacatctgaagtgtcgcctcaaaatggacaagctggagcttaaaggcatgtcttacgccatgtgcaccaacacatttgtgctgaagaaagaggtctccgaaacgcagcacgggaccatcctcatcaaggtggagtacaagggagaagatgcgccctgtaaaattcctttcagcacagaggacggccaagggaaggctcataacggaagactgatcaccgccaatcccgttgtgaccaagaaggaggaacccgtcaacattgaggccgaacctccgttcggcgagtccaatatcgtgattgggatcggcgataacgctctgaaaatcaattggtataagaagggatctagcattggcaaaatgtttgaagccaccgctagaggggccagacgcatggcgatccttggagacacggcctgggatttcggctccgtcgggggagttctcaacagcctgggcaagatggtccaccagatttttgggtctgcttacacagccctgttctccggcgtgagctgggtgatgaaaatcggaattggcgtcctcctgacctggatcgggcttaattctaagaacaccagcatgtccttttcttgcattgctatcggaatcattacactgtatctcggcgccgtggttcaggcggacatggggtgtgtgatcaattggaaaggaaaggagctgaagtgcggcagcgggattttcgtcaccaacgaggtgcatacatggacggaacagtacaaatttcaagccgattcccccaagcggctggctaccgccatcgctggcgcctgggagaatggagtttgtggcattagaagcacaacccgcatggaaaaccttctctggaaacagatcgccaatgagctgaactatatcctgtgggaaaataacattaagctcacagtggtcgtgggggacaccatcggagttctggagcagggcaaacggacgcttacccctcagcccatggagctgaagtactcttggaaaacatgggggaaggctaagattgtgaccgcggaaatccaaaactccagcttcattatcgatggacctaatacacccgagtgcccgtctgcctccagagcttggaacgtctgggaagtggaggactatggctttggcgtgttcaccacaaatatctggctcaaactgcgcgaagtctacacccagctgtgtgaccaccggcttatgagcgccgccgttaaggatgagagagctgtgcacgccgacatggggtactggattgagtcccagaaaaacggatcttggaagctcgaaaaagcgagcctgatcgaggtgaagacgtgcacatggcctaagtcccataccctgtggtctaatggcgtcctcgaaagcgatatgattatccccaaatccctggctgggcctattagccagcacaactatcgccccggataccatacccaaacagccggcccttggcaccttgggaagctggagctcgactttaattattgcgagggaaccacggtggttatcacagaatcttgtggcacccggggcccctccctgagaacaaccacagtgagcgggaaactgatccacgagtggtgctgtcgctcttgcacccttccgcctctccggtacatgggagaagatggctgttggtatgggatggagattagacccatctccgaaaaggaggagaacatggtcaaaagcctggtgtctgccggaagcggcaaggttgacaatttcacgatgggggtgctgtgcctcgctattctgtacgaagaggtcatgcggggaaagtttggcaaaaagcatatgatcgccggcgtgttcttcacctttgttcttctgctctccgggcagattacatggcgcgatatggcgcacaccctgatcatgattggaagcaacgcttctgacagaatgggcatgggggtgacatatctggcccttatcgccaccttcaaaatccagccctttctggctctcggattctttctgcggaagctcacgtccagagaaaatctgcttctgggcgtcgggctcgccatggctacaaccctgcaactgcctgaggatattgaacagatggccaacggaatcgcgcttggcctgatggccctcaaactgattacacagttcgagacctaccagctctggaccgctctggtgagccttacatgttccaatacgatctttaccctgacagtggcctggcgcaccgctacactcattctggccggcgtctctctgcttccggtttgccaaagctcctctatgcggaagaccgactggctgcccatggccgtggctgcgatgggggtgcctcccctccctctgttcatctttagcctcaaggatacgctgaaaagacgctcctggccccttaacgagggagtcatggccgtgggcctggtttctatcctggctagctccctcctgagaaatgacgtgcctatggccgggccccttgtcgccggaggcctgctcattgcttgttacgtgatcacagggaccagcgccgatctgaccgttgaaaaggcggctgacgtgacatgggaggaagaggccgaacagaccggagtctctcataacctcatgattacagtggacgatgacggcacgatgcggatcaaagatgacgagaccgagaacattctgacagtccttctgaagaccgccctgctcatcgtgtccggcatcttcccgtatagcattcctgctacactgcttgtttggcacacctggcagaaacagacgcaacgctctggggtgctgtgggatgtcccctcccctcccgaaacccagaaggccgagctcgaagagggagtgtacagaatcaaacagcagggcatttttgggaagacacaagttggagtgggcgtccagaaggagggggtgttccataccatgtggcacgtgacacggggagcggttctgacccacaatggcaaacgcctcgaaccgaactgggctagcgtcaagaaagacctgatctcttatggcgggggatggagactttccgcccagtggcaaaagggcgaggaagtccaggtgattgccgtcgagcctgggaaaaatcccaagaactttcagacaatgcctggaacgttccagaccacaaccggcgaaatcggggctattgccctggatttcaagcccggaaccagcggctcccccatcatcaatcgggagggcaaagtggttgggctgtacggaaacggcgtggtcacaaagaatgggggatatgtgagcggcattgctcaaacgaacgccgagcctgacgggccgacccccgaactcgaggaagagatgtttaaaaagcgcaatctgacaatcatggatcttcatcctggctctggaaaaaccagaaagtacctgcccgcgattgttcgggaagccatcaagcgcagactccggacactgattctcgctcctaccagagtggtcgccgctgagatggaggaagccctgaaaggccttcccatccgctatcagacgacagccaccaagagcgagcacaccgggcgggaaatcgtggacctgatgtgccatgctacattcaccatgagactgctctcccctgttcgcgtgccgaactacaatctgattgtcatggatgaggcgcactttacagaccccgcctctatcgctgcccggggatacattagcaccagagtgggcatgggggaagccgctgccatcttcatgacggcgacacctcccggaaccgctgatgcctttcctcagtccaacgcccccattcaggacgaggagcgcgacatcccggaacggtcttggaatagcggcaacgagtggatcacagatttcgctgggaaaaccgtgtggtttgtcccttccattaaggccggcaatgacatcgcgaactgtcttcgcaaaaacggaaagaaggttattcaactgtctagaaaaacgttcgataccgaatatcagaagacaaaactcaatgactgggattttgtggtgaccacagacatcagcgagatgggcgccaacttcaaggctgatcgggtcattgaccccagacggtgcctgaaacccgtgatcctgaccgatgggcctgagcgcgttattctcgccggacccatgcctgtgacagctgcctccgctgcccagagacggggccgcgtcgggagaaatccgcagaaggaaaacgaccaatacatctttaccggacagccccttaataacgatgaggaccatgcgcactggacggaagccaagatgctgctggacaatatcaacacacctgagggcattatccccgctctcttcgaacctgagcgggagaaaagcgccgctattgatggggaatatagactgaagggcgagtctcgcaaaaccttcgtggaacttatgcggagaggagacctgcccgtttggctcgcccacaaggtggcctccgagggcatcaaatacaccgatcgcaagtggtgctttgacgggcagcggaataaccagattctggaagagaatatggatgtcgagatctggacaaaagaaggagagaagaagaaactgagaccgcgctggctcgacgctcggacctatagcgatcctcttgcgctgaaggagttcaaagactttgccgctggcagaaagtctatcgccctggatctcgtgacagagattgggcgcgtcccctcccatctggcccacagaacgcggaacgctcttgacaatctggtgatgctccataccagcgaacacggaggccgcgcctacagacacgcggttgaggagctgcctgaaacaatggagaccctgctccttctgggcctgatgatcctcctgacagggggagccatgcttttcctgatttccggcaaagggatcggaaagacctctattggcctcatctgtgtgatcgctagctccgggatgctgtggatggccgaagtgcccctgcaatggattgctagcgccatcgtcctcgagtttttcatgatggttcttctgattcctgagcccgaaaagcagcggacgccgcaggataaccaactggcgtatgtggtgatcggcattctcaccctggccgctatcattgccgctaatgagatgggccttctggaaacaaccaaacgcgacctcggcatgtctaaggagcctggggtcgtgtcccccacaagctacctggatgttgacctgcatcccgcctctgcttggaccctctacgccgtggcgacgacagtcatcacccctatgcttagacacacaatcgaaaacagcaccgccaatgtgtccctggctgccattgctaaccaggccgtcgtgctgatgggactcgacaaaggctggccgatctctaagatggatctgggggttccccttctggccctcggatgctatagccaggtgaaccctctgaccctgacagcggctgtcctccttctgattacgcattacgccatcattggccccgggctgcaggctaaagccacccgggaggcccaaaagagaacagctgccggaatcatgaagaatcctaccgtggacggcatcatgacaattgatctcgaccccgttatctatgattccaaatttgagaagcagctgggccaggtgatgcttctggtcctctgtgcggtgcagctgctgctcatgcgcacctcttgggccctttgcgaagctctgacgctggccacagggcctattaccaccctctgggagggaagcccgggcaaattctggaacacaaccatcgctgtgtccatggccaatatttttcgggggagctacctggcgggagccggccttgctttctctatcatgaagtccgttgggacaggaaaaagaggcacgggcagccaaggggaaaccctgggagagaagtggaagaaaaagctcaaccagctgtcccgcaaagaatttgacctgtataagaaatctggcatcacagaggtcgatcggaccgaggccaaggaagggctcaaaagaggagagacaacccaccatgctgtgagccggggctccgccaaacttcagtggttcgtggaacgcaatatggtcgttcccgaggggagagtgattgacctgggatgtggccggggcgggtggtcttactattgcgctggactgaagaaagtgacggaagtccgcggctacaccaaagggggacctggccacgaggagcccgtgcctatgagcacatacgggtggaacatcgttaaactcatgtccggaaaggatgtgttttatctgcccccggaaaaatgtgacacccttctgtgcgatattggcgagagctctccttcccccacagtcgaagagagcagaaccatccgggtgctcaagatggttgagccctggctgaagaataaccagttctgtattaaagtgctgaatccttacatgcccacagtcatcgaacacctcgagcgccttcaaagaaagcatggcgggatgctggtgcggaaccctctgtctcgcaattccacccacgaaatgtattggattagcaacggaacgggcaatatcgtgtctagcgtcaacatggtttccagactcctgcttaatcggttcacaatgacccatagacgcccgaccatcgagaaagacgtggatctgggggccggaacacggcacgtgaacgcggaacccgagacgcctaacatggacgtcattggcgagagaatcaagcgcattaaagaagaacacaattctacctggcattacgacgatgaaaacccctataagacatgggcctaccacgggagctatgaggtgaaggctaccggatccgccagctccatgatcaatggcgttgtgaaactcctgacaaagccttgggacgtcgtgcccatggttacccagatggctatgacagataccacgccgtttggccagcaacgggtgttcaaagaaaaggtcgacaccagaacacctcgccccatgcctgggacccggaaagtgatggagattacagccgagtggctgtggagaaccctcggacgcaacaagcggcccagactgtgcacgcgcgaagagtttacaaagaaagttcggaccaatgccgcgatgggcgctgtgttcacagaagagaaccagtgggattctgccaaggccgctgtcgaagacgaggagttttggaaacttgtggatagagaacgcgagctgcataagctcgggaaatgtggaagctgcgtctacaatatgatgggcaagagagagaagaagctgggggagttcggcaaggccaaaggatcccgggctatctggtacatgtggcttggcgcccgctatctggagtttgaagcgctcgggttcctgaacgaggaccactggttttctagagaaaatagctactccggagtggagggcgaagggctgcataagctcggatatatcctgcgggatatttctaaaatccctggcggggccatgtacgctgacgataccgccggctgggacacgagaattaccgaggacgatcttcacaacgaggaaaagatcattcagcagatggaccccgagcaccggcaactggctaatgccatcttcaaactcacatatcagaacaaggttgtgaaggtccagcgcccgacccctacaggaaccgtgatggatatcattagcagaaaagaccagcggggctccgggcaagtgggaacatacggcctgaatacctttacgaacatggaagcgcagcttgttcgccagatggagggggaaggagtgctgacaaaggccgatctcgagaatccccatctgcccgagaaaaagatcacccagtggctggaaaccaaaggcgtcgagagactcaagcggatggctattagcggggacgattgcgtggttaagcctatcgacgatcgcttcgccaacgctctgcttgccctgaacgacatgggcaaagtgagaaaggatattccgcaatggcagccctctcggggatggcacgactggcagcaggtccctttttgttcccatcacttccacgaactcatcatgaaagatggccgcaagctggtggtcccctgcagacctcaagacgagcttatcgggcgggctcgcattagccagggagccggctggtctctgagagaaacagcgtgtctcgggaaagcctatgctcagatgtggtccctgatgtacttccatcggcgcgacctgagactcgccagcaatgccatctgctctgctgtgcccgttcactgggtgcctacctcccggacaacgtggagcattcatgcccaccatcaatggatgaccacagaggatatgctgaccgtctggaacagagtgtggatcgaggaaaatccctggatggaggacaagacaccggttaccacgtgggaaaacgtgccttaccttggaaagcgcgaggatcagtggtgtggctccctgattgggctcaccagccgggcgacatgggctcagaatatcctgaccgccattcagcaagtcagatctcttatcggcaacgaggaatttctggactatatgcccagcatgaaacgcttccggaaggaggaagagtccgaaggagccatctggtga

SEQ ID NO: 20908 - RNA, 9873 nt, synthetic construct
  misc_feature 1..9873: note = derived and/or modified CDS sequence (opt5) from DENV-3__JQ411814__SS-prME
  source 1..9873: mol_type = other RNA
accagcctgtgcctcatgatgatcctgcccgccgctcttgccttccacctgacatcccgggacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggaattggcaaccgggactttgtggaagggctcagcggagctacctgggtcgatgtggtgctggagcacggcgggtgcgtcaccacaatggccaagaataaacccacgctggacatcgagctccagaagaccgaagctacacagctggccacccttcgcaaactgtgtattgagggaaagatcacaaacattaccacggattccagatgccctacacagggcgaagcggttctcccggaggaacaggaccagaattatgtgtgtaaacacacctacgtggatcggggctgggggaacggatgcggcctgttcgggaagggaagccttgtgacctgcgccaagtttcaatgtctggagcccatcgagggcaaagtggttcagtatgaaaatctcaagtacacagtgatcattaccgtccatacaggggaccagcaccaggtgggaaacgagacgcaaggcgttaccgctgaaatcacacctcaggcctctaccacagaggctattctgcccgaatatggcaccctggggctcgagtgctcccctcgcacgggactggacttcaatgagatgatccttctgaccatgaaaaacaaggcctggatggtgcatagacagtggtttttcgatctccccctgccgtggacaagcggcgccaccacagaaacccctacgtggaatcggaaagagcttctggtcacatttaagaacgctcacgcgaaaaagcaagaagtggtcgtgctcgggtctcaggagggagccatgcacaccgctctgacaggcgccaccgaaattcaaaattccgggggcaccagcatcttcgccggacatctgaagtgtcgcctcaaaatggacaagctggagcttaaaggcatgtcttacgctatgtgcacaaacacgtttgttctgaagaaagaggtgtccgaaacccagcacgggacaatcctcattaaggtcgagtacaagggagaagatgccccctgtaaaatccctttcagcaccgaggacggccaagggaaggcgcataacggaagactgattacagctaatcccgtggttaccaaaaaggaggaacccgtgaacatcgaggccgaacctccgttcggcgagtccaatattgtcatcgggatcggcgataacgccctgaaaattaattggtataagaagggatctagcatcggcaaaatgtttgaagctacggccagaggggctagacgcatggccattcttggagacacagcgtgggatttcggctccgtcgggggagtgctcaacagcctgggcaagatggttcaccagatctttgggtctgcctacaccgctctgttctccggcgtcagctgggtgatgaaaattggaatcggcgtgctcctgacctggattgggcttaattctaagaacacaagcatgtccttttcttgcatcgccatcggaattatcaccctgtatctcggcgctgtcgtgcaggccgacatggggtgtgttattaattggaaaggaaaggagctgaagtgcggcagcgggatcttcgtgacaaacgaggtccatacgtggaccgaacagtacaaatttcaagcggattcccccaagcggctggccacagctattgccggcgcttgggagaatggagtgtgtggcatcagaagcaccacacgcatggaaaaccttctctggaaacagatcgccaatgagctgaactatattctgtgggaaaataacatcaagctcaccgttgtggtcggggacacgattggagtgctggagcagggcaaacggacccttacacctcagcccatggagctgaagtactcttggaaaacctgggggaaggccaagatcgttacagctgaaacccaaaactccagcttcattatcgatggacctaatacacccgagtgcccgtctgcgtccagagcctggaacgtgtgggaagtcgaggactatggctttggcgtgttcaccacgaatatctggctcaaactgcgcgacgtgtacacacagctgtgtgatcaccggcttatgagcgctgccgtcaaggacgaaagagccgttcacgctgatatggggtactggattgagtcccagaaaaacggatcttggaagctcgagaaagccagcctgatcgaagtgaagacctgcacctggcctaagtcccatacactgtggtctaatggcgtgctcgagagcgacatgattatccccaaatccctggcggggcctattagccagcacaactatcgccccggataccatacccaaacggctggcccttggcaccttgggaagctggaactcgattttaattattgcgagggaacaaccgtcgtgatcacagagaactgtggcacccggggcccctctctgagaacaaccacggtttccgggaaactgatccacgaatggtgctgtcgcagctgcacccttccgcctctccggtacatgggagaggacggctgttggtatgggatggaaattagacccatctctgagaaggaagagaatatggtgaaatccctggtcagcgccggatctggcaaggtggataacttcacaatgggggttctgtgcctcgccattctgtttgaggaagtgatgcggggaaagttcggcaaaaagcatatgatcgctggcgtccttttcacctttgtgctgctcctgagcgggcagattacatggcgcgacatggcccacaccctgatcatgattggatccaatgcgagcgatagaatgggcatgggggttacgtaccttgctctgatcgccacattcaaaatccagccctttctcgccctgggattctttctccggaagctgacctctagagagaaccttctgctcggcgtggggctggctatggccacaaccctgcaacttcctgaagacattgagcagatggctaatggaatcgccctgggcctcatggcgctgaaactcattacccagttcgaaacatatcagctgtggacggcccttgtctccctgacctgtagcaacacaatcctcaccctgacagtggcttggcgcaccgccacgctgattcttgctggcgtgtccctgctcccggtctgccaatctagctccatgcggaagacagattggctgcccatgaccgttgccgccatgggggtgcctcccctccctctgtttatcttctctcttaaggacaccctgaaaagacgcagctggcccctgaatgagggagtgatggctgtcggcctcgtgtccatcctggcgtctagccttctgagaaacgatgttcctatggccgggcccctcgtggctggaggcctgctcattgcctgttacgtcatcacagggacctccgccgacctgacagtggagaaggctgccgacgttacgtgggaagaggaagcggagcagaccggagtgagccataaccttatgattacagtcgatgacgatggcaccatgcggatcaaagacgatgaaacagagaatattctgaccgtgctgctcaagacggctctgcttatcgtctctggcatctttccgtactccattcctgccaccctgctcgtgtggcacacatggcagaaacagacccaacgcagcggggttctgtgggacgtgccctctcctcccgagacacagaaggccgaactcgaggaaggagtctatagaatcaaacagcagggcattctggggaagacccaagtgggagttggcgtgcagaaggagggggtcttccatacaatgtggcacgtgacgcggggagctgtgcttacccacaacggcaaacgcctggagccgaattgggcctccgttaagaaagatctgatcagctacggcgggggatggagactctctgcgcagtggcaaaagggcgaagaggtccaggtgattgctgtggaacctgggaaaaaccccaagaattttcagacaatgcctggaaccttccagaccacaacgggcgagatcggggccattgccctggactttaagcccggaacctccggcagccccatcatcaaccgggaaggcaaagtcgtggggctttatggaaatggcgttgtgacaaagaacgggggatacgtctccggcattgctcaaaccaatgccgagcctgatgggccgacacccgagctggaagaggaaatgttcaaaaagcgcaacctcaccatcatggacctgcatcctggcagcggaaaaacgagaaagtatctccccgctattgtgcgggaggccatcaagcgcagactgcggacacttattctggcgcctaccagagttgtggccgctgaaatggaggaggccctgaaaggcctccccatccgctaccagaccacagctaccaagtctgaacacacagggcgggagatcgtcgatctgatgtgccatgccaccttcacgatgagacttctgagccctgtgcgcgttccgaattataacctcattatcatggacgaagcccactttacagatcccgcttccattgcggcccggggatacatctctaccagagtgggcatgggggaggctgccgccattttcatgacagctacccctcccggaacggccgacgcgtttcctcagagcaatgctcccatccaggacgaggaacgcgatatcccggagcggtcctggaactctggcaatgaatggattaccgacttcgccgggaaaacagtctggtttgtgcctagcatcaaggccggcaacgatattgctaactgtctgcgcaaaaatggaaagaaggtgatccaactgtccagaaaaaccttcgacacagagtaccagaagaccaaactcaacgattgggactttgtcgttacaaccgatatttctgaaatgggcgccaatttcaaggcggaccgggtgatcgatcccagacggtgccttaaacccgtgattctgacggacgggcctgagcgcgtcatcctggccggacccatgcctgtgacagctgccagcgctgcccagagacggggccgcgttgggagaaacccgcagaaggagaatgatcaatatatctttaccggacagcccctcaacaatgacgaagaccatgctcactggaccgaggccaagatgctgcttgataacattaatacacctgaaggcatcattcccgcgctgttcgagcctgaacgggagaaatccgccgctatcgacggggagtacagactcaagggcgaaagccgcaaaacctttgtggagctgatgcggagaggagatctgcccgtctggctcgcccacaaggtggcttctgaaggcattaaatatacagaccgcaagtggtgcttcgatgggcagcggaacaatcagatccttgaggaaaacatggacgttgagatctggacgaaagagggagaaaagaagaaactgagaccgcgctggctggatgcccggacctactccgaccctctcgccctgaaggagttcaaagattttgctgcgggcagaaagagcattgcccttgacctggtgacagaaatcgggcgcgtcccctctcatctcgctcacagaacccggaatgccctggataacctggtgatgctccatacatccgagcacggaggccgcgcctatagacacgctgtcgaagaacttcctgagaccatggaaacgctgctgctcctgggccttatgattctgctcaccgggggagccatgctgttcctgatcagcggcaaagggattggaaagacatccatcggcctcatctgtgtgattgcgtctagcgggatgctttggatggccgagatccccctgcaatggattgcttccgccatcgttctggaatttttcatgatggtgctcctgattcctgagcccgagaagcagcggaccccgcaggacaatcaacttgcttacgtggtcatcggcattctcacactcgccgcgatcatcgccgctaacgaaatgggactgctggagaccacgaaacgcgatctcggcatgagcaaggaacctggggttgtgtctcccacatcctatcttgacgtggacctgcatcccgccagcgcttggaccctgtacgccgtcgctacaaccgtgattacccctatgctcagacacacaatcgaaaattctacggccaacgttagcctggcggccattgctaaccaggccgtggtccttatgggactggataaaggctggccgatctccaagatggacctcggggtgcccctgctggctctcggatgctactctcaggtcaatcctcttaccctgacagccgccgtgctgctcctgattacccattatgcgatcatcggccccgggcttcaggctaaagccacacgggaagctcaaaagagaaccgccgccggaattatgaagaaccctacggttgatggcatcatgacaattgacctggatcccgtgatctacgacagcaaatttgagaagcagctcggccaggtcatgctgctggtgctctgtgctgttcagcttctgctgatgcgcacctcctgggccctctgcgaggcgctgacccttgccacagggcctattaccacactgtgggaaggatctccgggcaaattctggaatacgaccatcgctgtgagcatggccaacatctttcgggggtcctatctcgctggagccggcctggcgttcagcattatgaagtctgtcgggacaggaaaaagaggcaccggctcccaaggggagacactgggagaaaagtggaagaaaaagctcaatcagcttagccgcaaagagtttgatctgtacaagaaatccggcatcaccgaagtggaccggacggaggccaaggaggggctgaaaagaggagaaattacccaccatgctgtgtctcggggcagcgccaagctccagtggttcgttgagcgcaacatggtcatccccgaagggagagtgattgatctgggatgtggccggggcgggtggtcctattactgcgctggacttaagaaagtgacagaggtccgcggctataccaaagggggacctggccacgaggagcccgttcctatgtctacatacgggtggaatatcgtgaaactgatgagcggaaaggacgtgttttacctgcccccggagaaatgtgataccctgctgtgcgacattggcgaatccagcccttctcccacagtcgaggaatccagaaccatccgggtgctcaagatggttgagccctggcttaagaacaatcagttctgtatcaaagtgctgaacccttatatgcccacggtcattgagcacctggaacgcctccaaagaaagcatggcgggatgctggtgcggaatcctcttagccgcaactctacacacgagatgtactggatctccaatggaaccggcaacattgttagctctgtgaatatggtcagcagactgctcctgaaccggtttaccatgacacatagacgcccgacgatcgaaaaagatgtggacctgggggccggaacccggcacgtgaacgctgagcccgaaacacctaatatggacgtcattggcgagagaatcaagcgcatcaaagaggaacacaactccacctggcattatgatgacgagaatccctacaagacatgggcctatcacgggtcttacgaagttaaggcgaccggaagcgcctccagcatgattaacggcgtggtgaaactcctgacaaagccttgggatgtcgtgcccatggttacccagatggctatgacggacaccacaccgttcggccagcaacgggtgttcaaagagaaggtcgataccagaacacctcgccccatgcctgggacccggaaagtgatgggaatcacggccgaatggctttggagaacactgggccgcaataagcggcccagactctgcacccgcgaggagtttacaaagaaagttcggaccaacgctgccatgggggccgtgttcacggaagagaatcagtgggactccgcgaaggctgccgtcgaagatgaggaattttggaaactggtggacagagagcgcgagcttcataagctgggaaaatgtggctcttgcgtttataacatgatggggaagagagagaagaagctcggcgagttcggaaaggccaaaggcagccgggctatttggtacatgtggctgggggcccgctacctggaatttgaggctctcggattcctgaatgaggatcactggttttccagagacaactcttatagcggcgtggaaggggagggacttcataagctgggctacatcctccgggatatttccaaaatccctgggggcgccatgtatgcggacgacaccgccggatgggatacaagaatcaccgaagacgatctgcacaatgaggaaaagattacacagcagatggaccccgagcaccggcaacttgctaacgccatcttcaaactgacctaccagaataaggtcgtgaaggtccagcgcccgacacctaccggcacggtgatggatattatctctagaaaagaccagcgggggagcggacaagttggcacatatgggctcaacacctttaccaatatggaggtgcagctggtccgccagatggaaggagagggcgtgctgtccaaggctgatctcgaaaacccccatctgcccgagaaaaagattacacagtggcttgaaaccaaaggggtggagagactgaagcggatggccatcagcggcgacgattgcgttgtgaagcctatcgacgatcgcttcgcgaacgccctcctggctcttaatgacatgggaaaagtcagaaaggatattccgcaatggcagccctctaaaggctggcacgactggcaacaggtgcctttttgttcccatcacttccacgagctgatcatgaaggacgggcggaaactcgttgtgccctgccgccctcaagatgaactgattggacgggcccggatcagccagggcgctgggtggtctctgcgcgagacagcctgtctcggaaaggcttacgcccagatgtggtccctgatgtattttcatagacgggaccttcgcctggcgagcaacgccatttgctctgctgtccccgtgcactgggtccctacgtccagaaccacatggagcatccatgcccaccatcaatggatgaccacagaagatatgctcaccgtgtggaatcgggtttggattgaggacaacccctggatggaagataagacgccggtgaccacatgggagaatgtcccttacctgggcaaaagagaggaccagtggtgtgggtcccttatcggcctgaccagccgcgccacatgggctcagaacatccccaccgccattcagcaagtgcggtctctcatcggaaatgaagagttcctggattacatgcctagcatgaagagattccgcaaagaagaggagtccgaaggcgcgatttggtga

SEQ ID NO: 20909 - RNA, 9873 nt, synthetic construct
  misc_feature 1..9873: note = derived and/or modified CDS sequence (opt5) from DENV-3__KM190937__SS-prME
  source 1..9873: mol_type = other RNA
accagcctctgcctcatgatgatgctgcccgccacacttgctttccacctgacgtcccgggacggagaacctcggatgatcgtggggaagaacgaacgcggaaaatctctcctgtttaagaccgccagcggcattaatatgtgtacacttatcgcgatggatctgggggagatgtgcgacgataccgtgacatacaaatgtccgcatattaccgaagttgagcccgaagacatcgattgctggtgtaacctcacatccacctgggtgacgtatggaacctgcaatcaggctggcgagcaccggcgggacaagcgctctgtggccattgcccctcatgtcgggatgggactggatacaagaacccagacatggatgagcgctgagggcgcctggagacaggtggaaaaagttgagacctgggctctgcgccaccccggcttcacgatcctcgccctgtttcttgcgcattacatcgggacatccctgacccagaaggtggtcattttcatcctcctgatgcttgtgacaccttctatgaccatgagatgtgttggagtgggcaaccgggactttgtcgaagggctgagcggagccacctgggtggatgtggtcctcgagcacggcgggtgcgttacaacgatggctaagaataaacccaccctggacattgagctgcagaagacagaagccacccagctcgctacactgcgcaaactttgtatcgagggaaagattaccaacatcacgacagattccagatgccctacccagggcgaagccattctgccggaggaacaggaccagaattatgtgtgtaaacacacctacgtggatcggggctgggggaacggatgcggcctcttcgggaagggaagcctggtcacatgcgcgaagtttcaatgtcttgagtctatcgagggcaaagtggttcagcatgaaaatctgaagtataccgtgatcattacagtccacacgggggaccagcatcaggtgggaaacgagatgcaaggcgttaccgccgaaatcacaccccaggcttccaccgccgaggtgattctccctgaatacggcacactggggctggagtgcagcccccgcaccggactcgacttcaatgagatgatctctctgacgatgaaaaacaaggcttggatggtccacagacagtggtttttcgatcttcctctgccctggacctccggcgccacagccgaaaccccgacatggaatcggaaagagctcctggtgacctttaagaacgctcacgcgaaaaagcaagaagtcgtggttcttgggagccaggagggagccatgcatacggctctgacaggcgccaccgaaattcagacatctgggggcacctccatcttcgccggacacctcaagtgtcgcctgaaaatggacaagctggagctcaaaggcatgagctatgctatgtgcctgtcctcttttgtgcttaagaaagaggtcagcgaaacccagcatgggacaatcctgattaaggtggagtacaagggagaagatgccccttgtaaaatccccttctccacggaggacggccaagggaaggcgcacaatggaagactcattaccgctaaccctgttgtgaccaaaaaggaggaacccgtcaacatcgaggccgaaccccctttcggcgagagcaatattgtgatcgggatcggcgataaagccctgaagattaactggtacaagaaaggatcttccatcggcaagatgtttgaagctaccgccagaggggctagacgcatggccattctgggagacacagcgtgggatttcggcagcgtcggcggggttcttaattctctcgggaaaatggtccatcagatctttgggagcgcctataccgctctgttcggcggagtgtcctggatgatgaagattggcatcggggtgctgctcacgtggattggactgaactctaaaaatacaagcatgtcctttagctgcatcgccatcggcattatcaccctttacctgggggctgtcgtgcaggccgacatgggatgtgttattaactggaagggcaaggagctcaaatgcgggtctggcatcttcgtgaccaatgaggtccacacatggaccgaacagtataagtttcaagcggattccccgaaacggctggccacagctattgccggagcttgggagaacggcgtgtgtgggatcagaagcacgacccgcatggaaaatctgctttggaagcagatcgccaacgagctcaattacattctgtgggaaaacaatatcaaactgacagttgtggtcggagacattaccggcgtgctcgagcaggggaagcggacactgacaccccagcctatggagcttaaatattcttggaagacgtggggaaaggccaaaatcgttaccgctgaaacacaaaactccagcttcattatcgatggcccctccacccctgagtgcccctctgcgagcagagcctggaatgtgtgggaagtcgaggactacggctttggggtgttcacaaccaacatctggctgaagctccgcgaagtgtatacacagctgtgtgaccaccggctgatgtccgctgccgtcaaagatgagagagccgttcatgctgacatgggatactggattgagtctcagaagaacggcagctggaaacttgaaaaggcctcctttatcgaggtgaagacctgcacgtggccgaaaagccacacactctggtctaatggggtgctggaatccgatatgattatccctaagagcctggcgggacccatttctcagcataaccaccgccctggctaccacacccaaaccgctgggccctggcatctcggaaaactggagcttgacttcaattattgcgagggcacaaccgtcgtgatctccgaaaactgtggcacgcgggggcctagcctgagaacaaccacagtttctggaaagctcatccacgagtggtgctgtcgcagctgcaccctgcccccgctgcggtacatgggcgaagatgggtgttggtatggaatggagattagacctatcaatgaaaaagaggagaacatggtgaagtcccttgccagcgccggctctgggaaggtcgacaattttacaatgggagtgctctgcctggctattctgttcgaagaggttatgcggggcaaattcggcaagatccatatgattgccggggtgctctttaccttcgtcctgcttctgtccggacagatcacgtggcgcgatatggcgcacaccctcattatgatcggcagcaacgcttccgacagaatggggatgggagtgacatacctggccctgatcgccacctttaaaattcagcccttccttgctctgggctttttcctccggaagctgacatctagagaaaatctcctgcttggggttggactggccatggctgccaccctccgcctgcccgaggatatcgaacaaatggcgaacggcattgccctgggccttatggctctgaaactcatcacgcagtttgagacatatcagctgtggaccgccctcgtgagcctgacatgttccaataccattttcacccttacagtcgcttggcggacggccaccctgatcctcgccgggatctctctgctgcctgtgtgccagagctcctctatgagaaagacagactggcttccgatgaccgtggctgcgatgggagcccaacccctgcctctctttattttcagcctgaaggatacactcaaacgcagatcctggcccctgaacgagggcgtcatggctgttgggcttgtgagcatcctggcctcttccctgctccggaatgacgtgcctatggccggacccctggtcgctggcgggcttctgattgcctgttacgtgatcaccggaacgagcgcggatctcacagttgaaaaggctgccgacgtgacctgggaggaagaggccgaacagaccggcgtctctcataacctgatggtgacagttgacgatgacggcaccatgcgcattaaagatgacgagacagagaatatcctcacggtgctgcttaagaccgctctgctgatcgtctccgggatttttccttatagcatccccgccacactcctggtgtggcacacctggcagaaacagacacaaagatctggagtcctttgggatgtgccgtcccctcccgaaacccagaaggcggagctggaagagggcgtttaccggattaaacagcaggggatcttcggaaagacgcaagtgggcgtcggggtgcagaaggagggagtttttcacaccatgtggcatgtgacacgcggcgctgtcctcacccacaacggcaaaagactggaacctaactgggccagcgtgaagaaagacctcatttcctacgggggaggctggcggctgagcgcccagtggcaaaagggggaggaagtgcaggttatcgctgtcgagcccggcaaaaatccgaagaacttccagacaatgcctggcattttccagaccacaacgggggaaatcggagccatcgctcttgattttaagcccggcacctctggcagccctattatcaatcgcgaggggaaagtggtgggactgtatggcaacggggtcgtgacaaagaatggaggctacgtttccgggattgcccaaaccaacgcggagcccgacggccccacccctgaactggaggaagagatgttcaaaaagagaaatctcacaatcatggatctgcatccgggatctggcaaaacgcggaagtatcttcccgccattgtgcgcgaagctatcaagagacggctgagaaccctcatcctggcccctacacgcgtcgtggctgccgagatggaggaagccctcaaagggctgcccattcggtaccagaccacagctaccaagagcgagcacacgggaagagaaatcgttgaccttatgtgccatgcgacatttaccatgcgcctgctgtcccctgtgcgggtccccaactataatctcattatcatggatgaggcccacttcaccgaccctgcttctattgccgccagaggctacatcagcacacgcgtggggatgggagaagctgccgcgatctttatgaccgctacaccgcccggcaccgccgatgccttccctcagtccaacgctcccattcaggacgaggagcgggacatccctgaaagatcttggaatagcgggaacgagtggattacggattttgttggcaaaacagtgtggttcgtcccctccatcaaggccggaaatgacattgcgaactgtctgcgcaaaaatggcaagaaggtgatccaacttagccggaaaacctttgatacagaatatcagaagaccaaactgaacgactgggatttcgtggtcacgaccgacatttctgagatgggggccaactttaaggctgatagagttatcgacccgcggcgctgcctcaaacctgtgatcctgacagatggacccgagagagtgattctggccggccccatgcctgtcaccgtggcttccgccgctcagcggcgcgggagagttggacggaatccccagaaggaaaacgaccaatacatcttcatgggccagcctctcaataacgatgaggaccacgcccattggacagaagcgaagatgcttctggacaatattaacaccccggaggggatcattcccgccctgttcgaacctgagagagagaaaagcgctgccatcgatggcgaataccgcctcaagggagagtctcggaaaacatttgtggaactgatgagacgcggcgaccttcccgtctggctggctcacaaggtggcctccgaggggatcaaatataccgatcggaagtggtgcttcgacggagaaagaaataaccagattctcgaggagaatatggatgttgaaatctggacgaaagagggcgaaaagaagaaactgcgccctcggtggctggacgccagaacatacagcgatcccctcgctcttaaggagtttaaagacttcgcggccgggcgcaagtccattgctctggatctggtgaccgaaatcggaagagtcccgtctcatctcgcccaccggacccgcaacgccctggacaatcttgtgatgctgcacacaagcgagcatggcggcagagcttatcggcacgccgtcgaggaactccctgagaccatggaaacactgctgctccttgggctgatgattctgctcacgggaggcgcgatgctgtttcttatctccgggaaaggaatcggcaagaccagcattgggctgatctgtgtgattgcctcttccggaatgctctggatggctgatgttcccctgcagtggatcgccagcgctattgtgctggagttctttatgatggtgctccttatccctgagcccgaaaagcaacgcacacctcaggacaaccagctggcctacgtcgttattggcatcctgaccctcgcggccatcgtggctgccaatgagatgggcctgcttgaaacaaccaaaagagatctggggatgtctaaggagcccggagtggtcagcccgacgtcctatctcgacgtggacctgcatcctgcttctgcctggaccctgtacgctgttgccacaaccgtgattacacccatgctccggcacaccatcgaaaacagcacggcgaatgtctcccttgccgctattgccaaccaagctgtggtcctgatgggcctggataaagggtggcccatctctaagatggacctcggagtgcctctgcttgccctgggctgctatagccaggttaatccgctcacactggccgcggctgtgctgctccttgtcacccattacgccattatcgggcccggactgcaggctaaagccacaagagaggcccagaagcgcaccgctgccggcatcatgaagaaccctaccgtggatggcattatgacaatcgacctggatcccgttatttacgactccaaattcgagaagcaactcggacaggtgatgctgcttgtcctgtgtgcggtgcagctcctgctgatgcggacgagctgggccctctgcgaagtgcttaccctggctacaggacctatcaccacactgtgggagggctctcccgggaaattttggaacaccacgattgccgtttccatggctaatatcttcagaggaagctatctcgccggcgcggggctggccttttccatcatgaagtctgtcggaacaggcaaacgcggcaccgggagccagggagaaacccttggcgagaagtggaagaaaaagctgaaccaactctcccggaaagagttcgatctgtacaagaaatctgggattacagaggtggacagaaccgaggctaaggaaggactgaaacggggcgagatcacacaccacgccgtgagccgcgggtccgctaagctccagtggtttgtcgaaagaaatatggttattcctgagggacgggtgatcgatcttggctgtggccgcgggggatggagctattactgcgccggcctgaagaaagtgacggaagtcagagggtataccaagggaggcccggggcatgaggagcccgtgcctatgtctacatacggatggaacattgttaaactgatgtccggcaaggacgtgttctatctgccccctgaaaaatgtgataccctgctttgcgacatcggcgagagctctccctccccgacagtcgaagagagccggaccattcgcgtgctgaagatggttgagccttggctcaagaataaccagttctgtatcaaagtgctgaatccctacatgcccacggtcatcgaacacctggagagactccagcggaagcatgggggaatgcttgtgcgcaaccctctgtctagaaatagcacccacgaaatgtactggatttccaacggcacagggaatatcgtgtctagcgtcaacatggtttcccggctgctcctgaatagatttaccatgacacaccgccggcccaccattgagaaagatgtggaccttggagctggcacaagacatgtgaacgccgaacctgagaccccgaatatggacgtcatcggggagcgcattaagcggatcaaagaagaacacagctccacgtggcattatgatgacgaaaacccctacaagacatgggcgtatcacggatcttacgaggtgaaggccaccggcagcgcttcctctatgatcaacggcgttgtgaaactgctcaccaagccttgggatgtcgtgcccatggttacacaaatggccatgacggacaccacacctttcgggcagcagagagtgtttaaagaaaaggtcgatacccgcacaccccggccgatgcctggaaccagaaaagtgatggagattacagctgagtggctgtggcgcaccctgggccggaataagagaccccgcctctgcacgcgggaagagttcaccaagaaagttagaacaaacgccgccatgggggcggtgtttaccgaagagaatcaatgggacagcgctcgcgccgccgtcgaagatgaggagttctggaagctggtggacagagaacgggagcttcataaactgggaaagtgtggctcctgcgtctataacatgatggggaaacgcgaaaagaaactcggcgagtttggaaaggctaagggctctagagccatctggtacatgtggctgggggctcggtatcttgagttcgaagccctgggatttctcaatgaggatcactggttcagcagagaaaactcctacagcggcgtggagggggaaggactgcacaaactgggctacattctccgggacatctctaagattcctgggggcgcgatgtatgccgatgacacagctggatgggacacccgcatcacggaggatgacctgcataatgaggagaaaatcacacagcagatggatcccgagcacagacagcttgccaacgctatttttaagctgacctaccaaaataaagttgtgaaggtccagcggcctacacccaagggcaccgtgatggacatcatttcccgcaaagatcagagagggagcggacaggtgggcacgtatgggctcaacaccttcacaaatatggaagcccaactgatccggcagatggagggagaaggcgttctttctaaggcggacctggagaacccgcatcctctcgagaaaaagattacccagtggctggaaacaaaaggggtggagcgcctgaagagaatggccatctccggcgatgactgcgtcgtgaagcccatcgatgaccggtttgctaatgccctcctggctcttaacgatatgggaaaagttcgcaaggacattccccagtggcaacctagcaaaggctggcacgattggcaacaggtgccgttctgttctcaccatttccacgaactgatcatgaaggacgggagaaaactcgtcgtgccctgccggcctcaggacgagctgattggacgcgccagaatctcccaaggcgctgggtggagccttcgggaaaccgcctgtctgggaaaggcgtacgcccagatgtgggctctcatgtattttcatcgcagagatctgcggctggcctccaatgccatttgcagcgctgtccccgtgcactgggttcctacatctagaaccacgtggagcatccatgcccaccaccagtggatgacaaccgaggacatgctcaccgtgtggaaccgcgtctggattgaggataacccctggatggaagacaagacacctgtgaccacatgggaggatgttccctacctgggcaaacgggaagaccaatggtgtgggtcccttatcggcctgacgtctagagcgacctgggctcagaatatcctcacagccattcaacaggtgcgcagcctgatcggaaacgaggagttccttgattatatgccgtccatgaagcggtttagaaaagaagaggaatctgagggcgccatttggtga

SEQ ID NO: 20910 - RNA, 9873 nt, synthetic construct
  misc_feature 1..9873: note = derived and/or modified CDS sequence (opt5) from DENV-3__JQ920487__SS-prME
  source 1..9873: mol_type = other RNA
accagcctgtgcctcatgatgatgctgcccgccacacttgctttccacctgacgtccagagacggcgagcctcggatgatcgtggggaagaacgaacgcggaaaatctctcctgtttaagaccgccagcggcattaatatgtgtacacttatcgcgatggatctgggggagatgtgcgacgataccgtcacatacaaatgtccgctcattaccgaagttgagcccgaagacatcgattgctggtgtaacctgacatccacctgggtgacgtatggaacctgcaatcaggctggcgagcatagacgggacaagcgctctgtggccctggcccctcacgtcgggatgggactcgatacaagaacccaaacatggatgagcgctgagggcgcctggcggcaggtggaaaaagttgagacctgggctttccgccatcccggctttacgattctggcccttttcctggcgcactacatcgggacatccctcacccagaaggtggtcatctttattctgcttatgctggtgacaccttctatgaccatgagatgtgttggagtgggcaaccgggacttcgtcgaagggctcagcggagccacctgggtggatgtggtcctggagcatggcgggtgcgttacaacgatggctaagaataaacccaccctggacatcgagctccagaagacagaagccacccaactggctacacttcgcaaactgtgtattgagggaaagatcaccaacgtgacgacagattccagatgccctacccagggcgaagccattctcccggaggaacaggaccagaattatgtgtgtaaacacacctacgtcgatcggggctgggggaacggatgcggcctgtttgggaagggaagccttgtgacatgcgcgaagttccaatgtctggagtctatcgagggcaaagccgttcagcacgaaaatctcaagtataccgtgattatcacagtccatacgggggaccagcaccaggtgggaaacgagacccaaggcgttacagctgaaatcaccccccaggcctccacagtggaggctattctgcctgaatacggcaccctggggctcgagtgcagcccccgcacgggactggactttaatgagatgatccttctgaccatgaaaaacaaggcctggatggtccatagacagtggttctttgatctccctctgccctggacatctggcgccaccacagaaaccccgacgtggaataaaaaggagcttctggtgacattcaaaaacgctcacgcgaagaagcaagaagtcgtggttctcgggtcccaggagggagccatgcacaccgctctgacaggcgccaccgaaattcagaccagcgggggcacatctatctttgccggacatctgaaatgtcggctcaagatggacaaactggagcttaagggcatgtcctatgctatgtgcctgaatgccttcgtgctcaaaaaggaggtcagcgaaacgcagcacgggaccattctgatcaaggtggagtacaaaggagaagatgcgccttgtaagatccccttctccacagaggacggccaagggaaagctcataacggacgcctgattaccgccaaccctatcgttacaaagaaagaggaacccgtgaatattgaggccgaacccccttttggcgagtctaacatcgtcattgggatcggcgataaggctcttaagatcaattggtacaaaaagggaagctccattggcaaaatgttcgaagccaccgctagaggggcccggagaatggcgatcctcggagacacggcctgggattttggcagcgtggggggagtgctgaactctctgggcaagatggttcaccagattttcgggtccgcttatacagccctctttagcggcgtctcttggatcatgaaaattggaatcggcgtgctgcttacctggattgggctgaatagcaagaacacctccatgtctttcagctgcatcgtgatcggaattatcacactctacctgggcgctgtcgtgcaggccgacatggggtgtgttattaattggaagggaaaagagctgaagtgcggctccgggatctttgtgaccaacgaggtccatacatggacggaacagtataaattccaagcggatagcccgaagcgccttgccaccgctattgccggcgcttgggagaatggagtgtgtggcatccggtctacaaccagaatggaaaacctcctgtggaaacagatcgccaatgagctgaactacattctctgggaaaataacatcaagctgacagttgtggtcggggacgtgattggagttcttgagcagggcaaacgcaccctgacgccccagcctatggagctcaagtattcctggaagacctgggggaaagccaagatcgtgacagctgaaacccaaaatagctcttttattatcgatggacccaacacacctgagtgcccctccgcgagccgggcctggaacgtctgggaagtggaggactacggcttcggcgtgtttaccacaaatatctggctgaaactgagagaaatgtatacccagctttgtgaccaccgcctcatgtccgctgccgtcaaggatgagcgggccgttcacgctgacatggggtactggattgagtctcagaaaaacggaagctggaagctggaaaaggcctccctgatcgaggtgaaaacgtgcacatggccgaagtctcataccctctggagcaatggcgtgctggaatccgatatgattatccctaaaagccttgcggggcccatttctcagcacaactacagacctggatatcatacccaaacagctggcccctggcacctggggaagctcgagctggacttcaattactgcgagggaaccacggtcgtgatcacagaaaactgtggcacccgcggcccttccctgcggacaaccacagttagcgggaaacttatccacgagtggtgctgtagatcttgcaccctccccccgctgcgctatatgggagaagatggctgttggtacgggatggagattcggcctatcaatgaaaaggaggagaacatggtgaagtccctggtcagcgccggatctggcaaagccgacaattttacgatgggggtgctctgcctggctattcttttcgaagaggttatgagaggaaagttcggcaaaaagcatatgatcgccggcgcgctgtttaccttcgtgctcctgctgagcgggcagattacatggcgggatatggctcacacccttatcatgattggatccaacgccagcgaccgcatgggcatgggggtcacatatctggccctcatcgctacctttaaaatccagcccttcctggccctcggatttttcctgagaaagcttacgtctcgggaaaatctgctcctgggcgtggggctggctatggccacaacccttcaactgcccgaggatattgaacagatggcgaacggaatcgccctcggcctgatggctctcaagctgattacacagtttgagacctaccagctttggaccgccctggtttccctcatgtgtagcaatacaatcttcacgctgaccgtggcttggagaacagccaccctgattcttgccgtcatctccctgctccctgtgtgccaatctagctccatgcgcaaaacagactggctgccgatgaccgtggctgcgatgggcgtcccccctctccccctgtttatcttctctcttaaggatacgctgaaacggagaagctggcctctgaacgagggggttatggccgtgggactcgtgtccattctggcttctagctttcttcgcaatgacgtccccatggccggccctctggtggccgggggactcctgatcgcttgttatgttattacaggcacctccgccgatctcaccgtggaaaaggcggctgacgtcacatgggaggaagaggccgaacagaccggggtgagccataacctgatgatcacagttgacgatgacggaacgatgagaattaaagatgacgagaccgagaacatccttacagtgctgctgaagaccgccctcctgatcgtctctggcattttcccctactccatcccggctacacttctggtgtggcacacctggcagaaacagacgcaacggagcggcgtcctctgggatgtgccttctccccctgaaacccagaaggccgagctggaagagggggtttaccgcattaagcagcagggaatctttggcaaaacacaagtgggggtcggagtgcagaaggagggcgttttccataccatgtggcacgtgacaagaggggcggtcctcacccacaatggaaaacggctggaacccaactgggctaatgtgaagaaagaccttatttcctatggcggcgggtggaagctgagcgcccagtggcaaaagggagaggaagtgcaggttatcgccgtcgagccgggcaaaaaccctaagaatttccagacaatgcccgggatttttcagacgaccacaggagaaatcggcgctatcgccctggatttcaaacctgggacctctggatcccccattatcaaccgcgagggcaaggtggtgggcctctacgggaatggagtcgtgaccaaaaacggcgggtatgttagcggaattgctcaaacaaatgccgagcccgacggccctacgccggaactggaggaagagatgtttaagaagagaaaccttaccatcatggatctgcatcccgggtccggcaaaacacggaagtacctccctgcgattgtgcgcgaagccatcaaaagacggctgcgcaccctcatcctggctcccacaagagtcgtggccgctgagatggaggaagcccttaagggactgcctattcggtatcagaccacggccacaaaaagcgagcacaccggcagagaaatcgttgacctgatgtgccatgctaccttcacaatgcgcctcctgtctcccgtgcgggtccctaattacaaccttattgtgatggatgaggcgcactttaccgacccggccagcatcgctgccagagggtatatttccacacgcgttggaatgggcgaagccgctgccatcttcatgaccgcgacgccccctgggacagctgatgcctttccccagtctaatgcccctatccaggacgaggagcgggacattcccgaaagaagctggaactccggaaatgagtggatcaccgatttcgctggcaagacagtgtggtttgtcccgtctattaaggccgggaacgacatcgcgaactgtctgcgcaaaaatggcaagaaagtgattcaactcagccggaagaccttcgatacggaataccagaaaaccaagctgaacgactgggattttgtggtcacaaccgacatctccgagatgggagccaatttcaaggctgatagagttattgaccctcgccggtgcctgaaacccgtgatcctcacagatggccccgagagagtgatccttgccgggcctatgcccgtcaccgtggcttctgccgctcagcggcgcggaagagttggccggaaccctcagaaggaaaatgaccaatacattttcacagggcagccgctgaacaatgatgaggaccatgcccactggaccgaagcgaaaatgctgctcgacaacatcaatacgcccgagggaattatccctgccctgtttgaacccgagcgcgagaagagcgctgccattgatggcgaatatagacttaaaggggagtcccggaagacattcgtggaactgatgagacgcggcgacctccctgtctggctggctcacaaagtggccagcgagggaatcaagtacaccgatcggaagtggtgctttgacggcgaaagaaacaatcagatcctggaggagaacatggatgttgaaatttggaccaaagagggggaaaagaaaaagctccgcccccggtggcttgacgccagaacatattctgatccgctggctctgaaagagttcaaggactttgcggccggacgcaagtccatcgctctcgatctggtgaccgaaattggccgggtccctagccatcttgcccacagaacacgcaatgccctggacaacctcgtgatgctgcatacgtctgagcacgggggaagagcttaccggcacgccgtcgaggaactgcccgagaccatggaaacactccttctgctgggcctcatgatcctgcttaccggcggggcgatgctgttcctcatttccggaaaaggcatcgggaagacaagcatcggactgatttgtgtggttgcctcctctggcatgctgtggatggctgatgtgcctctccagtggatcgccagcgctattgtgcttgagtttttcatgatggtcctgctgatccccgagcctgaaaaacaacgcaccccccaggacaatcagctcgcctatgttgtgattgggatcctgacgcttgcggccattgtggctgccaacgagatgggactgctcgaaaccacaaagagagatctgggcatgtccaaagagccgggcgtcgtgagccctacctcttacctggacgttgacctccatcccgcttccgcctggacactttatgctgtggccaccacggtcatcacacccatgctgcggcacaccatcgaaaatagcacagcgaacgtgtctctggccgctattgccaaccaagctgtcgtgctcatggggctggataagggatggcctatcagcaagatggaccttggcgttccgctgctcgccctggggtgctactcccaggtgaatcccctgaccctcaccgccgcggtccttctgctggtgacacattacgctattatcggacctggcctccaggccaaagctacgcgcgaggcccagaagagaaccgccgctgggattatgaaaaaccccacagttgatggaatcatgaccatcgacctggatcctgtgatttatgactctaagtttgagaaacaacttggccaggtcatgctgctcgtgctgtgtgccgtgcagctgctccttatgcggacaagctgggcgttctgcgaagccctgaccctggctacgggccccatcacaaccctctgggaggggtcccctggaaagttttggaataccacaattgccgtttctatggctaacatcttcagaggcagctacctggccggggcgggacttgccttttccattatgaagagcgtcggcaccgggaaacgcggaacaggctctcagggcgaaacgctgggggagaagtggaaaaagaaactcaatcaactgtcccggaaggaattcgatctgtataaaaagagcggaatcaccgaggtggacagaacagaggctaaggaaggcctcaaacgcggggagatcacccaccatgccgtgtcccggggatctgctaagcttcagtggttcgtcgaaagaaacatggttattccggagggccgggtgatcgatctggggtgtggacgcggcggctggagctactattgcgccgggctgaaaaaggtgacagaagtcagaggatacaccaaaggcgggcccggacacgaggagcctgtgcccatgtccacgtatggctggaatattgttaagctcatgtctgggaaggacgtgttttacctgcctcccgaaaaatgtgatacccttctgtgcgacatcggagagagctccccgagccctacagtcgaagagtctcggaccattcgcgtgctcaagatggttgagccctggctgaaaaacaatcagttctgtatcaaggtgctgaacccctacatgcctacagtcattgaacacctcgagagacttcagcggaaacatggcggcatgctggtgcgcaatcccctgtccagaaacagcacccacgaaatgtattggatctctaatgggacaggaaacatcgtgtccagcgtcaatatggtttctcggctcctgcttaaccgctttaccatgacgcatagacggcctacaattgagaaggatgtggacctgggcgctgggaccagacacgtgaacgccgaaccggagacccccaatatggacgtcatcggagagcgcattcggagaatcaaggaagagcacagctccacatggcattacgatgacgaaaacccttataaaacgtgggcgtaccacggctcttatgaggtgaaggccaccgggagcgcttccagcatgattaatggagttgtgaaactcctgacaaagccctgggatgtcgtgcctatggttacccaaatggccatgacagacaccacacccttcggccagcagcgcgtgtttaaagaaaaggtcgatacccggacgccgagacctatgcccggcacccgcaaggtgatggagatcacagctgagtggctgtggcggaccctcgggagaaacaaacgccctcggctgtgcacaagagaagagttcatcaagaaagttcgcaccaatgccgccatgggagcggtgtttacggaagagaaccaatgggactccgctcgggccgccgtcgaagatgaggagttctggaagcttgtggacagagaacgcgagctgcataaactcggcaagtgtgggtcttgcgtctacaatatgatgggaaaaagagaaaagaagctgggcgagtttgggaaagctaagggcagccgggccatttggtatatgtggcttggagctcgctacctggagttcgaagccctcggctttctgaacgaggatcactggttctccagagaaaattctcatagcggggtggagggagaaggcctgcacaaactcgggtacatcctgcgggacatttccaagatccccggaggcgcgatgtatgccgatgacacagctgggtgggacaccagaattacagaggatgaccttcacaacgaggaaaaaatcacccagcagatggatcctgagcatcggcagctggccaatgctatctttaagctcacgtaccaaaacaaggttgtgaaagtccagcgccccaccccgaagggcacagtgatggacattatctctagaaaagatcagcggggaagcggccaggtggggacctatggactgaatacattcaccaacatggaagcccaacttattcgccagatggagggcgaaggggttctgtccaaggcggacctcgagaatcctcacctgctggagaaaaaggtgacacagtggctcgaaaccaagggagtcgagagactgaaacggatggccatcagcggcgatgactgcgtggttaagcccattgatgaccgcttcgctaacgcccttctggctctcaacgatatggggaaagtgagaaaggacatcccccagtggcaaccttctaaaggctggcatgattggcagcaggtcccgttttgttcccaccacttccatgaactgatcatgaaggacggacggaagcttgtggtcccctgccgccctcaggacgagctgattggcagagcccggatcagccaaggggctggatggtctctccgcgaaacggcctgtctgggcaaagcgtacgcccagatgtgggctctgatgtattttcacagacgggatctccgcctggcctccaatgccatttgcagcgctgtgcccgttcattgggtgcctacatctagaaccacctggtccatccacgcccatcaccagtggatgacaaccgaggacatgcttacagtctggaaccgggtgtggattgaggataatccctggatggaagacaagacgcctgttaccacatgggaggatgtgccctacctggggaaaagagaagaccaatggtgtggaagcctcatcggcctgacctcccgcgcgacatgggctcagaacattcttaccgccatccagcaggtccggagcctgatcgggaatgaggagttcctcgattatatgccgtctatgaagagatttcgcaaagaagaggaaagcgagggcgccatttggtga

SEQ ID NO: 20911 - RNA, 9873 nt, synthetic construct
  misc_feature 1..9873: note = derived and/or modified CDS sequence (opt5) from DENV-3__JQ920488__SS-prME
  source 1..9873: mol_type = other RNA
accagcctgtgcctcatgatgatgctgcccgccacccttgctttccacctgacgtccagagacggagaacctcggatgatcgtggggaagaacgaacgcggaaaatctctcctgtttaagaccgccagcggaattaatatgtgtacacttatcgcgatggatctgggggaaatgtgcgacgataccgtgacatacaaatgtccgctcattaccgaagttgaacccgaagacatcgattgctggtgtaacctgacatccacctgggtgacgtatggaacctgcaatcaggctggcgagcatagacgggacaagcgctctgtggccctggcccctcacgtcgggatgggactcgatacaagaacccaaacatggatgagcgctgagggcgcctggagacaggtggaaaaagttgagacctgggctttccgccatcccggctttacgattctggcccttttcctggcgcactacatcgggacatccctcacccagaaggtggtcatctttattctgcttatgctggtgacaccttctatgaccatgagatgtgttggagtgggcaaccgggacttcgtcgaagggctcagcggagccacctgggtggatgtggtcctggagcatggcgggtgcgttacaacgatggctaagaataaacccaccctggacatcgagctccagaagacagaagccacccaactggctacacttcgcaaactgtgtattgagggaaagatcaccaacgtgacgacagattccagatgccctacccagggcgaagccattctcccggaggaacaggaccagaattatgtgtgtaaacacacctacgtcgatcggggctgggggaacggatgcggcctgtttgggaagggaagccttgtgacatgcgcgaagttccaatgtctggagtctatcgagggcaaagccgttcagcacgaaaatctcaagtataccgtgattatcacagtccatacgggggaccagcaccaggtgggaaacgagacccaaggcgttacagctgaaatcacaccccaggcctccacagtggaggctattctgcctgaatacggcaccctggggctcgagtgcagcccccgcacgggactggactttaatgagatgatccttctgaccatgaaaaacaaggcctggatggtccatagacagtggttctttgatctccctctgccctggacatctggcgccaccacagaaaccccgacgtggaataaaaaggagcttctggtgacattcaaaaacgctcacgcgaagaagcaagaagtcgtggttctcgggtcccaggagggagccatgcacaccgctctgacaggcgccaccgaaattcagaccagcgggggcacatctatctttgccggacatctgaaatgtcggctcaagatggacaaactggagcttaagggcatgtcctatgctatgtgcctgaatgccttcgtgctcaaaaaggaggtcagcgaaacgcagcacgggaccattctgatcaaggtggagtacaaaggagaagatgcgccttgtaagatccccttctccacagaggacggccaagggaaagctcataacggacgcctgattaccgccaaccctatcgttacaaagaaagaggaacccgtgaatattgaggccgaacccccttttggcgagtctaacatcgtcattgggatcggcgataaggctcttaagatcaattggtacaaaaagggaagctccattggcaaaatgttcgaagccaccgctagaggggcccggagaatggcgatcctcggagacacggcctgggattttggcagcgtcgggggagtgctgaactctctgggcaagatggttcaccagattttcgggtccgcttatacagccctctttagcggcgtctcttggatcatgaaaattggaatcggcgtgctgcttacctggattgggctgaatagcaagaacacctccatgtctttcagctgcatcgtgatcggaattatcacactctacctgggcgctgtcgtgcaggccgacatggggtgtgttattaattggaagggaaaagagctgaagtgcggctccgggatctttgtgaccaacgaggtccatacatggacggaacagtataaattccaagcggatagcccgaagcgccttgccaccgctattgccggcgcttgggagaatggagtgtgtggcatccggtctacaaccagaatggaaaacctcctgtggaaacagatcgccaatgagctgaactacattctctgggaaaataacatcaagctgacaattgttgtgggggacgtcatcggagtgcttgagcagggcaaacgcaccctgacgccccagcctatggagctcaagtattcctggaagacctgggggaaagccaagattgttacagctgaaacccaaaatagctcttttatcatcgatggacccaacacacctgagtgcccctccgcgctgcgggcctggaacgtgtgggaagtcgaggactacggcttcggcgtgtttaccacaaatatttggctgaaacttagagaaaagtatacccagctctgtgaccaccgcctgatgagcgctgccgtgaaagatgagcgggccgtccacgctgacatggggtactggatcgagtcccagaagaacgaatcttggaagctggagaaagccagcctcattgaagttaagacgtgcacatggccgaaatcccataccctgtggtctaatggagtgcttgagagcgatatgatcattcctaagtccctggcgggccccatcagccagcacaactacagacctgggtatcatacccaaacagctggaccctggcacctcggcaaactggagctggacttcaattactgcgaagggaccacggtggtcatcacagagaactgtggcattcgcggcccttctcttcggaccacaaccgtgtccggcaagctcatccacgaatggtgctgtagaagctgcacactgcccccgctgcgctatatgggggaggatggatgttggtacggcatggaaattcggcctatcaatgagaaggaggaaaacatggttaaatctctcgtgtccgccgggagcggaaagaccgacaattttacgatgggcgtcctgtgccttgccattctgttcgaggaagtgatgagagggaaattcggaaagaaacatatgatcgctggcgccctctttaccttcgttctgctgctttctggccagattacatggcgggatatggcgcacaccctgatcatgatcgggagcaacgcttccgaccgcatgggaatgggcgtgacatatctcgccctgattgccacctttaagatccagcccttcctcgctctggggtttttccttagaaagctgacgagccgggagaatctcctgctgggagtcggccttgccatggctacaaccctgcaactccccgaagatattgagcagatggccaacgggatcgcgctgggactcatggccctgaaacttattacacagtttgagacctaccagctgtggaccgctctcatctctctgatgtgttccaatacaatcttcacgctgaccgtggcctggagaacagctacccttattctggccgttatcagcctcctgcctgtgtgccaatcctctagcatgcgcaagacagactggctcccgatgaccgtcgccgctatgggcgtgccccctctgcccctttttattttctccctgaaagatacgctgaagcggagatcttggcctctcaacgaaggcgtgatggcggtcgggctggttagcatccttgcctcctcttttctgcgcaatgacgtgcccatggctggacctctcgtggccggcgggctgctcattgcctgttatgtcatcacaggaaccagcgctgatctgaccgtggagaaagccgcggacgttacatgggaagaggaagctgagcagaccggcgtgtcccataaccttatgatcacagtcgacgatgacgggacgatgagaattaaggatgacgagaccgaaaacatcctgacagtgctgctcaaaaccgccctgcttattgttagcggaatcttcccctactctattccggccacactgctcgtgtggcacacctggcagaagcagacgcaacggtccggcgtcctgtgggatgtgccttctccccctgagacccagaaggctgaactcgaggagggcgtctaccgcatcaaacagcaggggatttttggaaagacacaagtgggcgttggggtgcagaaagaaggagtcttccataccatgtggcacgtgacaagaggcgccgttctgacccacaatgggaagcggcttgagcccaactgggcgaatgtgaaaaaggacctgatctcctatggaggcggctggaagctgggggctcagtggcaaaaaggagaagaggtccaggtgatcgccgtggaaccgggcaagaaccctaaaaatttccagacaatgcccgggatttttcagacgaccacaggagagatcggcgccattgctctcgatttcaagcctgggacctccggaagccccatcattaaccgcgagggcaaagttgtcggcctgtacgggaatggagtggtgaccaagaacggcgggtatgtctctggaatcgcccaaacaaatgctgaacccgacggccctacgccggagcttgaagaggaaatgtttaagaaaagaaacctgaccatcatggatctccatcccgggtccggcaagacacggaaatacctgcctgccattgtgcgcgaggcgatcaagagacggctccgcaccctgattcttgcccccacaagagttgtggctgccgagatggaagaggctctgaaaggactgcctatccggtatcagaccacggccacaaagagcgaacacaccggcagagagattgtcgacctcatgtgccatgccaccttcacaatgcgcctgctttcccccgtgcgggttcctaattacaacctgatcgtgatggatgaagctcactttaccgacccggcgagcatcgccgctagagggtatatttctacacgcgtcggaatgggcgaggccgccgctatcttcatgaccgccacgccccctgggacagcggatgcttttccccagagcaatgcccctattcaggacgaggaacgggacatccccgagagatcctggaactctggaaatgaatggattaccgatttcgccggcaagacagtgtggtttgttccgagcatcaaagctgggaacgacattgccaactgtctccgcaagaatggcaaaaaggtgatccaactgtcccggaaaaccttcgatacggagtaccagaagaccaagctgaacgactgggattttgtcgtgacaaccgacatctctgagatgggagcgaatttcaaagccgatagagtgattgaccctcgccggtgcctcaagcccgtcatccttacagatggccccgaaagagttattctggctgggcctatgcccgtgaccgtggccagcgctgcccagcggcgcggaagagtcggccggaactcccagaaagagaatgaccaatacatcttcacagggcagcctctgaacaatgatgaagaccatgctcactggaccgaggccaagatgctcctggacaacattaatacgccggaaggaatcatccccgcgctttttgagcctgagcgcgaaaaatctgccgctattgatggcgagtatagactgaagggggaaagccggaaaacattcgtggagctcatgagacgcggcgacctgcccgtttggctggcccacaaggtggcttccgaaggaatcaagtacaccgatcggaaatggtgctttgacggcgagagaaacaatcagattctcgaggaaaacatggatgtcgagatctggaccaaggaaggggagaaaaagaaacttcgccctcggtggctggacgccagaacatatagcgatcccctggccctcaaggagttcaaggactttgctgcgggacgcaaatctattgccctggatcttgtgaccgagatcggccgggttccgtcccatctggctcacagaacacgcaatgccctcgacaacctggtgatgctgcatacgagcgagcacgggggccgggcctaccggcacgctgtcgaagaactccctgaaaccatggagacacttctgctgctcggcctgatgatccttctgaccggcggggccatgctgttcctgatttctggaaagggcatcgggaaaacatccattggactgatctgtgtggtcgcgagctccggcatgctctggatggccgatgtgccccttcagtggattgcttctgccatcgttctggagtttttcatgatggtgctgctcattcctgaacccgagaagcaacgcacccctcaggacaatcagctggcttatgtggtcatcgggatccttacgctggccgcgattgttgccgctaacgaaatgggactcctggagaccacaaaaagagatctgggcatgagcaaggaacccggcgtggtgtccccgaccagctacctcgacgtcgaccttcatcctgcctctgcttggacactgtatgccgtggctaccacggttatcacacccatgctgcggcacaccattgaaaatagcacagccaacgtgagcctcgcggccatcgctaaccaagccgtcgtgctgatggggcttgataagggatggcccatttctaaaatggacctgggcgtccctctcctggctctggggtgctacagccaggtgaatccgctcacccttaccgccgccgttctgctgctcgtgacacattacgcgatcatcggacccggcctgcaggctaaggccacgcgcgaggctcagaaaagaaccgccgccgggattatgaagaaccctacagtcgatggaatcatgaccattgaccttgatcccgtgatctatgactccaaatttgaaaagcaactgggccaggttatgctcctggtgctgtgtgctgtccagctccttctgatgcggacatcttgggccttctgcgaggcgctgaccctcgccacgggccctattacaaccctgtgggaagggagccccggaaagttttggaataccacaatcgctgtgtccatggccaacatcttcagaggctcttaccttgctggggccggactggcgtttagcattatgaaatccgtgggcaccgggaagcgcggaacaggcagccagggcgagacgctcggggaaaaatggaagaaaaagctgaatcaactgtctcggaaagagttcgatctctataagaagtccggaatcaccgaggttgacagaacagaagccaaagagggccttaagcgcggggaaattacccaccatgctgtcagccggggatccgccaaactgcagtggttcgtggagagaaacatggtgatccctgaaggccgggtcattgatctggggtgtggacgcggcggctggtcttactattgcgctgggctcaagaaagttacagaggtgagaggatacaccaagggcgggccgggacacgaggaacccgtgcctatgagcacgtatggctggaatatcgtcaagctgatgtccgggaaagacgtgttttaccttccccctgagaagtgtgataccctgctctgcgacattggagaatctagcccctccccgacagttgaggagagccggaccatccgcgtgctgaaaatggtcgaaccttggctgaagaacaatcagttctgtatcaaagtgctcaacccctacatgcccacagttattgagcaccttgaaagactgcagcggaagcatggcggcatgctggtgcgcaatcctctctctagaaactccacccacgagatgtattggatcagcaatgggacaggaaacattgtctcttccgtgaatatggtgagccggctgcttctgaaccgctttaccatgacgcatagacggcccacaatcgaaaaggatgtcgacctcggcgccgggaccagacacgttaacgctgagcctgagaccccgaatatggacgtgattggagaacgcatccggagaatcaaagaggaacactctagcacatggcattacgatgacgagaacccctataagacgtgggcctaccacggctcctatgaagtgaaagcgaccgggtctgccagctccatgattaatggagtcgtgaagctgctgacaaaaccttgggatgttgtgcccatggtcacccaaatggctatgacagacaccacacctttcggccagcagcgcgtgtttaaggagaaggttgatacccggacgcccagaccgatgcctggcacccgcaaagtgatggagatcacagccgaatggctctggcggaccctggggagaaacaagcgcccccggctttgcacaagagaggagttcattaaaaaggtccgcaccaatgctgccatgggagccgtgtttacggaggaaaaccaatgggacagcgcgcgggctgccgttgaggatgaggagttctggaaactggtggacagagagcgcgaactccataagctgggcaaatgtgggtcctgcgtctacaatatgatgggaaagagagagaagaaacttggcgagtttgggaaggccaaaggctctcgggctatctggtatatgtggctgggagcccgctacctcgagttcgaggctctgggctttctgaacgaagatcactggttcagcagagaaaattcccattctggggtggagggagagggcctccacaagctggggtacattcttcgggacatcagcaaaatccctggaggcgccatgtatgcggatgacacagccgggtgggacaccagaattacagaggatgacctgcacaacgaagagaagatcacccagcagatggatcccgaacatcggcagctcgctaatgccatttttaagctgacgtaccaaaacaaagtcgtgaaggttcagcgccctacccccaaaggcacagtgatggacatcatttccagaaaggatcagcggggatctggccaggtcgggacctatggacttaatacattcaccaacatggaggctcaactgatccgccagatggaaggcgagggggtgctcagcaaagccgacctggagaatccgcacctcctcgaaaagaaggtgacacagtggctggagaccaaaggagttgaaagacttaagcggatggcgatctccggcgatgactgcgtggtcaaacctattgatgaccgcttcgccaacgctctgctcgccctgaacgatatggggaaggtgagaaaagacatcccccagtggcaacccagcaagggctggcatgattggcagcaggttcctttttgttctcaccacttccatgagcttattatgaaggacggacggaaactggtggtcccgtgccgcccccaggacgaactcatcggcagagctcggatttcccaaggggccggatggagcctgcgcgagacggcttgtctgggcaaggcctacgcgcagatgtgggccctcatgtattttcacagacgggatctgcgccttgcttctaatgccatctgctccgccgtgcctgtccattgggtgcccacaagcagaaccacctggtctattcacgctcatcaccagtggatgacaaccgaggacatgctgacagtttggaaccgggtgtggatcgaagataatccttggatggaggacaaaacgcccgtcaccacatgggaagatgtgccttacctcgggaagagagaggaccaatggtgtggatccctgatcggccttaccagccgcgccacatgggcgcagaacattctgaccgctatccagcaggttcggtccctcattgggaatgaggagttcctggattatatgcccagcatgaaaagatttcgcaaggaggaagagtctgaaggcgccatctggtga

SEQ ID NO: 20912 - RNA, 9873 nt, synthetic construct
  misc_feature 1..9873: note = derived and/or modified CDS sequence (opt5) from DENV-3__JQ920489__SS-prME
  source 1..9873: mol_type = other RNA
accagcctgtgcctcatgatgatgctgcccgctacccttgctttccacctgacgtcccgggacggcgagcctcggatgatcgtggggaagaacgaacgcggaaagtctctcctgtttaagaccgccagcggcatcaatatgtgtacccttatcgcgatggatctgggggagatgtgcgacgataccgtcacatacaagtgtccgctcattaccgaagttgagcccgaagacatcgattgctggtgtaacctgacatccacctgggtgacgtatggaacctgcaatcaggctggcgagcatcggcgggacaagcgctctgtggccctggcccctcacgtcgggatgggactcgatacaagaacccagacatggatgagcgctgagggcgcctggcggcaggtcgaaaaggttgagacctgggctttccgccatcccggctttacgattctggcccttttcctggcgcactacatcgggacatccctcacccagaaggtggtcatctttattctgcttatgctggtgacaccttctatgaccatgagatgtgttggagtgggcaaccgggacttcgtcgaagggctcagcggagccacctgggtggatgtggtcctggagcatggcgggtgcgttacaacgatggctaagaataagcccaccctggacatcgagctccagaagacagaagccacccagctggctacacttcgcaagctgtgtattgagggaaagatcaccaacattacgacagattccagatgccctacccagggcgaagccatcctcccggaggaacaggaccagaattatgtgtgtaaacacacctacgtggatcggggctgggggaacggatgcggcctgtttgggaagggaagccttgtcacatgcgcgaagttccaatgtctggagtctattgagggcaaagccgtgcagcacgaaaatctcaagtataccgttatcatcacagtgcatacgggggaccagcaccaggtcggaaacgagacccaaggcgtgacagctgaaattacaccccaggcctccacagttgaggctatcctgcctgaatacggcaccctggggctcgagtgcagcccccgcacgggactggactttaatgagatgattcttctgaccatgaaaaacaaggcctggatggtgcatagacagtggttctttgatctccctctgccctggacatctggcgccaccacagaaaccccgacgtggaataaaaaggagcttctggtcacattcaaaaacgctcacgcgaagaagcaagaagtggtcgtgctcgggtcccaggagggagccatgcacaccgctctgacaggcgccaccgaaatccagaccagcgggggcacatctatttttgccggacatctgaaatgtcggctcaagatggacaaactggagcttaagggcatgtcctatgctatgtgcctgaatgccttcgttctcaaaaaggaggtgagcgaaacgcagcacgggaccatcctgatcaaggtcgagtacaaaggagaagatgcgccttgtaagattcccttctccacagaggacggccaagggaaagctcataacggacgcctgatcaccgccaaccctattgtgacaaagaaagaggaacccgttaatatcgaggccgaacccccttttggcgagtctaacattgtgatcgggatcggcgataaggctcttaagattaattggtacaaaaagggaagctccatcggcaaaatgttcgaagccaccgctagaggggcccggagaatggcgattctcggagacacggcctgggattttggcagcgtcgggggagtgctgaactctctgggcaagatggtgcaccagatcttcgggtccgcttatacagccctctttagcggcgtttcttggattatgaaaatcggaattggcgtcctgcttacctggatcgggctgaatagcaagaacacctccatgtctttcagctgcatcgtgattggaatcattacactctacctgggcgctgtggtccaggccgacatggggtgtgtgatcaattggaagggaaaagagctgaagtgcggctccgggatttttgttaccaacgaggtgcatacatggacggaacagtataaattccaagcggatagcccgaagcgccttgccaccgctatcgccggcgcttgggagaatggagtctgtggcatccggtctacaaccagaatggaaaacctcctgtggaaacagattgccaatgagctgaactacatcctctgggaaaataacattaagctgacaatcgtggttggggacgtgattggagtccttgagcagggcaaacgcaccctgacgccccagcctatggagctcaagtattcctggaagacctgggggaaagccaagatcgtgacagctgaaacccaaaatagctcttttatcattgatggacccaacacacctgagtgcccctccgcgagccgggcctggaacgtttgggaagtggaggactacggcttcggcgtctttaccacaaatatctggctgaaactgagagaaaagtatacccagctttgtgaccaccgcctcatgtccgctgccgtgaaagatgagcgggccgtgcacgctgacatggggtactggattgagtctcagaagaacggaagctggaagctggaaaaagcctccctgatcgaggtcaagacgtgcacatggccgaaatctcataccctctggagcaatggcgttctggaatccgatatgattatccctaagagccttgcggggcccatctctcagcacaactacagacctggatatcatacccaaacagctggcccctggcacctggggaaactcgagctggacttcaattactgcgagggaaccacggtggtgattacagaaaactgtggcatccgcggcccttccctgcggaccacaaccgtcagcgggaaacttattcacgagtggtgctgtagatcttgcacactgcccccgctgcgctatatgggagaagatggctgttggtacgggatggagatccggcctattaatgaaaaggaggagaacatggtgaaatccctggttagcgccggatctggcaagaccgacaattttacgatgggggtgctctgcctggccatccttttcgaagaggtcatgagaggaaaattcggcaagaaacatatgattgctggcgccctgtttaccttcgtgctcctgctgagcgggcagatcacatggcgggatatggcgcacacccttatcatgattggatccaacgctagcgaccgcatgggcatgggggttacatatctggccctcatcgccacctttaagattcagcccttcctggctctcggatttttcctgagaaaacttacgtctcgggaaaatctgctcctgggcgtggggctggccatggctacaacccttcaactgcccgaggatatcgaacagatggccaacggaattgcgctcggcctgatggccctcaaactgatcacacagtttgagacctaccagctttggaccgctctgatctccctcatgtgtagcaatacaattttcacgctgaccgtcgcctggagaacagctaccctgatccttgccgtgatttccctgctccctgtttgccaatctagctccatgcgcaagacagactggctgccgatgaccgtggccgctatgggcgtgccccctctccccctgtttatcttctctcttaaagatacgctgaagcggagaagctggcctctgaacgagggggtgatggcggtgggactcgtctccattctggcctctagctttcttcgcaatgacgttcccatggctggccctctggtggccgggggactcctgatcgcctgttatgtgatcacaggcacctccgctgatctcaccgtcgaaaaagccgcggacgtgacatgggaggaagaggctgaacagaccggggttagccataacctgatgattacagtggacgatgacggaacgatgagaatcaaggatgacgagaccgagaacattcttacagtcctgctgaaaaccgccctcctgatcgtgtctggcattttcccctactccatcccggccacacttctggtttggcacacctggcagaagcagacgcaacggagcggcgtgctctgggatgtcccttctccccctgaaacccagaaggctgagctggaagagggggtgtaccgcattaaacagcagggaatctttggcaagacacaagtcggggtgggagttcagaaagagggcgtgttccataccatgtggcacgtcacaagaggggccgtgctcacccacaatggaaagcggctggaacccaactgggcgaatgttaaaaaggaccttatctcctatggcggcgggtggaagctgagcgctcagtggcaaaaaggagaggaagtgcaggtcattgccgtggagccgggcaagaaccctaaaaatttccagacaatgcccgggatctttcagacgaccacaggagaaattggcgccatcgctctggatttcaagcctgggacctctggatcccccattatcaaccgcgagggcaaagtggttggcctctacgggaatggagtcgtgaccaagaacggcgggtatgtgagcggaatcgcccaaacaaatgctgagcccgacggccctacgccggaactggaggaagagatgtttaagaaaagaaaccttaccattatggatctgcatcccgggtccggcaagacacggaaatacctccctgccatcgtccgcgaagcgattaagagacggctgcgcaccctcatcctggcccccacaagagtggttgctgccgagatggaggaagctcttaaaggactgcctattcggtatcagaccacggccacaaagagcgagcacaccggcagagaaatcgtggacctgatgtgccatgccaccttcacaatgcgcctcctgtctcccgtccgggtgcctaattacaaccttatcgttatggatgaggctcactttaccgacccggcgagcattgccgctagagggtatatctccacacgcgtgggaatgggcgaagccgccgctattttcatgaccgccacgccccctgggacagcggatgcttttccccagtctaatgcccctatccaggacgaggagcgggacattcccgaaagaagctggaactccggaaatgagtggatcaccgatttcgccggcaagacagtctggtttgtgccgtctattaaagctgggaacgacatcgccaactgtctgcgcaagaatggcaaaaaggttatccaactcagccggaaaaccttcgatacggaataccagaagaccaagctgaacgactgggattttgtggtcacaaccgacatttccgagatgggagcgaatttcaaagccgatagagtgatcgaccctcgccggtgcctgaagcccgtgattctcacagatggccccgagagagtcatccttgctgggcctatgcccgttaccgtggcctctgctgcccagcggcgcggaagagtgggccggaacagccagaaagaaaatgaccaatacattttcacagggcagcctctgaacaatgatgaggaccatgctcactggaccgaagccaagatgctgctcgacaacatcaatacgccggagggaatcattcccgcgctgtttgaacctgagcgcgagaaatccgccgctatcgatggcgaatatagacttaagggggagagccggaaaacattcgtcgaactgatgagacgcggcgacctccccgtgtggctggcccacaaggttgcttctgagggaattaagtacaccgatcggaaatggtgctttgacggcgaaagaaacaatcagatcctggaggagaacatggatgtggaaatttggacccgcgagggggaaaagaaaaagctccggcctagatggcttgacgcccgcacatattccgatcccctggccctgaaagagttcaaggactttgctgcgggaagaaagagcatcgccctcgatctggtcaccgaaatcggcagagtgccgtctcatcttgctcaccgcacaagaaatgccctggacaacctcgttatgctgcatacgtccgagcacgggggacgggcctaccgccacgctgtggaggaactgcctgagaccatggaaacactccttctgctgggcctcatgattctgcttaccggcggggccatgctgttcctcatcagcggaaaaggcattgggaagacatccatcggactgatttgtgtcgtggcgtctagcggcatgctgtggatggccgatgtccccctccagtggatcgcttccgccattgtgcttgagtttttcatgatggttctgctgatccctgagcccgaaaaacaaagaacccctcaggacaatcagctcgcttatgtggtgatcgggattctgacgcttgccgcgatcgtcgccgctaacgagatgggactgctcgaaaccacaaagcgggatctgggcatgagcaaagagcccggcgttgtgtctccgacctcctacctggacgtggacctccatcctgccagcgcttggacactttatgccgtcgctaccacggtgattacacccatgctgcgccacaccatcgaaaattctacagccaacgttagcctggcggccattgctaaccaagccgtggtcctcatggggctggataagggatggcccatctccaagatggaccttggcgtgcctctgctcgctctggggtgctactctcaggtcaatccgctgaccctcaccgccgccgtgcttctgctggttacacattacgcgatcattggacccggcctccaggctaaagccacgagagaggctcagaagcggaccgccgccgggatcatgaaaaaccctacagtggatggaattatgaccatcgacctggatcccgtcatttatgacagcaagtttgagaaacaacttggccaggtgatgctgctcgttctgtgtgctgtgcagctgctccttatgagaacatcctgggccttctgcgaagcgctgaccctggccacgggccctatcacaaccctctgggaggggtctcccggaaagttttggaataccacaatcgctgtcagcatggccaacattttccgcggctcctacctggctggggccggacttgcgtttagcatcatgaagtctgtgggcaccgggaaacggggaacaggctcccagggcgaaacgctgggggagaagtggaaaaagaaactcaatcaactgagcagaaaggagttcgatctgtataaaaagtccggaattaccgaggtggaccgcatcgaggccaaggaaggcctcaaaagaggggaaattacacaccatgctgtttctagaggaagcgccaaacttcagtggttcgtcgaacggaacatggtgatccctgagggccgcgtgattgatctggggtgtggaagaggcggctggtcctactattgcgctgggctgaaaaaggtcaccgaagttcggggatacacaaaaggcgggccgggacacgaggagcccgtgcctatgtctacctatggctggaatatcgtgaagctcatgagcgggaaggacgtcttttacctgccccctgaaaaatgtgatacgcttctgtgcgacatcggagagtccagcccctctccgaccgtggaagagtcccgcacaattagagttctcaagatggtggagccttggctgaaaaacaatcagttctgtatcaaggtcctgaacccctacatgcccaccgtgattgaacacctcgagcggcttcagcgcaaacatggcggcatgctggttagaaatcctctgagccggaactctacacacgaaatgtattggatctccaatgggaccggaaacattgtgagctctgtcaatatggtgagccgcctcctgcttaacagatttacaatgacccatcggagacccacgatcgagaaggatgtggacctgggcgccgggacacgccacgtcaacgctgaacctgagaccccgaatatgaacgttatcggagagcggattagacgcatcaaggaggaacactcctctacctggcattacgacgatgaaaatccctataaaacatgggcctaccacggcagctatgaggtgaaggcgacggggtccgccagctccatgattaacggagtggtcaaactcctgaccaagccttgggacgtggttcccatggtgacacaaatggctatgaccgatacaacccctttcggccagcagcgggtctttaaagaaaaggtggacacaagaacaccccgcccgatgcctggcacgcggaaggttatggagatcaccgccgagtggctgtggagaacactcgggcgcaataaacggcccagactgtgcacccgcgaagagttcattaagaaagtgcggacaaacgctgccatgggagccgtctttaccgaagagaatcaatgggattctgcgagagctgccgtggaagacgaggagttctggaaacttgttgatcgcgaaagagagctgcataaactcggcaagtgtgggagctgcgtgtacaacatgatgggaaaacgggaaaagaagctgggcgagtttgggaaagccaagggctcccgcgctatctggtatatgtggcttggagccagatacctggagttcgaagctctcggctttctgaatgaggaccactggttctctcgggaaaacagccattccggggtcgagggagaaggcctgcacaaactcgggtacatcctgagagatatttctaagatccctggaggcgccatgtatgcggacgatacggccgggtgggacacacggattaccgaggacgatcttcacaatgaggagaaaattacacagcagatggaccccgaacatcgccagctggctaacgccatttttaagctcacctaccaaaataaggtggtcaaagtgcagagacctacgcccaagggcaccgttatggatatcatcagccggaaagaccagcgcggatccggccaggtggggacatatggactgaacaccttcacaaatatggaagctcaacttattagacagatggagggcgaaggggtcctgagcaaggccgatctcgagaacccgcacctcctggagaaaaaggtgacccagtggctcgaaacaaagggagtggagcggctgaaacgcatggcgatctctggcgacgattgcgttgtgaagcctattgacgatagattcgccaacgcccttctggccctcaatgacatggggaaagtccggaaggatatcccccagtggcaaccctccaaaggctggcatgactggcaacaggtgcctttttgtagccaccacttccatgaactgattatgaaggatggacgcaaacttgttgtgccgtgcagaccccaggacgagctgatcggccgggctcgcatttctcaaggggccggatggtccctcagagaaaccgcttgtctgggcaaagcctacgcgcagatgtgggccctgatgtattttcaccggcgcgacctcagactggctagcaacgccatctgctctgccgtccctgtgcattgggtccccacgtcccggacaacctggagcatccacgctcatcaccagtggatgaccacagaggatatgcttaccgtgtggaatagagtttggattgaggacaacccttggatggaagataagacacccgtgacgacctgggaggacgtcccttacctggggaaacgcgaagatcaatggtgtggatccctcatcggcctgacaagccgggccacctgggcgcagaatattcttacagctatccaacaggtgagatctctgattgggaacgaggagttcctcgactatatgcccagcatgaagcgctttcggaaagaagaggaatccgagggcgccatctggtga

SEQ ID NO: 20913 - RNA, 9873 nt, synthetic construct
  misc_feature 1..9873: note = derived and/or modified CDS sequence (opt5) from DENV-3__KF824902__SS-prME
  source 1..9873: mol_type = other RNA
acctccctgtgcctcatgatgatgctgcccgccacccttgctttccacctgacgtcccgggacggcgagcctcggatgatcgtggggaagaacgaacgcggaaagtctctcctgtttaagaccgccagcggcattaatatgtgtacccttatcgcgatggatctgggggagatgtgcgacgataccgtcacctacaaatgtccgctcattgctgaagttgagcccgaagacatcgattgctggtgtaacctgacctccacatgggtgacctatggaacgtgcaatcaggccggcgagcatcggcgggacaagcgctctgtggccctggctcctcacgtcgggatgggactcgatacccggacacagacctggatgagcgccgagggcgcttggagacaggtggaaaaagttgagacatgggccctgcgccatcccggcttcaccattcttgcgctgtttctcgcccactacatcgggacgtccctgacacagaaggtggtcatcttcattcttctgatgctcgtgaccccttctatggctatgagatgtgttggagtgggcaaccgggactttgtcgaagggctgagcggagccacatgggtggatgtggtcctggagcatggcgggtgcgttaccaccatggctaagaataaacccacactcgacatcgagctgcagaagacggaagccacccagcttgcgacactgcgcaaactctgtattgagggaaagatcaccaacattacaaccgattccagatgccctacgcagggcgaagccatcctgccggaggaacaggaccagaattatgtgtgtaaacacacatacgtggatcggggctgggggaacggatgcggccttttcgggaagggaagcctggtgacctgcgctaagtttcaatgtctcgagtctattgagggcaaagtggttcagcacgaaaatctgaagtataccgtgacaatcaccgtccatacaggggaccagcaccaggtgggaaacgacacgcaaggcgttaccgccgagatcacaccccaggcttccaccgtggaagccattctgcctgagtacggcacactcgggctggaatgcagcccccgcaccggacttgatttcaatgagatgatcctgctcacgatgaaaaacaaggcctggatggtccatagacagtggtttttcgacctgcctcttccctggacctctggcgctacaaccgagacaccgacctggaatcggaaagaactgctcgtgacgtttaagaacgcgcacgccaaaaagcaagaggtcgtggttctggggtcccaggaaggagctatgcacacagccctgaccggcgccacagagattcagaatagcgggggcacctctatcttcgctggacatctcaagtgtcgcctgaaaatggataaacttgaactgaaaggcatgtcctatgccatgtgcctcaacacctttgtgctgaagaaagaggtcagcgagacacagcacgggacgattctgatcaaggtggaatacaagggagaggacgcgccttgtaaaatccccttctccaccgaagatggccaagggaaggctcataacggaagacttattacagccaatcctgttgtgaccaaaaaggaggagcccgtcaacatcgaagccgagccccctttcggcgaatctaatattgtgatcgggattggcgacaaagctctcaagatcaactggtacaagaaaggaagctccatcggcaagatgtttgaggccacagctagaggggccagacgcatggcgattctgggagataccgcctgggacttcggcagcgtcggcggggttctcaattctctcgggaaaatggtccaccagatctttgggtccgcttatacggccctgttcggcggagtgagctggattatgaagatcggcattggggtgcttctgacatggatcggactcaactctaaaaataccagcatgtccttttcttgcattgtcatcggcatcattaccctgtacctggggacagtggttcaggctgatatgggatgtgtgatcaactggaagggcaaggaacttaaatgcgggagcggcattttcgtcaccaatgaggtgcatacatggacggagcagtataagtttcaagccgactccccgaaacggctcgcgaccgccatcgctggagcctgggaaaacggcgtttgtgggattagaagcacaacccgcatggagaatctgctgtggaagcagatcgctaacgaactcaattacatcctgtgggagaacaatattaaacttacagtggtcgtgggagatatcattggcgttctggaacaggggaagcgggccctcacaccccagcctatggagctgaaatattcttggaagacgtggggaaaggccaaaatcgtgaccgctgagattcaaaactccagcttcatcatcgacggccccaacacacctgaatgcccctctgcgtccagagcctggaatgtctgggaggtggaagactacggctttggggtgttcaccacaaacatttggctgaaacttcgcgaggtctatacccagacatgtgatcaccggctcatgagcgctgccatcaaagacgaaagagccgttcacgctgatatgggatactggattgagtcccagaagaatggctcttggaaactggagaaggccagctttatcgaagtgaagacctgcacgtggccgaaaacacataccctgtggtccaacggggtgctcgagtctgacatgattatccctaagagcctggcgggacccatctcccagcacaatcatcgccctggctaccacacccaaacagctgggccctggcaccttggaaaactggaactcgatttcaactattgcgagggcaccacggtcgtgattacagagaattgtggcacccgggggcctagcctgagaacaaccacagtttctggaaagctgatccatgaatggtgctgtcgctcctgcacccttcccccgctccggtacatgggcgaggacgggtgttggtatggaatggaaattagacctatcaacgagaaagaagagaatatggtcaagagcctggtgtctgccggctccgggaaggtggataactttacgatgggagttctgtgcctcgccattctgttcgaggaagtgatgcggggcaaattcggcaagaaacacatgatcgctggggtcctttttaccttcatgctgctcctgagcggacagattacatggcgcgacatggcccataccctgatcatgatcggctctaatgcgagcgatagaatggggatgggagtgacataccttgctctgattgccacctttaagatccagcccttcctcgccctgggctttttcctccggaaactgacgtccagagagaaccttctgctcggggttggactggctatggccacaaccctgcaacttcccgaagacattgagcagatggctaatggcatcgccctgggcctcatggcgctgaagctcattacacagtttgaaacctatcagctgtggaccgcccttgtgagcctgacatgttctaacacgatcttcaccctcacagtcgcttggcgcaccgccacactgatcctggctggggtgtcccttctgcctgtgtgccaaagctcctctatgcggaagaccgattggctcccggtcgccgttgccgctatgggagtgccccctctgcccctctttattttcagcctgaaagacacgcttaagagacgctcctggcctctgaatgagggcgtgatggcggtcgggctggtgtctatcctcgccagctccctgcttagaaacgatgttcccatggctggacctctggtggccggcgggctcctgattgcctgttacgtcatcacaggaacctctgctgacctcaccgtggagaaagccgcggacgttacatgggaagaggaagctgagcagaccggcgtgagccacaacctgatgattacagtcgatgacgatggcacgatgcggatcaaggacgatgaaaccgagaatatccttacagtgctgctgaaaaccgccctcctgattgtctccgggatctttccctatagcattccggccacacttctggtgtggcatacctggcagaagcagacgcaacgctctggagttctctgggacgtgccttctccccctgagacccagaaagctgaactggaggaaggcgtctacagaatcaagcagcaggggattttcggaaagacacaagtgggcgttggggtgcagaaagagggagtctttcacaccatgtggcacgtgacacggggcgccgtgctcacccataacggcaagcgcctggagcccaattgggcgagcgttaaaaaggatcttatcagctacgggggaggctggagactgtccgctcagtggcaaaaaggggaagaggtccaggtgattgccgtggaaccgggacggaaccctaagaatttccagacaatgcccggcatcttccagacgaccacaggggagatcggagccattgctctggactttaagcctggcaccagcggctctcccatcattaaccgcgaagggaaagtcgtgggactctatggcaatggggttgtgaccaagaacggaggctacgtctccgggatcgcccaagctaatgccgagcccgagggccctacaccggaactggaggaagagatgttcaaaaagagaaaccttacgattatggatctgcaccccggaagcggcaaaacccggaagtatctccctgcgatcgtgcgcgaagccatcaagagacggctgagaacactcattctggctcccacccgcgttgtggccgctgagatggaggaagcccttaaagggctgcctatccggtaccagacaaccgccacgaagtccgagcatacaggaagagaaattgtcgtgctgatgtgccacgctacctttaccatgcgcctcctgagccccgttcgggtgcctaattataaccttatcattatggacgaggcgcatttcacagatccggcctctatcgctgccagaggctacatcagcacccgcgtcgggatgggagaagccgctgccatttttatgacagcgacaccccctggcacggctgaggccttcccccagtccaatgcccctatccaggacgaggaacgggatattcccgagagatcttggaacagcgggaatgaatggatcacagactttgtgggcaaaaccgtgtggttcgtcccgtccattaaggctggaaacgacatcgccaactgtctgcgcaaaaatggcaagaaggttattcaactctctcggaaaacatttgataccgagtatcagaagacgaaactgaacgactgggatttcgtggtgaccacagacatcagcgagatgggggcgaattttaaggccgatagagtcatcgaccctcggcgctgcctgaaacccgtgattctcaccgatggacccgaaagagttatccttgctggccctatgcccgtgacagccgcttccgccgctcagcggcgcgggagagtcggacggaaccctcagaaggagaatgaccaatacattttcatgggccagccgctgaacaatgatgaagaccacgcccactggaccgaggcgaagatgctgctcgataacatcaatacacccgaagggattatccctgccctgttcgagcccgagagagaaaaatctgctgccatcgacggcgagtaccgccttaagggagaaagccggaaaacctttgtggagctgatgagacgcggcgacctccctgtttggctggctcataaggtggcctccgaagggattaaatatacggatcggaagtggtgcttcgacggagagagaaacaatcagatcctggaggaaaacatggatgtcgagatttggacaaaagaaggcgagcgcaagaagctccggcccagatggcttgacgcccgcacctacagcgatccgctggctctgaaagaatttaaggacttcgcggccgggagaaaatctatcgctctcgatctggtgaccgagattggacgggtcccttcccaccttgcccatcgcacaagaaatgccctggacaacctcgtgatgctgcacaccagcgagcacggcggccgggcttatcgccatgccgttgaggaactgcccgaaacaatggagacgctccttctgctggggctcatgatcctgcttaccggaggcgcgatgctgtttctcatctctgggaagggaattggcaaaacatccatcgggctgatttgtgtgatcgtgagctccggaatgctgtggatggccgatgtccctctccagtggattgcttctgccatcgttcttgagttctttatgatggtgctgctgattcccgaacctgagaagcaaagaacaccccaggacaatcagctcgcttacgtggtcatcggcatcctgacacttgccgcgattgtggccgctaacgaaatgggcctgctcgagaccacgaagcgggatctggggatgagcaaagaaccgggagttgtgtcccctaccagctatctggacgtcgatctccaccccgcctctgcttggacactttacgccgtggctaccacagtcatcacccccatgctgagacatacgattgaaaattccacagccaacgtgagcctggcggccatcgctaaccaagccgttgtgctcatgggcctggacaaggggtggcctatttctaaaatggaccttggagtcccgctgctcgctctgggctgctatagccaggtgaatcccctgaccctcacagccgccgttcttctgctggtgacccactacgcgatcatcgggcctggactccaggctaaggccacccgcgaggctcagaaacggacagccgccggcattatgaagaaccccacggtcgatggcatcatgaccattgacctggatcctgtgatctacgactccaagttcgaaaaacaacttggacaggtgatgctgctcgttctgtgtgctgtccagctgctccttatgagaacatcttgggccctgtgcgaggcgctgaccctcgccacaggacccattaccacgctgtgggaaggcagccctgggaagttttggaatacaaccatcgctgtgtccatggccaacatcttccgcggatcttatcttgctggcgccgggctggcgtttagcattatgaaatccgtgggaaccggcaagcggggcacagggagccagggagagaccctcggcgaaaaatggaagaagaaactgaatcaactgtctagacgggagttcgagctctacaagaaatccgggatcacagaagtcgatcgcacggaggccaaggaaggacttaaaagaggcgagaccacacatcacgctgttagccgggggtccgccaagctgcagtggtttgtggaacgcaacatggtgattccggagggaagagtcatcgacctgggctgtggcagagggggatggtcttattactgcgctggcctcaaaaaggtgaccgaggttcgcgggtatacaaagggaggccccgggcacgaagaacctgtgcccatgagcacctacggatggaatacggtcaaactgatgtccggcaaggatgtgttctatcttcctcccgaaaaatgtgacaccctgctctgcgatattggcgagtctagcccgtcccctacagttgaggaaagcagaaccatccgggtgctgaagatggtcgagccctggctgaaaaacaatcagttctgtattaaggtgctcaacccctacatgcctacagtgatcgaacatcttgagcgcctgcagagaaagcacgggggaatgctggtccggaatcccctctctagaaactccacccatgaaatgtactggatcagcaatggcacagggaacattgtttcttccgtgaatatggtgagccgcctgcttctgaaccggtttaccatgacgcacagacgccctacaatcgagaaagacgtcgatctcggagccggcacccggcacgtgaacgctgagccggaaacccccaatatggacgttattggggagagaatcaagcgcattaaagaagaacattctagcacatggcactatgatgacgaaaacccttacaagacgtgggcctatcatggatcctacgaggtgaaagcgaccggctctgccagctccatgatcaatggcgtcgtgaagctgctgacaaagccctgggacgttgtgcctatggtcacccaaatggctatgacagataccacacccttcgggcagcagcgggtgtttaaagagaaggttgacaccagaacgccgcgccctatgcccggaacccggaaagtgatggaaatcacagccgagtggctctggagaaccctgggccgcaacaagcggcctagactttgcacacgcgaagagttcaccaaaaaggtcagaacgaatgctgccatgggggccgtgtttacagaagagaaccaatgggagagcgcgcgggctgccgtcgaagatgaggagttctggaagctggtgggacgcgagagagagctccacaaactgggcaagtgtgggtcctgcgtttataatatgatgggcaaacgggaaaagaaacttggagagtttggcaaggccaaagggtctagagctatttggtacatgtggctgggagcccggtatctcgagttcgaggctctgggctttctgaacgaagaccattggttcagccgcgaaaattcctactctggggtggagggagaaggcctccacaagctggggtacatccttagagatattagcaagatccccggcggagccatgtatgcggacgataccgccggctgggacacacggattaccgaggatgacctgcacaacgaagagaaaatcacgcagcagatggatcctgaacatcgccagctcgctaatgccatctttaagctgacctaccaaaacaaagtcgtgaaggtgcagagacccacaccgaaagggaccgttatggacattatctcccggaaggaccagcgcggatctggccaggtggggacatatggacttaataccttcacaaacatggaggctcaactgattagacagatggagggcgaaggggtcctcagcaaggccgatctggagaatcctcatctgctggagaagaagatcacccagtggctggagacgaaaggcgtggaacggcttaagcgcatggcgatttccggagacgattgcgttgtgaaacccatcgacgatagatttgccaacgctctgctcgccctgaacgacatgggcaaggtccggaaggatatcccccagtggcaacctagcaaagggtggcacgactggcaacaggtgccgttctgttctcaccacttccatgagcttattatgaaggatggacgcaaactggtcgtgccctgcagacctcaggacgagctcatcggccgggctcgcatttcccaaggggccggatggagcctgaaggaaacagcttgtctgggcaaagcctacgcgcagatgtggtctctcatgtattttcacagacgggatctgagacttgcctccaatgctatctgcagcgccgttcccgtgcattgggtccctacctctcgcaccacatggtccattcacgcccatcaccagtggatgaccacagaggacatgctgacggtgtggaaccgggtttggatcgaagataatccctggatggaggacaagacccctgtgacaacctgggaggacgtcccctacctcgggaagagagaagatcaatggtgtggcagcctgattggacttacatcccgcgctacctgggcccagaacatcctgacggcgatccaacaggtgcggagcctcattggcgacgaggagttcctggattatatgccgtctatgaaaagatttcgcaaggaggaagagagcgagggggctatctggtga

SEQ ID NO: 20914 - RNA, 9873 nt, synthetic construct
  misc_feature 1..9873: note = derived and/or modified CDS sequence (opt5) from DENV-3__KF824903__SS-prME
  source 1..9873: mol_type = other RNA
accagcctgtgcctgatgatgatgctgcccgccacccttgctttccacctgacgagccgggacggcgaacctcggatgatcgtggggaagaacgaacgcggaaagtctctcctgtttaagaccgccagcggcattaatatgtgtacccttatcgcgatggatctgggggagatgtgcgacgataccgtcacatacaagtgtccgctcattgctgaagttgagcccgaagacatcgattgctggtgtaacctgacctccacatgggtgacctatggaacgtgcaatcaggccggcgagcaccggcgggacaagcgctctgtggccctggctcctcacgtcgggatgggactcgatacccggacacaaacctggatgagcgccgagggcgcttggagacaggtggaaaaggttgagacatgggccctgcgccatcccggcttcaccattcttgcgctgtttctcgcccactacatcgggacgtccctgacacagaaggtggtcatcttcattcttctgatgctcgtgaccccttctatggctatgagatgtgttggagtgggcaaccgggactttgtcgaagggctgagcggagccacatgggtggatgtggtcctggagcatggcgggtgcgttaccaccatggctaagaataaacccacactcgacatcgagctgcagaagacggaagccacccaacttgcgacactgcgcaaactctgtattgagggaaagatcaccaacattacaaccgattccagatgccctacgcagggcgaagccatcctgccggaggaacaggaccagaattatgtgtgtaaacacacatacgtggatcggggctgggggaacggatgcggccttttcgggaagggaagcctggtgacctgcgctaagtttcaatgtctcgagtctattgagggcaaagtggttcagcacgaaaatctgaagtataccgtgacaatcaccgtccatacaggggaccagcaccaggtgggaaacgacacgcaaggcgttaccgccgagatcacaccccaggcttccaccgtggaagccattctgcctgagtacggcacactcgggctggaatgcagcccccgcaccggacttgatttcaatgagatgatcctgctcacgatgaaaaacaaggcctggatggtccatagacagtggtttttcgacctgcctcttccctggacctctggcgctacaaccgagacaccgacctggaatcggaaagaactgctcgtgacgtttaagaacgcgcacgccaaaaagcaagaggtcgtggttctggggtcccaggaaggagctatgcacacagccctgaccggcgccacagagattcagaatagcgggggcacctctatcttcgctggacatctcaagtgtcgcctgaaaatggataaacttgaactgaaaggcatgtcctatgccatgtgcctcaacacctttgtgctgaagaaagaggtcagcgagacacagcacgggacgattctgatcaaggtggaatacaagggagaggacgcgccttgtaaaatccccttctccaccgaagatggccaagggaaggctcataacggaagacttattacagccaatcctgttgtgaccaaaaaggaggagcccgtcaacatcgaagccgagccccctttcggcgaatctaatattgtgatcgggattggcgacaaagctctcaagatcaactggtacaagaaaggaagctccatcggcaagatgtttgaggccacagctagaggggctagacgcatggcgattctgggagataccgcctgggacttcggcagcgtcggcggggttctcaattctctcgggaaaatggtccaccagatctttgggtccgcttatacggccctgttcggcggagtgagctggattatgaagatcggcattggggtgcttctgacatggatcggactcaactctaaaaataccagcatgtccttttcttgcattgtcatcggcatcattaccctgtacctggggacagtggttcaggctgatatgggatgtgtgatcaactggaagggcaaggaacttaaatgcgggagcggcattttcgtcaccaatgaggtgcatacatggacggagcagtataagtttcaagccgactccccgaaacggctcgcgaccgccatcgctggagcctgggaaaacggcgtttgtgggattagaagcacaacccgcatggagaatctgctgtggaagcagatcgctaacgaactcaattacatcctgtgggagaacaatattaaacttacagtggtcgtgggagatatcattggcgttctggaacaggggaagcgggccctcacaccccagcctatggagctgaaatattcttggaagacgtggggaaaggccaaaatcgtgaccgctgagattcaaaactccagcttcatcatcgacggccccaacacacctgaatgcccctctgcgtccagagcctggaatgtctgggaggtggaagactacggctttggggtgttcaccacaaacatttggctgaaacttcgcgaggtctatacccagacatgtgatcaccggctcatgagcgctgccatcaaagacgaaagagccgttcacgctgatatgggatactggattgagtcccagaagaatggctcttggaaactggagaaggccagctttatcgaagtgaagacctgcacgtggccgaaatcccatacactgtggtctaacggggtgctcgagagcgacatgattatccctaagtccctggcgggacccatcagccagcacaatcatcgccctggctaccacacccaaaccgctgggccctggcaccttggaaaactggaactcgatttcaactattgcgagggcacaaccgtcgtgattacggagaattgtggcacacgggggccttctctgagaaccacaaccgtttccggaaagctgatccatgaatggtgctgtcgcagctgcacacttcccccgctccggtacatgggcgaggacgggtgttggtatggaatggaaattagacctatcaacgagaaagaagagaatatggtgaagtctctggtctccgccggcagcgggaaggtggataactttaccatgggagttctgtgcctcgccattctgttcgaggaagtgatgcggggcaaattcggcaagaaacacatgatcgctggggtcctttttacgttcatgctgctcctgtctggacagattacctggcgcgacatggcccatacactgatcatgatcggcagcaatgcgtccgatagaatggggatgggagtgacctaccttgctctgattgccacatttaagatccagcccttcctcgccctgggctttttcctccggaaactgaccagcagagagaaccttctgctcggggttggactggctatggccacgacactgcaacttcccgaagacattgagcagatggctaatggcatcgccctgggcctcatggcgctgaagctcattacccagtttgaaacatatcagctgtggaccgcccttgtgtctctgacctgttccaacacaatcttcacgctcaccgtcgcttggcgcacagccaccctgatcctggctggggtgagccttctgcctgtgtgccaatcctctagcatgcggaagacagattggctcccggtcgccgttgccgctatgggagtgccccctctgcccctctttattttctccctgaaagacacccttaagagacgctcttggcctctgaatgagggcgtgatggcggtcgggctggtgagcatcctcgcctcctctctgcttagaaacgatgttcccatggctggacctctggtggccggcgggctcctgattgcctgttacgtcatcacgggaacaagcgctgacctcaccgtggagaaagccgcggacgttacctgggaagaggaagctgagcagacaggcgtgtcccacaacctgatgattaccgtcgatgacgatggcacaatgcggatcaaggacgatgaaacggagaatatccttaccgtgctgctgaaaacagccctcctgattgtcagcgggatctttccctattctattccggccacccttctggtgtggcatacatggcagaagcagacccaacgctccggagttctctgggacgtgccttctccccctgagacgcagaaagctgaactggaggaaggcgtctacagaatcaagcagcaggggattttcggaaagacccaagtgggcgttggggtgcagaaagagggagtctttcacacaatgtggcacgtgacccggggcgccgtgctcacacataacggcaagcgcctggagcccaattgggcgtccgttaaaaaggatcttatctcctacgggggaggctggagactgagcgctcagtggcaaaaaggggaagaggtccaggtgattgccgtggaaccgggacggaaccctaagaatttccagaccatgcccggcatcttccagacaacgaccggggagatcggagccattgctctggactttaagcctggcacatctggctcccccatcattaaccgcgaagggaaagtcgtgggactctatggcaatggggttgtgaccaagaacggaggctacgtcagcgggatcgcccaagctaatgccgagcccgagggccctaccccggaactggaggaagagatgttcaaaaagagaaaccttacaattatggatctgcaccccggatccggcaaaacgcggaagtatctccctgcgatcgtgcgcgaagccatcaagagacggctgagaaccctcattctggctcccacacgcgttgtggccgctgagatggaggaagcccttaaagggctgcctatccggtaccagaccacagccaccaagagcgagcatacgggaagagaaattgtcgagtgcatgtgtcacgctacatttaccatgcgcctgctctctcccgtgcgggttcctaattataacctgatcattatggacgaagcgcatttcaccgatccggccagcatcgctgccagaggctacatctccacacgcgtggggatgggagaggccgctgccatttttatgaccgcgacaccccctggcaccgctgaggccttcccccagtctaatgcccctatccaggacgaagaacgggatattcccgaaagaagctggaactccgggaatgagtggatcacggactttgtcggcaaaacagtgtggttcgtgccgtctattaaggctggaaacgacatcgccaactgccttcgcaaaaatggcaagaaggtcattcaactgagccggaaaacctttgatacagagtatcagaagaccaaactcaacgactgggatttcgttgtgacgaccgacatctccgaaatgggggcgaattttaaggccgatagagtgatcgaccctcggcgctgcctgaaacccgtcattctgacagatggacccgagagagtgatcctcgctggccctatgcccgttaccgccgcttctgccgctcagcggcgcgggagagtgggacggaaccctcagaaggaaaatgaccaatacattttcacaggccagccgcttaacaatgatgaggaccacgcccactggaccgaagcgaagatgctgctggataacatcaatacacccgaggggattatccctgccctcttcgagcccgaaagagagaaaagcgctgccatcgacggcgaataccgcctgaagggagagtcccggaaaacctttgtcgaacttatgagacgcggcgacctgcctgtgtggctcgctcataaggttgccagcgaggggattaaatatacggatcggaagtggtgtttcgacggagagagaaacaatcagatcctggaagagaacatggatgtggaaatttggacaaaagagggcgaacgcaagaagctgcggcccagatggctcgacgcccgcacctactctgatccgcttgctctgaaagagtttaaggacttcgcggccgggagaaaatccatcgctctggatctcgtcaccgagattggacgggtgcctagccacctggcccatcgcacaagaaatgcccttgacaacctggtcatgctccacacctctgaacacggcggccgggcttatcgccatgccgtggaggaactgcccgagacaatggagacgctgctccttctggggctgatgatcctcctgaccggaggcgcgatgctttttctgatctccgggaagggaattggcaaaacaagcatcgggctcatttgcgttatcgtgtcctctggaatgctgtggatggccgatgtgcctctgcagtggattgctagcgccatcgtcctcgagttctttatgatggttcttctgattcccgagcctgaaaagcaaagaacaccccaggacaatcagctggcttacgtggtgatcggcatcctcacactggccgcgattgtcgccgctaacgagatgggccttctggaaaccacgaagcgggatctcgggatgtccaaagagccgggagtggttagccctacctcttatctggacgtggatctgcaccccgcctccgcttggacactctacgccgtcgctaccacagtgatcacccccatgcttagacatacgattgagaatagcacagccaacgtctctctggcggccatcgctaaccaagccgtggttctgatgggcctcgacaaggggtggcctattagcaaaatggacctgggagtgccgcttctggctctcggctgttattcccaggtcaatcccctgaccctgacagccgccgtgctccttctggttacccactacgcgatcatcgggcctggactgcaggctaaggccacccgcgaagctcagaaacggacagccgccggcattatgaagaaccccacggtggatggcatcatgaccattgacctcgatcctgtcatctacgactctaagttcgagaaacaactgggacaggtgatgcttctggtgctctgcgctgttcagctgctgctcatgagaacaagctgggccctttgtgaagcgctgaccctggccacaggacccattaccacgctctgggagggctcccctgggaagttttggaatacaaccatcgctgtctctatggccaacatcttccgcggaagctatctggctggcgccgggcttgcgttttccattatgaaaagcgtgggaaccggcaagcggggcacagggtctcagggagaaaccctgggcgagaaatggaagaagaaactcaatcaactgtccagacgggagttcgaactgtacaagaaaagcgggatcacagaggtggatcgcacggaagccaaggagggactcaaaagaggcgaaaccacacatcacgctgtctcccgggggtctgccaaacttcagtggtttgttgagcgcaacatggtgattccggagggaagagtgatcgacctgggctgcggcagagggggatggagctattactgtgctggcctgaaaaaggtcaccgaagtgcgcgggtatacaaagggaggccccgggcacgaggaacctgttcccatgtccacctacggatggaatacggtgaaactcatgtctggcaaggatgtcttctatctgcctcccgagaaatgcgacacccttctgtgtgatattggcgagagctccccgagccctacagtggaagagtctagaaccatccgggttctcaagatggtggaaccctggctgaaaaacaatcagttctgcattaaggtcctgaacccctacatgcctacagtgatcgagcatctcgaacgccttcagagaaagcacgggggaatgctggtgcggaatcccctgtccagaaacagcacccatgagatgtactggatctctaatggcacagggaacattgtctccagcgttaatatggtgtctcgcctcctgcttaaccggtttaccatgacgcacagacgccctacaatcgagaaagacgtggatctgggagccggcacccggcacgtcaacgctgaaccggagacccccaatatggacgtgattggggaaagaatcaagcgcattaaagaggaacatagctccacatggcactatgatgacgagaacccttacaagacgtgggcctatcatggatcttacgaggttaaagcgaccggcagcgcctccagcatgatcaatggcgtggtcaagctcctgacaaagccctgggacgtggttcctatggtgacccaaatggctatgacagataccacacccttcgggcagcagcgggtctttaaagaaaaggtggacaccagaacgccgcgccctatgcccggaacccggaaagttatggagatcacagccgaatggctgtggagaaccctcggccgcaacaagcggcctagactgtgtacacgcgaggagttcaccaaaaaggtgagaacgaatgctgccatgggggccgtctttacagaggagaaccaatgggaatccgcgcgggctgccgtggaggatgaagagttctggaaacttgtcggacgcgagagagaactgcacaaactcggcaagtgcgggtcttgcgtgtataatatgatgggcaaacgggagaagaaactgggagaatttggcaaggccaaagggagcagagctatttggtacatgtggcttggagcccggtatctggagttcgaagctctcggctttctgaacgaggaccattggttctcccgcgaaaattcttacagcggggttgaaggagagggcctgcacaagctcgggtacatcctgagagatatttccaagatccccggcggagccatgtatgcggacgataccgccggctgggacacacggattaccgaagatgaccttcacaacgaggagaagatcacgcagcagatggatcctgagcatcgccagctggctaatgccatctttaagctcacctaccaaaacaaagtggtcaaggtgcagagacccacaccgaaagggaccgtgatggacattatctctcggaaggaccagcgcggaagcggccaggttgggacatatggactgaataccttcacaaacatggaggctcaacttattagacagatggaaggcgagggggtgctgtccaaggccgatctcgaaaatcctcatctgctggagaaaaagatcacccagtggctcgaaacgaaaggcgtcgagcggctgaagcgcatggcgattagcggagacgattgtgtggttaaacccatcgacgatagatttgccaacgcccttctggccctcaacgacatgggcaaggtgcggaaggatatcccccagtggcaaccttctaaagggtggcatgactggcagcaggtcccgttctgctcccaccacttccatgagctgattatgaaggatggacgcaaacttgtggtcccctgtagacctcaggacgaactgatcggccgggctcgcattagccaaggggccggatggtctctcaaggagacagcttgcctgggcaaagcctacgcgcagatgtggtccctgatgtattttcacagacgggatctcagactggccagcaatgctatctgttctgccgtgcccgttcattgggtgcctacctcccgcaccacatggagcattcacgcccatcaccagtggatgaccacagaagacatgcttacggtctggaaccgggtgtggatcgaggataatccctggatggaggacaagacccctgttacaacctgggaagacgtgccctacctggggaagagagaggatcaatggtgcggctccctcattggactgacaagccgcgctacctgggcccagaacatccttacggcgatccagcaggtccggtctctgattggcgacgaagagttcctcgattatatgccgagcatgaaaagatttcgcaaggaagaggagtccgaaggggctatctggtga

SEQ ID NO: 20915 - RNA, 9873 nt, synthetic construct
  misc_feature 1..9873: note = derived and/or modified CDS sequence (opt5) from DENV-3__JF504679__SS-prME
  source 1..9873: mol_type = other RNA
acaagcctgtgcctcatgatgatcctgcccgccgctcttgccttccacctgacatcccgggacggcgaacctcggatgattgtggggaagaacgaacgcggaaaatctctcctgtttaagacggcgagcggcatcaatatgtgtacacttattgctatggatctgggggagatgtgcgacgatacagtgacctacaaatgtccgcatatcacagaagttgagcccgaagacattgattgctggtgtaacctcacctccacatgggtgacctatggaacgtgcaatcaggccggcgagcaccggcgggacaagcgctctgtggccctggctcctcatgttgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtgattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcagtgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgccccctgtaaaattcctttcagcaccgaggacggccaagggaaggcgcataacggaagactgatcacagctaatcccgttgtgaccaaaaaggaggaacccgtcaacattgaggccgaacctccgttcggcgagtccaatatcgtgattgggatcggcgataacgccctgaaaatcaattggtataagaagggatctagcattggcaaaatgtttgaagctacggccagaggggctagacgcatggccatccttggagacacagcgtgggatttcggctccgtcggaggggttctcaacagcctgggcaagatggtccaccagatttttgggtctgcctacaccgctctgttctccggcgtgagctgggtgatgaaaatcggaattggcgtcctcctgacctggatcgggcttaattctaagaacacaagcatgtccttttcttgcattgccatcggaatcattaccctgtatctcggcgctgtggttcaggccgacatggggtgtgtgatcaattggaaaggaaaggagctgaagtgcggcagcgggattttcgtcacaaacgaggtgcatacgtggaccgaacagtacaaatttcaagcggattcccccaagcggctggccacagttatcgctggcgcctgggagaatggagtgtgtggcattagaagcaccacacgcatggaaaaccttctctggaaacagatcgctaatgagctgaactatatcctgtgggaaaataacattaagctcaccgtcgtggttggggacacgatcggagtgctggagcagggcaaacggacccttacacctcagcccatggagctgaagtactcttggaaaacctgggggaaggccaagattgtcacagccgaaacccaaaactccagcttcatcattgatggacctaatacacccgagtgcccgtctgcttccagagcgtggaacgtgtgggaagtggaggactatggctttggcgtcttcaccacgaatatctggctcaaactgcgcgaagtttacacacagatgtgtgaccaccggctgatgagcgccgctgtgaaggatgagagagccgtgcacgccgacatggggtactggatcgagtcccagaaaaacggatcttggaaacttgaaaaagctagcctcattgaggtcaagacctgcacctggcctaagtcccatacactgtggtctaatggcgtgctggaaagcgatatgatcattcccaaatccctcgccgggcctgttagccagcacaactatcgccccggataccatacccaaacggcgggcccttggcacctggggaaacttgagctggactttaattattgcgagggaacaaccgtggtcatcacagaaaactgtggcacccggggcccctctctcagaacaaccacggtgtccgggaaactgattcacgagtggtgctgtcgcagctgcaccctgccgcctcttcggtacatgggagaagatggctgttggtatgggatggagatcagacccatctctgaacgggaggagaatatggttaagtccctcgtgagcgctggatctggcaaagtcgacaacttcacaatgggggtgctgtgcctggccattctctttgaagaggttatgcgcggaaagttcggcaagaaacatatgatcgccggcgtgttctttaccttcatgctgcttctgagcgggcagattacatggagagatatggctcacaccctcatcatgattggatccaatgccagcgaccggatgggcatgggggtcacgtacctggcgctgatcgctacatttaagattcagcccttccttgccctgggatttttcctcagaaaactgacctctcgcgaaaacctcctgcttggcgtggggctggccatggctacaaccatccaactccctgaggatatcgaacagatggccaatggaattgctctgggcctgatggcccttaagctgatcacccagtttgagacatatcagctctggacggcgctgatttccctcacctgtagcaacacaatcttcaccctgacagtggcctggcggaccgctacgcttattctggccggcgtctccctcctgccggtttgccaatctagctccatgagaaaaacagactggctgcccatgaccgtggctgccatgggggtgcctccccttcctctgtttatcttctctctcaaggataccctgaagcgcagaagctggcccctcaatgagggagtcatggccgtgggcctggtttccatccttgcttctagcctgctgcggaacgacgtgcctatggcggggcccctcgtcgccggaggcctgcttattgcttgttacgtgatcacagggacctccgccgatctgacagttgaaaaagccgctgacgtgacgtgggaggaagaggccgaacagaccggagtcagccataacctcatgattacagtggacgatgacggcaccatgcgcatcaaggatgacgagacagagaatattctgaccgtcctcctgaaaacggcgcttctgatcgtgtctggcatctttccgtactccattcctgctaccctgctcgtttggcacacatggcagaagcagacccaaagaagcggggtgctgtgggatgtcccctctcctcccgaaacacagaaagccgagcttgaagagggagtgtatcggatcaagcagcagggcattctggggaaaacccaagttggagtgggcgtccagaaggagggggtgttccatacaatgtggcacgtgacgcgcggagccgttctcacccacaacggcaagagactggaaccgaattgggcttccgtcaaaaaggacctcatcagctacggcgggggatggcggctgtctgcccagtggcaaaaaggcgaggaagtccaggtgattgcggtcgagcctgggaagaaccccaaaaattttcagacaatgcctggaaccttccagaccacaacgggcgaaatcggggctattgcccttgatttcaagcccggaacctccggcagccccatcatcaaccgcgagggcaaggtggttgggctgtatggaaatggcgtggtcaccaagaacgggggatacgtgtccggcattgcccaaaccaatgctgagcctgacgggccgacacccgaactggaggaagagatgtttaagaaaagaaacctcaccatcatggatctgcatcctggcagcggaaagacgcggaaatatcttcccgccattgttcgcgaagctatcaagagacggctgagaacactcattctggcccctacccgcgtggtcgcggccgagatggaggaagctctcaagggcctgcccatccggtaccagaccacagccaccaaatctgagcacacagggagagaaatcgtggaccttatgtgccatgctaccttcacgatgcgcctgctgagccctgttcgggtgccgaattataacctcattatcatggatgaggcccactttacagaccccgcctccattgctgcgagaggatacatctctacccgcgtcggcatgggggaagccgctgccattttcatgacagccacccctcccggaacggctgatgcctttcctcagagcaatgcgcccatccaggacgaggagcgggacatcccggaaagatcctggaactctggcaatgagtggattaccgatttcgctgggaagacagtgtggtttgtgcctagcatcaaagccggcaacgacattgccaactgtctgcgcaagaatgggaaaaaggtcatccaactttcccggaagaccttcgatacagaataccagaaaaccaagctgaacgactgggattttgttgtgacaaccgacatttctgagatgggcgctaatttcaaagccgatagagtgatcgacccccggcgctgcctcaagcccgtcattctgacggatgggcctgagagagtgatcctggcgggacccatgcctgttacagtggccagcgctgcccagcggcgcggcagagtcgggcggaacccgcagaaagaaaatgaccaatatatctttaccggacagcccctcaacaatgatgaggaccatgctcactggaccgaagccaagatgcttctggacaacattaatacacctgagggcatcattcccgctctgttcgaacctgagagagagaagtccgccgcgatcgatggggaataccgcctcaaaggcgagagccggaagaccttcgtggaactgatgagacgcggagaccttcccgtttggctggcccacaaagtggcttctgagggcattaagtatacagatcggaaatggtgctttgacgggcagagaaacaatcagatcctcgaagagaacatggatgtcgagatctggacgaaggaaggagagaaaaagaagctgcgcccgcggtggctggacgccagaacctactccgatcctctcgctcttaaagagttcaaggactttgccgccggccgcaaaagcattgctctggatctggtgacagagatcgggagagtcccctctcatctcgcgcaccggacccgcaatgccctggacaaccttgtgatgctgcatacatccgaacacggaggcagagcttatcggcacgccgttgaggagctccctgaaaccatggagacgctgctgctccttggcctgatgattctgctcaccgggggagccatgctgttccttatcagcggcaaggggattggaaaaacatccatcggcctgatctgtgtgattgcttctagcgggatgctctggatggccgaaatccccctgcaatggattgcgtccgccatcgtgctggagtttttcatgatggtcctccttattcctgagcccgaaaagcagcgcaccccgcaggataatcaactggcttacgttgtgatcggcattctcacactcgccgctatcatcgccgcgaacgagatgggactgcttgaaaccacgaagagagacctgggcatgagcaaagagcctggggtggtctctcccacatcctatctcgatgtggacctgcatcccgccagcgcttggaccctgtacgccgttgctacaaccgtgattacccctatgctccggcacacaatcgaaaattctacggccaacgtcagccttgctgccattgcgaaccaggccgtggtcctgatgggactggacaagggctggccgatctccaaaatggatctcggggtgcccctgcttgctctgggatgctactctcaggttaatcctctcaccctgacagccgctgtgctgctccttgtcacccattatgccattatcggccccgggctgcaggccaaggcgacaagagaggctcaaaaacgcaccgccgctggaatcatgaagaaccctacggtggacggcattatcacaattgatctggaccccgttatctacgatagcaagtttgagaaacagctcggccaggtgatgctgcttgtcctgtgtgccgtgcagctcctgctgatgcggacctcctgggccctctgcgaagctcttaccctggccacagggcctattaccacactgtgggagggatctccgggcaagttctggaatacgaccatcgcggtgagcatggccaacatctttagagggtcctatctcgctggagccggcctggctttcagcattatgaaatctgttgggacaggaaagcgcggcaccggctcccaaggggaaacacttggagagaaatggaagaagaaactgaatcagctcagccggaaggaatttgacctgtacaaaaagtccggcatcaccgaggtcgatagaacggaggccaaagaagggctgaagcggggagagaccacacaccatgcggtgtctcgcggcagcgccaaactccagtggttcgtggaaagaaacatggtcattcccgaggggcgggttatcgaccttggatgtggccgcggcgggtggtcctattactgcgctggactgaagaaggtgaccgaagtgagaggctatacaaaagggggacctggccacgaggagcccgtccctatgtctacctacgggtggaatattgtgaagctgatgagcggaaaagatgtcttttacctgcccccggaaaagtgtgacacactgctttgcgatatcggcgagtccagcccttctcccaccgtggaagagtcccggacgattcgcgtcctgaaaatggtggagccctggctcaagaacaatcagttctgtatcaaggttctgaacccttatatgcccgccgtgatcgaacacctggagagactccaacggaaacatggcgggatgcttgtccgcaatcctctgagcagaaactctacacacgaaatgtactggatttccaatggaaccggcaacatcgtgagctctgtgaatatggtcagccggctgctcctgaacagattcaccatgacacatcgccggccgacgattgagaaggacgttgatcttggggctggaaccagacacgtgaacgccgaacccgagacacctaatatggacgtgatcggcgagcgcattcggagaatcaaagaagaacacaactccacctggcattatgacgatgaaaatccctacaagacatgggcttatcacgggtcttacgaggtcaaagccaccggaagcgcgtccagcatgatcaacggcgtggttaagctgctcacaaagccttgggacgtggtccccatggtgacccagatggccatgacggataccacaccgtttggccagcaacgcgttttcaaagaaaaggtggacacccggacacctagacccatgcctgggacccgcaaagtcatggagattacggctgagtggctgtggcggacactgggaagaaataagcgcccccggctctgcaccagagaagagtttaccaagaaggtgcgcaccaacgccgctatgggcgccgttttcacggaagagaatcagtgggattccgccaaggcggctgtggaagacgaggagttttggaaactggtcgatagagaacgggagcttcataagctggggaaatgtggatcttgcgtgtataacatgatgggcaagcgcgagaaaaagctcggggagttcggcaaagccaagggaagcagagccatctggtacatgtggctgggcgctcggtaccttgagtttgaagccctggggttcctcaatgaggaccactggttttccagagaaaactcttatagcggagtcgagggcgaagggctgcataagctgggatacattctccgggatatctccaaaattcctggcggggctatgtatgccgacgataccgcgggctgggacacacgcatcaccgaggacgatctgcacaatgaggaaaagatcacacagcagatgaaccccgagcacagacttctggccaatgctattttcaaactcacctaccaaaacaaggtggttaaagtgcagcggccgacacctaccggaacggtcatggacatcatttctcgcaaggatcagagaggcagcggacaggtgggaacatatggcctgaatacctttaccaacatggaagcccaacttgtgcggcagatggagggggaaggagttctgtccaaggctgacctcgagaacccccatctgcccgagaaaaagatcacacagtggctggaaaccaaaggcgtggagcgcctcaagagaatggccattagcggggatgactgcgtcgtgaaacctatcgatgaccggttcgcgaatgccctgcttgctctgaacgatatgggcaaggttcgcaaggacatcccgcagtggcaaccctctaaaggatggcacgattggcaacaggtgcctttttgttcccatcacttccacgaactcattatgaaggacggcagaaaactggtcgtgccctgccggcctcaggatgagcttatcgggcgcgccagaattagccaaggagctggctggtctctgcgggaaacagcctgtctcgggaaggcttacgcccagatgtggtccctgatgtatttccatcgcagagacctgcggctcgcgagcaatgccatctgctctgctgtccccgtgcactgggttcctacgtccagaaccacatggagcattcatgcccaccatcagtggatgaccacagaggacatgctgaccgtgtggaaccgcgtctggatcgaggataatccctggatggaagacaaaacgccggtgaccacatgggagaacgttccttaccttggaaagcgggaagatcaatggtgtggctccctgattgggctcaccagcagagccacatgggctcagaatatccccaccgccatccaacaggtgcgctctctgattggcaacgaggagtttcttgactacatgcctagcatgaagcggttcagaaaagaagaggaatccgagggagcgatctggtga

SEQ ID NO: 20916 - RNA, 9873 nt, synthetic construct
  misc_feature 1..9873: note = derived and/or modified CDS sequence (opt5) from DENV-3__KC425219__SS-prME
  source 1..9873: mol_type = other RNA
accagcctgtgcctcatgatgatcctgcccgccgctcttgccttccacctgacctccagagacggagaacctcggatgattgtggggaagaacgaacgcggaaaatctctcctgtttaagacggcgagcggaatcaatatgtgtacccttattgctatggatctgggggaaatgtgcgacgatacagtgacctacaaatgtccgcacatcaccgaagttgagcccgaagacattgattgctggtgtaacctcacctccacatgggtgacctatggaacgtgcaatcaggccggcgagagacggcgcgacaagagatctgtggccctggctcctcacgtcgggatgggactggatacccggacacagacctggatgagcgccgagggcgcttggcgccaggtggaaaaagttgagacatgggccctcagacatcccggcttcaccatcctggcgctttttctggcccactacatcgggacgtccctcacacagaaggtggtcattttcatcctgcttatgctggtgaccccttctatgacaatgcggtgtgttggagtgggcaaccgcgactttgtcgaagggctcagcggagctacctgggtggatgtggtcctggagcatggcgggtgcgttaccacaatggccaagaataaacccacgctggacattgagctccagaagaccgaagctacacaactggccacccttagaaaactgtgtatcgagggaaagattacaaacatcaccacggattcccggtgccctacacagggcgaagcggtgctcccggaggaacaggaccagaattatgtgtgtaaacacacctacgtcgatcgcggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcacacaggggaccagcatcaggttggaaacgagacgcaaggcgtgaccgctgaaattacacctcaggcctctaccacagaggctatcctgcccgaatatggcaccctggggctcgagtgctcccctagaacgggactggacttcaatgagatgattcttctgaccatgaaaaacaaggcctggatggtccaccggcagtggtttttcgatctccccctgccgtggacaagcggcgccaccacagaaacccctacgtggaatcgcaaagagcttctggtgacatttaagaacgctcatgcgaaaaagcaagaagtcgtggttctcgggtctcaggagggagccatgcacaccgctctgacaggcgccaccgaaatccagaatagcgggggcaccagcattttcgccggacacctgaagtgtagactcaaaatggacaagctggagcttaaaggcatgtcttacgctatgtgcacaaacacgtttgtgctgaagaaagaggtctccgaaacccagcatgggacaatcctcatcaaggtggagtaccggggagaagatgccccctgtaagattcctttcagcaccgaggacggccaagggaaagcgcacaacggaagactgatcacagctaatcccgttgtgaccaagaaagaggaacccgtcaacattgaggccgaacctccgttcggcgagtccaatatcgtgattgggatcggcgataacgccctgaagatcaattggtataaaaagggatctagcattggcaagatgtttgaagctacggcccgcggggctcggagaatggccatccttggagacacagcgtgggatttcggctccgtcgggggagttctcaacagcctgggcaaaatggtccatcagatttttgggtctgcctacaccgctctgttctccggcgtgagctgggtgatgaagatcggaattggcgtcctcctgacctggatcgggcttaatcccaaaaacacatctatgagcttttcctgcattgccatcggaatcattaccctgtatctcggcgctgtggttcaggccgacatggggtgtgtgatcaattggaagggaaaagagctgaagtgcggctctgggattttcgtcacaaacgaggtgcacacgtggaccgaacagtacaagtttcaagcggatagccctaaacgcctggccacagctatcgccggcgcttgggagaatggagtttgtggcattcggtccaccacaagaatggaaaaccttctctggaagcagatcgccaatgagctgaactatatcctgtgggaaaataacattaaactcaccgtggtcgtgggggacatcattggagttctggagcagggcaagcgcacgcttacaccccagcctatggagctgaaatacagctggaagacatgggggaaagccaagatcgtgaccgctgaaacacaaaactcttccttcattatcgatggacccaataccccggagtgccctagcgcgtctcgggcctggaacgtctgggaagtggaggactatggctttggcgtgttcacaaccaatatctggctcaagctgagagaagtctacacgcagctgtgtgaccatcgccttatgtccgctgccgttaaagatgagcgggccgtgcacgctgacatggggtactggattgagagccagaagaacggatcctggaaactcgaaaaggcctctctgatcgaggtgaaaacatgcacctggcccaagagccacaccctgtggtccaatggcgtcctcgaatctgatatgattatccctaagagcctggcggggcccatttcccagcataaccacagacctggatatcatacacaaaccgctggcccctggcaccttgggaaactggagctcgactttaattactgcgagggaacgacagtggttatcaccgaaaactgtggcacacgcggcccgagcctgcggaccacaaccgtgtctgggaagctgatccacgagtggtgctgtagatcctgcacgcttcctcccctccggtatatgggagaagatggctgttggtacgggatggagattcgccccatcagcgaaaaagaggagaatatggtcaagtctctggtgtccgccggaagcggcaaagttgacaacttcaccatgggggtgctgtgcctcgccattctgtttgaagaggtcatgagaggaaagttcggcaagaaacatatgatcgctggcgtgttctttacattcgttcttctgctctctgggcagattacctggcgggatatggcccacacactgatcatgattggaagcaatgcgtccgacagaatgggcatgggggtgacctatctggctcttatcgccacgtttaagatccagcctttcctggccctcggatttttcctgcgcaaactcacaagccgggaaaacctgcttctgggcgtcgggctcgctatggccaccacactgcaactgccggaggatattgaacagatggctaatggaatcgcccttggcctgatggcgctcaagctgattacccagtttgagacctaccagctctggacagccctgatctctcttacgtgttccaacaccatgttcacactgaccgtggcttggagaacagccaccctcattctggctggcgtgagcctgcttcccgtctgccaatcctctagcatgcgcaaaacggactggctgcctatggccgttgccgctatgggggtgccccctctccccctgtttatcttctccctcaaggatacactgaagagacggtcttggcctcttaatgagggagtgatggcggtcggcctggtgagcatcctggcctcctctctcctgcgcaacgacgttcccatggctgggccgcttgtggccggaggcctgctcattgcctgttatgtcatcaccgggaccagcgctgatctgacagtggaaaaagccgcggacattacctgggaggaagaggctgaacagacaggagtttcccataacctcatgatcacggtggacgatgacggcaccatgagaattaaggatgacgagacagagaatatcctgaccgtccttctgaaaacagccctgctcatcgtgagcggcgtctttccttactctattcccgccaccctgcttgtgtggcacacgtggcagaagcagacccaacggtccggggttctgtgggatgtgccttctcccccggaaacacagaaagctgagctcgaagagggagtctaccgcatcaagcagcagggcattttcgggaaaacccaagtgggagttggcgtgcagaaggagggggtctttcatacaatgtggcacgtgaccagaggagccgtgctgacatataacggcaagcggctcgaacctaattgggcgtccgttaaaaaggacctgatctcctacggcgggggatggcgccttagcgctcagtggcaaaaaggcgaggaagtccaggtgattgccgtggagcccgggaagaaccctaaaaatttccagacgatgcccggaaccttccagacaaccaccggcgaaatcggggccattgctctggattttaagcccggaacatctggctcccctatcatcaacagagagggcaaggtcgtggggctgtatggaaatggcgttgtgacgaaaaacgggggatacgtcagcggcattgcccaaaccaatgctgagccggacgggcccacacctgaactcgaggaagagatgttcaagaaacggaacctgaccatcatggatcttcaccccggctccggaaagacacgcaaatatctgcctgccattgtgagagaagcgatcaagcggagactccgcaccctgattctcgcccccacgcgggttgtggctgccgagatggaggaagctctgaagggccttcctatcagataccagacaaccgccaccaaaagcgagcatacagggcgcgaaatcgtcgacctgatgtgccacgccacctttacaatgcggctgctctctccggtgagagttcccaattataacctgattatcatggatgaggctcatttcaccgaccctgcgagcattgccgctcgcggatacatctccacgcgggtgggcatgggggaagccgccgctatttttatgacagccacaccccctggaacagcggatgctttcccccagtctaatgccccgatccaggacgaggagagagacatccctgaacgcagctggaactccggcaatgagtggattaccgattttgccgggaagacggtctggttcgtgccctctatcaaagctggcaacgacattgccaactgtcttcggaagaatggcaagaaggtgatccaactgagcagaaagacctttgatacagaataccagaaaaccaagctcaacgactgggatttcgtcgttacaaccgacatttccgagatgggcgcgaattttaaagccgatcgggtgatcgacccccgcagatgcctgaagcctgtgattctgacagatgggcccgagcgggtcatcctcgctggacctatgccggtgaccgccgcttctgccgctcagcgcagaggccgggttgggagaaacccccagaaagaaaatgaccaatatatcttcacgggacagcctcttaacaatgatgaggaccacgcccattggacagaagcgaagatgctgctggacaacattaatacccccgagggcatcattcctgccctcttcgaacccgagcgcgaaaagagcgctgccatcgatggggaataccggctgaaaggcgagtccagaaagacctttgtggaacttatgcgccggggagacctgccggtctggctcgctcacaaagtggccagcgagggcattaagtatacagatagaaaatggtgcttcgacgggcagcgcaacaatcagatcctggaagagaacatggatgttgagatctggaccaaggaaggagagaaaaagaagctgcggcctagatggctcgacgcccgcacatactctgatccccttgctctgaaagaatttaaggacttcgcggccggcagaaaatccattgctctggatctcgtgacggagatcgggcgggtccctagccacctggcccatcgcaccagaaatgcccttgacaacctggtgatgctccacacatctgaacatggaggccgggcttatcgccacgccgtcgaggagctgcccgaaaccatggagacactgctccttctgggcctgatgattctcctgaccgggggagcgatgctttttctgatctccggcaaggggattggaaaaacgagcatcggcctcatctgtgtgattgcctcctctgggatgctgtggatggctgaaatccctctgcaatggattgccagcgctatcgttctcgagttctttatgatggtgcttctgattcccgagccggaaaagcagagaacccctcaggataatcaactggcctacgtggtcatcggcattctcacactggcggccatcatcgctgccaacgagatgggccttctggaaaccacaaagcgggacctcggcatgtccaaagagcccggggttgtgagccccacctcttatctggatgtggacctgcaccctgcttccgcctggacgctctacgctgtcgccacaaccgtgattacaccgatgcttagacataccatcgaaaatagcaccgcgaacgtttctctggccgctattgccaaccaggctgtggtcctgatgggactcgacaagggctggcccatcagcaaaatggatctgggggtgcctcttctggccctcggatgctactcccaggtcaatcccctgacactgacggccgcggtgctccttctgattacccactatgctatcatcggccctgggctgcaggccaaggctacacgcgaggcccaaaaacggaccgccgctggaattatgaagaaccccacagttgacggcatcatgaccattgatctcgaccctgtgatctacgattctaagttcgagaaacagctgggccaggtcatgcttctggtgctctgtgccgttcagctgctgctcatgagaacgagctgggcgctttgcgaagccctgacactggctaccgggccgattaccacactctgggagggatcccccggcaagttttggaataccacaatcgccgtgtctatggctaacatcttccgcgggagctatctggccggagcgggccttgccttttccattatgaaaagcgtcgggacgggaaagcggggcaccggctctcaaggggaaacactgggagagaaatggaagaagaaactcaatcagctgtccagaaaggagttcgacctgtacaaaaagagcggcatcaccgaggtggatcggacagaggctaaagaagggctcaagcgcggagagattacccatcacgccgtgtccagaggctctgctaaacttcagtggtttgttgaacggaacatggtcatccctgaggggcgcgtgattgacctgggatgtggcagaggcgggtggagctattactgcgccggactgaagaaggtgacggaagtccggggctataccaaagggggacccggccatgaggagcctgttcccatgtccacatacgggtggaatatcgtgaagctcatgtctggaaaagatgtgttctacctgccgcctgaaaagtgtgacacccttctgtgcgatattggcgagagctcccccagccccacagtcgaagagtctcgcaccatcagagtgctcaaaatggttgagccttggctgaagaacaatcagttctgtatcaaggtgctgaacccctatatgcctacagtcattgaacacctcgagcggcttcaacgcaaacacggcgggatgctggtgagaaatccgctgtcccggaacagcacccatgaaatgtactggatctctaatggaacgggcaacattgttgcttccgtgaatatggtcagcagactcctgcttaaccgctttacaatgacccaccggagacccaccatcgagaaggacgtggatctgggggccggaacacgccatgtgaacgcggaacctgagacgcccaatatggacgtcattggcgagcggatcaaaagaatcaaggaagaacacaactctacctggcactatgacgatgaaaatccttacaaaacatgggcctatcatgggagctacgaggttaaggctaccggatccgcctctagcatgattaacggcgtggtgaagctcctgacaaaaccctgggacgtcgtgccgatggttacccagatggctatgacagataccacgcctttcggccagcaacgcgtgtttaaggaaaaagtcgacacccggacacccagatccatgcctgggacccgccgggtgatgggaatcacagccgagtggctgtggagaaccctcggccgcaataagaaaccccggctgtgcacgagagaggagttcacaaagaaggttcgcaccaacgccgcgatgggggctgtgtttacagaggaaaatcagtgggatagcgccaaagccgctgtcgaggacgaagatttctggaaacttgtggacagagagcgggagctgcacaaactcggaaagtgtggctcctgcgtttataacatgatggggaaacgcgaaaagaaactgggcgagtttggaaaggccaagggctctagagctatttggtacatgtggcttggggcccggtacctggagttcgaggcgctcggatttctgaatgaggatcattggttcagcagagaaaactcctattctggcgtggagggggaaggactgcacaaactcggctacatcctgcgggacattagcaagatccctgggggcgccatgtatgctgatgacaccgccggatgggacacgcgcatcaccgaggatgaccttcataatgaagagaaaattacacagcagatggatcccgagcacagacaactggctaacgccatctttaagctcacctaccagaataaagtcgtgaaggtccagcggccgacacctaccggcacagtgatggacattatctcccgcaaggatcagagagggtctggacaagttggcacctatgggctgaacacgttcacaaatatggaagcgcagcttattcggcagatggagggagaaggcgtgctgagcaaagccgacctcgagaacccccatctgcccgaaaagaaaatcacccagtggctggagaccaagggggtcgagcgcctcaaaagaatggctatctccggcgatgactgcgtggtgaagcctattgatgaccggtttgccaacgctctgcttgccctgaatgatatgggaaaggttcgcaaagacatcccgcaatggcagcccagcaagggctggcatgattggcaacaggtgcctttctgttctcaccatttccacgaactcattatgaaagacgggagaaagctggtcgtgccctgccggcctcaagacgagcttatcggacgcgctagaatttcccagggcgccgggtggagcctgcgggaaacagcgtgtctcggaaaagcctacgctcagatgtggtctctgatgtattttcaccgcagagatctgcggctcgcctccaacgccatctgcagcgctgttcccgtgcattgggtccctacctctagaacaacgtggtccattcacgcccatcaccaatggatgaccacagaggacatgctgaccgtgtggaatcgcgtctggatcgaagataacccctggatggaggacaagacaccggtgaccacgtgggagaatgttccttaccttggcaagcgggaagatcagtggtgtgggagcctgatcggcctcacctccagagcgacatgggctcagaacattcccaccgccatccagcaagtgcgcagcctgattggaaatgaggagttccttgactacatgccttctatgaaacggtttagaaaggaggaggaaagcgagggcgccatctggtga

SEQ ID NO: 20917 - RNA, 9873 nt, synthetic construct
  misc_feature 1..9873: note = derived and/or modified CDS sequence (opt5) from DENV-3__AY858037__SS-prME
  source 1..9873: mol_type = other RNA
accagcctgtgcctcatgatgatgctgcccgtgacccttgccttccacctgacgtccagagacggcgagcctcggatgattgtcgggaagaacgaacgcggaaagtctctcctgtttaagaccgctagcggcattaatatgtgtacacttatcgccatggatctgggggagatgtgcgacgataccgttacctacaaatgtccgctcattaccgaagtggagcccgaagacatcgattgctggtgtaacctgacatccacctgggtgacgtatggaacctgcaatcaggcgggcgagcatagacgggacaagcgctctgtcgctctggcccctcacgtggggatgggactcgatacaagagcccaaacctggatgagcgctgagggcgcctggcggcaggttgaaaaagtggagacatgggctttccgccatcccggctttaccattctggcccttttcctggcgcactacatcgggacgtccctcacacagaaggtcgtgatctttattctgcttatgctggttaccccttctatgacaatgagatgtgtgggagtcggcaaccgggacttcgtggaagggctcagcggagccacctgggtggatgtcgttctggagcatggcgggtgcgtgaccacaatggctaagaataaacccacgctggacatcgagctccagaagaccgaagccacacaactggctacccttcgcaaactgtgtattgagggaaagatcacaaacgtgaccacggattccagatgccctacacagggcgaagccattctcccggaggaacaggaccagaattatgtctgtaaacacacctacgtggatcggggctgggggaacggatgcggcctgtttgggaagggaagccttgttacctgcgcgaagttccaatgtctggagtctatcgagggcaaagtggtccagcacgaaaatctcaagtatacagtgattatcaccgttcatacaggggaccagcaccaggtgggaaacgagacgcaaggcgtcaccgccgaaatcacaccccaggcttccaccgtggaggccattctgcctgaatacggcacactggggctcgagtgcagcccccgcaccggactggactttaatgagatgatccttctgacgatgaaaaacaaggcttggatggtccatagacagtggttctttgatctccctctgccctggacctctggcgccacaaccgaaacaccgacctggaataaaaaggagcttctggtgacgttcaaaaacgcccacgctaagaagcaagaagttgtggtcctcgggtcccaggagggagcgatgcacacagccctgaccggcgctacagaaattcagaccagcgggggcacctctatctttgccggacatctgaaatgtcggctcaagatggacaaactggagcttaagggcatgtcctatgccatgtgcagcaatgctttcgtgctgaaaaaggaggtttccgaaacacagcacgggacgattctcatcaaggtggagtacaaaggagaagatgccccttgtaagatccccttctctaccgaggacggccaagggaaagcgcataacggacgcctgattacagctaaccctgtcgtgaccaagaaagaggaacccgtgaatatcgaggccgaacccccttttggcgagagcaacattatcattgggatcggcgatagagccctgaagatcaattggtacaagaaaggatccagcattggcaagatgttcgaagctacagccagaggggctagacgcatggccatccttggagacaccgcgtgggattttggctctgttgggggagtcctcaactccctgggcaaaatggtgcaccagattttcgggagcgcctatacggctctgttttctggcgtgagctggatcatgaagattggaatcggcgtcctcctgacatggattgggcttaattccaaaaacacctctatgagcttctcctgcatcgtgatcggaattatcaccctgtacctcggcgccgttgtgcaggctgacatggggtgtgtcattaattggaagggaaaggagctgaaatgcggcagcgggatctttgtgacaaacgaggttcatacctggacagaacagtataagttccaagccgattctccgaaacggctggcgacggccattgctggcgcctgggagaatggagtgtgtggcatcagatccaccacacgcatggaaaaccttctctggaagcagatcgctaatgagctgaactacattctgtgggaaaataacatcaaactcaccgtcgtggttggggacattatcggagtgctggagcagggcaagcggacacttacaccccagcctatggagctgaaatatagctggaagacgtgggggaaggccaaaattgtcaccgccgaaacacaaaattcttcctttatcatcgatggacccaacacccctgagtgccccaacgctagcagagcgtggaatgtgtgggaagtggaggactacggcttcggcgtctttacaaccaacatttggctcaagctgcgcgaaatgtatacacagctgtgtgaccaccggcttatgtccgccgctgttaaagatgagagagccgtgcacgccgacatggggtactggatcgagtctcagaagaatggaagctggaaactcgaaaaggcttccctgattgaggtgaagacctgcacgtggccgaaatctcatacactgtggagcaacggcgtcctcgaatccgatatgatcattcctaagagcctggccgggcccatctctcagcacaattaccgccctggatatcatacccaaaccgcgggcccctggcaccttgggaaactggagctcgacttcaactactgcgagggaacaaccgtggttatcacggaaaattgtggcacacggggcccttccctgagaaccacaaccgtgagcgggaagctgattcacgagtggtgctgtcgctcttgcacacttcccccgctccggtatatgggagaagatggctgttggtacgggatggagatcagacctattaacgaaaaagaggagaatatggtcaagtccctggtgagcgctggatctggcaaggttgacaactttaccatgggggtgctgtgcctcgccatcctgttcgaagaggtcatgcggggaaaattcggcaagaaacatatgattgccggcgtgctttttacgttcgttctgctcctgagcgggcagatcacctggcgcgatatggctagaacactgattatgatcggatccaatgccagcgaccggatgggcatgggggtgacctatcttgcgctgatcgctacatttaagattcagcccttcctcgccctgggatttttcctcagaaaactgacctctcgcgaaaaccttctgctcggcgtcgggctggccatggctacgacactgcaacttcccgaggatatcgaacagatggccaatggaattgctctgggcctcatggccctgaagctcatcacccagtttgagacataccagctgtggaccgcgcttgtgtccctgatgtgtagcaacaccattttcacactcacggtggcctggcggaccgctacactgatcctggccggcatctccctttttcctgtctgccaatctagctccatgagaaagaccgactggctgccgatgacagttgctgccatgggggtgccccctctccccctgttcatcttttctctcaaagataccctgaagcgcagaagctggcctcttaatgagggagtgatggccgtcggcctggtgtccatcctggcttctagcctcctgcggaacgacgttcccatggcggggcctcttgtggccggaggcctgctcattgcttgttatgtcatcacggggacatccgccgatctgaccgtggaaaaagccgctgacgttacctgggaggaagaggccgaacagacaggagtgagccacaacctcatgattaccgtcgacgatgacggcacaatgcgcatcaaggatgacgagacggagaatatcctgaccgtgcttctgaaaacagcgctgctcattgtctctggcatcttcccctactccattccggctaccctgcttgtgtggcatacatggcagaagcagacccaaagaagcggggttctgtgggatgtgccttctccccctgaaacgcagaaagccgagctcgaagagggagtctaccggatcaagcagcagggcatttttgggaagacccaagtgggagttggcgtgcagaaagagggggtcttccacacaatgtggcatgtgacccgcggagccgtgctgacatataacggcaagagactcgaacccaattgggcttccgttaaaaaggacctgatcagctacggcgggggatggcggctttctgcccagtggcaaaaaggcgaggaagtccaggtgattgcggtggagccggggaagaaccctaagaatttccagaccatgcccggaatctttcagacaacgaccggcgaaatcggggctattgccctggatttcaaacctggaacatccggcagccccatcattaaccgcgagggcaaggtcgtggggctgtatggaaatggcgttgtgaccaaaaacgggggatacgtctccggcatcgcccaaaccaatgctgagcccgacgggcctacaccggaactcgaggaagagatgtttaagaaaagaaacctgacgattatggatcttcaccccggcagcggaaagacccggaagtatctgcctgccatcgtgcgcgaagctatcaaaagacggctcagaacactgattctcgcccccacccgcgttgtggcggccgagatggaggaagctctgaagggccttcctatccggtaccagacaaccgccacgaaatctgagcacacagggaaggaaattgtcgacctgatgtgccatgctaccttcaccatgagactgctcagccccgtgcgcgttcctaattataacctgatcattatggatgaggcccactttacagacccggcctccatcgctgcgcggggatacatctctaccagagtgggcatgggggaagccgctgccattttcatgacagccacaccccctggaacggctgatgcctttccccagagcaatgcgcctatccaggacgaggagcgcgacattcccgaacggtcctggaactctggcaatgattggatcacagacttcgctgggaaaaccgtctggtttgtgccgagcattaaggccggcaacgatatcgccaactgtcttagaaagaatggcaaaaaggtgattcaactgtcccgcaaaacattcgacaccgagtaccagaagacgaaactcaacgattgggactttgtcgttaccacagatatctctgaaatgggagctaatttcaaggccgaccgggtgatcgatcctagacggtgcctgaagcccgtgattctgaccgacgggcccgagcgcgtcatcctcgcgggacctatgcccgtgacagttgccagcgctgcccagagacggggccgcgtggggagaaaccctcagaaagagaatgatcaatatattttcaccggacagccgcttaacaatgacgaagaccatgctcactggacagaggccaagatgctgctggataacatcaatacccccgaaggcattatccctgctctctttgagcccgaacgggagaaatccgccgcgatcgacggggagtacagactgaagggcgaaagccgcaaaacgttcgtcgagcttatgcggagaggagatctgcctgtgtggctcgcccataaggttgcttctgaaggcattaaatatacagaccgcaagtggtgctttgatggggagcggaacaatcagatcctggaagagaacatggacgtggagatttggaccaaggaaggagagaaaaagaaactgagaccccgctggctcgatgcccggacctactccgacccgcttgctctgaaggagttcaaagattttgccgccggcagaaagagcatcgctctggacctcgtcacagagattgggcgcgtgccttctcacctggcgcacagaacccggaatgcccttgataacctggtcatgctccatacatccgaacacggaggccgcgcttatagacatgccgtggaggagctgcccgaaacgatggagaccctgctccttctgggcctgatgatcctcctgacagggggagccatgcttttcctgatcagcggcaagggggttggaaaaacctccattggcctcatctgtgtggtggcttctagcgggatgctgtggatggccgacattcctctgcagtggatcgcgtccgccattgtcctcgaatttttcatgatggttcttctgatccccgagcctgagaagcaacggacaccccaggataatcagctggcttacgtggtgattggaatcctcaccctggccgctatcgtcgccgcgaacgaaatgggccttctggagacgaccaaacgcgacctcggcatgagcaaggaaccgggggtggtttctcctacatcctatctggacgtggatctgcaccccgccagcgcttggaccctctacgccgtcgctacaaccgtgattacgcccatgcttagacacacaatcgaaaattctaccgccaacgtcagcctggctgccattgcgaaccaagccgtggttctgatgggactcgacaaaggctggcctatctccaagatggatctgggggtgccgcttctggctctcggatgctactctcaggtcaatcccctgacactgaccgccgctgtgctccttctggttacccattatgccattatcggccctgggctgcaggccaaggcgacacgggaagctcagaaaagaacggccgctggaatcatgaagaaccccaccgtggacggcattatgacaatcgatctcgaccctgtcatttacgatagcaaatttgagaagcaactgggccaggtgatgcttctggtgctctgtgccgttcagctgctgctcatgcgcacctcctgggccttctgcgaggctcttacactggccaccgggcccatcacgacactgtgggaaggatctcctggcaaattttggaataccaccattgcggtcagcatggccaacatcttccgggggtcctatctcgctggagccggcctggcttttagcatcatgaagtctgtggggacaggaaagagaggcaccggctcccagggggagacacttggagaaaaatggaagaaaaagctgaatcaactcagccgcaaagagttcgacctgtacaagaaatccggcattacggaagtggatcggaccgaggccaaggaggggctgaagagaggagaaatcacacaccatgcggtctctcggggcagcgccaaactccagtggttcgttgagcgcaacatggtgattccggaagggagagtgatcgaccttggatgtggccggggcgggtggtcctattactgcgctggactgaagaaagtcaccgaggtgcgcggctatacaaaagggggacccggccacgaagaacctgttcccatgtctacctacgggtggaatattgtgaaactgatgagcggaaaggatgtcttttacctccctcccgagaagtgtgacacgctgctttgcgatatcggcgaatccagcccgtctcctaccgtggaggaatccagaacaattcgggttctgaaaatggtggagccctggctcaagaacaatcagttctgtatcaaagtcctgaacccctatatgcctaccgtgatcgagcatctggaacgcctccagagaaagcacggcgggatgcttgtgcggaatcccctgagccgcaactctacacacgagatgtactggatttccaatggaaccggcaacatcgtcagctctgttaatatggtgagcagactgctcctgaaccggtttacaatgacctatagacgccctacgattgaaaaagacgtggaccttggggccggaacacggcatgtcaacgctgagccggaaacccccaatatggatgtgatcggcgagcggattcgccggatcaaggaggaacactcctctacctggcattacgacgatgagaacccttataagacatgggcctaccacgggagctatgaagttaaagctacgggatccgccagctccatgatcaatggcgtggtcaagctgctcaccaaaccctgggacgtggttcctacagtgacccaaatggcgatgacagataccacacccttcggccagcagagagtctttaaggagaaagtggacacccgcacgccgaagcctatgcccgggacccggaaggttatggaaattacagccgagtggctgtggagaaccctgggacgcaacaaacggcctagactctgcacacgcgaggagttcaccaagaaagtgcggacgaatgctgccatgggcgctgtctttacagaggaaaaccaatgggattctgccagagccgcggtggaggacgaagagttctggaagctggtcgatcgcgagagagaacttcacaaactggggaagtgtggaagctgcgtgtacaatatgatgggcaaacgggagaagaagctcggggaatttggcaaagctaagggatcccgcgccatctggtacatgtggctgggcgccagatatcttgagttcgaggctctggggtttctcaacgaagaccattggttctctcgggagaatagctactccggagttgaaggcgaggggctgcacaaactgggatatattctcagagatatctctaagattcccggcggggccatgtacgctgacgacaccgccggctgggatacacggatcaccgaagacgatctgcataacgaggagaaaatcacgcagcagatggaccctgaacaccgccagcttgcgaatgccatttttaagctgacctatcaaaacaaggtggtcaaagtgcagagacccacaccgaagggaaccgtgatggatatcattagccggaaagaccagcgcggctccgggcaggttggaacatacggcctcaataccttcacaaacatggaggctcaactgatcagacagatggaaggggagggagtgcttagcaagaccgatctggaaaatcctcatctcctggagaaaaagattacgcagtggctggagacaaagggcgtcgaacggctcaaacgcatggccatctctggggacgattgcgtggttaagcccatcgacgatagattcgctaacgccctgcttgcgctgaacgacatgggcaaagtgcggaaggatattccccagtggcaaccttccaaaggatggcacgactggcagcaggtcccgttttgtagccaccatttccacgagctcatcatgaaggacggccgcaagctggtggtcccctgcagacctcaggatgaacttattgggcgggcccgcatctctcaaggagctggctggtccctgaaagagaccgcctgtctcgggaaggcttatgcccagatgtgggctctgatgtactttcatagacgggacctgcgcctcgccagcaatgcgatttgctctgccgtgcccgttcactgggtgcctacctccagaacaacctggagcatccacgctcatcaccagtggatgacaacggaagatatgctgaccgtctggaaccgggtgtggattgaggacaatccctggatggaggataaaacacctgttaccacatgggaagacgtgccctaccttggaaagagagaggatcaatggtgtggctccctgatcgggctcaccagccgcgccacgtgggcccagaacatcctgaccgctattcagcaggtccggtctcttatcggcaatgaagagttcctggactatatgccgagcatgaaaagatttcgcaaggaggaagagtccgaaggagccatttggtga

SEQ ID NO: 20918 - RNA, 9873 nt, synthetic construct
  misc_feature 1..9873: note = derived and/or modified CDS sequence (opt5) from DENV-3__KJ737429__SS-prME
  source 1..9873: mol_type = other RNA
accagcctgtgcctcatgatgatgctgcccgccacacttgctttccacctgacgtcccgggacggcgaacctcggatgatcgtggggaagaacgaacgcggaaagtctctcctgtttaagaccgccagcggcattaatatgtgtacacttatcgcgatggatctgggggagatgtgcgacgataccgtcacatacaagtgtccgctcattgctgaagttgagcccgaagacatcgattgctggtgtaacctgacctccacatgggtgacctatggaacgtgcaatcaggccggcgagcaccggcgggacaagcgctctgtggccctggctcctcacgtcgggatgggactcgataccagaacacagacctggatgagcgccgagggcgcttggagacaggtggaaaaagttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagaataaacccacgctcgacatcgagctgcagaagaccgaagctacacagcttgccaccctgcgcaaactctgtattgagggaaagatcacaaacattaccacggattccagatgccctacacagggcgaagcgatcctgccggaggaacaggaccagaattatgtgtgtaaacacacctacgtggatcggggctgggggaacggatgcggccttttcgggaagggaagcctggtgacatgcgccaagtttcaatgtctcgagcccattgagggcaaagtggttcagtatgaaaatctgaagtacacagtgatcatcaccgtccacacaggggaccagcatcaggtgggaaacgacacgcaaggcgttaccgtggagattacacctcaggcttctaccgtcgaagccgtgctgcccgagtatggcacactcgggctggaatgctcccctcgcaccggacttgatttcaatgagatgatcctgctcacgatgaaaaacaaggcttggatggtccacagacagtggtttttcgacctgccccttccgtggaccagcggcgccacaaccgagacacctacctggaatcggaaagaactgctcgtgacgtttaagaacgcccatgctaaaaagcaagaggttgtggtcctggggtctcaggaaggagcgatgcacacagccctgaccggcgctacagagattcaaaattccgggggcaccagcatcttcgccggacacctcaagtgtcgcctgaaaatggataaacttgaactgaaaggcatgtcttacgccatgtgcctcaacacctttgtgctgaagaaagaggtttccgagacacagcatgggacgattctgatcaaggtggaatacaagggagaggacgctccctgtaaaatccctttcagcaccgaagatggccaagggaaggcccacaacggaagacttattacagcgaatcccgtcgtgaccaaaaaggaggagcccgtgaacatcgaagctgagcctccgttcggcgaatccaatattgttatcgggattggcgacaaagccctcaagatcaactggtataagaaaggatctagcatcggcaagatgtttgaggccacagctagaggggccagacgcatggctattctgggagataccgcctgggacttcggctccgtcgggggagtgctgaatagcctcggcaaaatggtgcatcagatctttgggtctgcgtacacggccctgttctccggcgtcagctggattatgaagatcggaattggcgtgcttctgacatggatcgggctcaactctaaaaataccagcatgtccttttcttgcattgttatcggaatcattaccctgtatctgggcgctgtggtccaggccgatatggggtgtgtgatcaactggaagggaaaggaacttaaatgcggcagcgggattttcgttacaaatgaggtgcacacctggacagagcagtacaagtttcaagctgactcccccaaacggctcgccacggcgatcgccggcgcttgggaaaacggagtctgtggcattagaagcaccacacgcatggagaatctgctgtggaagcagatcgccaacgaactcaattatatcctgtgggagaacaatattaaacttaccgtggttgtgggggatatcattggagtcctggaacagggcaagcggacactcacccctcagcccatggagctgaaatactcttggaagacgtgggggaaggctaaaatcgtgaccgccgagacacaaaactccagcttcattatcgacggacctaacacccccgaatgcccgtctgcctccagagcttggaatgtgtgggaggtcgaagactatggctttggcgttttcacaaccaacatctggctgaaacttcgcgaggtgtacacacagagctgtgatcatcggctcatgtccgcggccattaaagacgaaagagctgtgcacgccgatatggggtactggatcgagtctcagaagaatggaagctggaaactggagaaggcctcctttattgaagtcaagacctgcacgtggcctaaatctcacacactgtggagcaacggcgtgctcgagtccgacatgatcattcccaagagcctggctgggcctatctctcagcataatcaccgccccggatatcatacccaaaccgccggcccttggcaccttgggaaactggaactcgatttcaactactgcgagggaacaaccgttgtgatcacggagaattgtggcacacggggcccctccctgagaaccacaaccgtcagcgggaagctgattcacgaatggtgctgtcgctcttgcacacttccgcctctccggtatatgggagaggacggctgttggtacgggatggaaatcagacccattaacgagaaagaagagaatatggtgaagtccctggttagcgcgggatctggcaaggtggataactttaccatgggggtcctgtgcctcgctatcctgttcgaggaagtgatgcggggaaaattcggcaagaaacatatgattgccggcgttctttttacgttcgtgctgctcctgagcgggcagatcacctggcgcgacatggcccacacactgattatgatcggatccaatgctagcgatagaatgggcatgggggtcacctatcttgccctgatcgcgacatttaagattcagcccttcctcgctctgggatttttcctccggaaactgacctctagagagaaccttctgctcggcgtggggctggccatggccacgacactgcaacttcctgaagacatcgagcagatggctaatggaattgccctgggcctcatgaccctgaagctcatcacacagtttgaaacctaccagctgtggaccgctcttgtgtccctgacatgtagcaacacgattttcaccctcacagtcgcctggcgcaccgcgacactgatcctggccggcgtttcccttctgccgctctgccaatctagctccatgcggaagaccgattggctgcccatgacggtggctgccatgggggtgcctcccctccctctgtttatcttctctcttaaagacacacccaagagacgcagctggcctctgaatgagggagtcatggctgtgggcctggtttccattctcgcctctagcctgcttagaaacgatgtgcccatggccgggccgctggtcgctggaggcctcctgatcgcgtgttatgtgattaccgggacctccgccgacctcacagttgagaaagctgccgacgtgacctgggaagaggaagccgagcagacaggagtcagccataacctgatgatcacggtggatgacgatggcaccatgcggattaaggacgatgaaacagagaatatccttaccgtcctgctgaaaacagctctcctgatcgtgtctggcatttttccttactccatccccgccacccttctggtttggcacacgtggcagaagcagacccaacgcagcggggtgctctgggacgtcccttctcccccggagacacagaaagcggaactggaggaaggagtgtacagaattaagcagcagggcatcttcgggaagacccaagttggagtgggcgtccagaaagagggggtgtttcatacaatgtggcacgtgacccggggagctgttctcacacacaacggcaagcgcctggagcctaattgggcctccgtcaaaaaggatcttattagctatggcgggggatggagactgtctgcccagtggcaaaaaggcgaagaggtccaggtgatcgctgtcgaacccgggaagaaccctaagaatttccagacgatgcccggaattttccagaccacaaccggcgagatcggggccatcgcgctggactttaaacccggaacctccggcagccctattatcaaccgggaaggcaaggtggttgggctctacggaaatggcgtggtcaccaagaacgggggatatgtgtccggcattgctcaaacgaatgccgagccggatgggcccacccctgagctggaagaggaaatgttcaagaaacgcaaccttacaatcatggacctgcatcccggcagcggaaagaccagaaagtacctccctgccattgttcgggaggctatcaaacgcagactgcggacactcatcctggcccccaccagagtggtcgctgccgaaatggaggaggcgcttaagggcctgcctattcgctatcagacgacagccaccaaatctgaacacaccgggcgggagatcgtggatctgatgtgccatgctacatttaccatgagactcctgagcccggttcgcgtgcccaattacaaccttattatcatggacgaagcccacttcacagatcctgcttccattgccgcccggggatatatctctaccagagtcggcatgggggaggctgcggccatctttatgacggctacaccccctggaaccgccgaagccttcccccagagcaatgctccgattcaggacgaggagcgcgacatccctgaacggtcctggaactctggcaatgagtggattacagattttgtggggaagaccgtgtggttcgtccccagcatcaaagccggcaacgacattgcgaactgtctgagaaagaatggaaagaaagttatccaactctcccgcaagacgtttgataccgaataccagaaaacacggctgaacgactgggatttcgtggtgaccacagacatttctgagatgggcgctaattttaaggccgatagagtcatcgacccccggcgctgcctgaaacctgtgatcctcaccgatgggcccgagagagttattcttgccggacctatgccggtgacagctgccagcgcggcccagcggcgcggcagagtcgggcggaacccccagaaggaaaatgaccaatacatcttcaccggacagcctctgaacaatgatgaggaccatgctcactggacggaagccaagatgctgctcgacaacattaatacacccgagggcatcattcctgctctgttcgaacccgagagagagaaatccgccgctatcgatggggaatatcgccttaagggcgagagccggaaaacctttgtggaactgatgagacgcggagacctcccggtttggctggcccacaaggtggcgtctgagggcatcaaatacaccgatcggaagtggtgcttcgacggggaaagaaacaatcagattctggaggagaacatggatgtcgaaatctggacaaaagagggagaacgcaagaagctccggcctagatggcttgacgcccgcacctattccgatcccctggctctgaaagagtttaaggacttcgccgctggcagaaaaagcattgccctcgatctggtgacagaaatcgggcgggtcccttctcatcttgcccaccgcacgagaaatgctctggacaacctcgtgatgctgcatacctccgagcacggaggccgggcgtaccgccacgccgttgaggaactgcccgagacaatggaaaccctccttctgctgggcctcatgattctgcttacagggggagctatgctgtttctcatcagcggcaaggggatcggaaaaacctccattggcctgatctgtgtgattgtgtctagcgggatgctgtggatggccgatgtccctctccagtggatcgcctccgctattgttcttgagttctttatgatggtgctgctgatccccgagccggaaaagcaaagaacgcctcaggacaatcagctcgcctatgtggtcattggaatcctgacccttgcggccatcgtggctgccaacgagatgggcctgctcgaaacaaccaagcgggatctgggcatgagcaaagagcccggggttgtgtctcccacatcctacctggacgtcgacctccatcctgctagcgcctggaccctttatgcggtggccacgacagtcattaccccgatgctgagacacacaatcgaaaattctaccgctaacgtgagcctggccgctattgccaaccaagctgttgtgctcatgggactggataagggctggcccatctccaaaatggaccttggggtccctctgctcgccctgggatgctactctcaggtgaatcccctgaccctcacagcggccgttcttctgctggtgacgcattacgctattatcggccctgggctccaggccaaggctacccgcgaggcccagaaacggacagccgcgggaatcatgaagaaccccaccgtcgatggcattatgacaatcgacctggatcctgtgatttatgacagcaagttcgagaaacaacttggccaggtgatgctgctcgttctgtgtgctgtccagctgctccttatgagaacctcctgggccctgtgcgaagctctgacgctcgccacagggccgatcaccaccctgtgggagggatctcccggcaagttttggaatacaaccattgccgtgagcatggctaacatcttccgcgggtcctaccttgccggagcgggcctggcctttagcatcatgaaatctgtggggacaggacggagaggcacgggctcccagggggaaaccctcggagagaagtggaaaaagaagctgaatcaactgagccggaaagagttcgatctctataagaaatccggcattacagaggtcgaccgcaccgaggctaaggaagggcttaaaagaggagagacaacccaccatgccgtttctcggggcagcgctaagctgcagtggtttgtggaacgcaacatggtgatccctgaggggagagtcattgatctgggatgtggccggggcgggtggtcctactattgcgccggactcaaaaaggtgacggaagttcgcggctacaccaaaggcgggcccgggcacgaggagcctgtgcccatgtctacatatgggtggaatatcgtcaaactgatgagcggaaaggacgtgttctaccttccgcctgaaaaatgtgataccctgctctgcgacattggcgagtccagcccctctcccacagttgaagagtccagaaccatccgggtgctgaagatggtcgagccttggctgaaaaacaatcagttctgtattaaggtgctcaacccctacatgcctacagtgatcgaacaccttgagcgcctgcagagaaagtatggcgggatgctggtccggaatccgctcagcagaaactctacccatgaaatgtactggatctccaatggaacgggcaacattgttagctctgtgaatatggtgagccgcctgcttctgaaccggtttacaatgacccacagacgccccaccatcgagaaagatgtcgacctcggggcgggaacacggcatgtgaacgccgaacctgagacgcccaatatggacgttattggcgagagaatcaagcgcattaaagaagaacactcctctacctggcactatgatgacgaaaacccttacaagacatgggcttatcatgggagctacgaggtgaaagccaccggatccgctagctccatgatcaatggcgtcgtgaagctgctgacaaagccctgggatgttgtgccgatggtcacccaaatggccatgacagacaccacgcctttcggccagcagcgggtgtttaaagaaaaggttgataccagaacaccccgccctatgcccgggacccggaaagtgatggagatcacagctgagtggctctggagaaccctgggacgcaacaagaaacctcggctttgcacgagagaagagttcacaaagaaggtccgcaccaatgccgcgatgggcgccgtgtttacagaagagaaccaatgggactctgctagagccgctgtcgaagatgaggagttctggaaactggtggaccgggaacgcgagctccacaagctggggaaatgtggaagctgcgtttataatatgatgggcaagagagagaagaaacttggggagtttggcaaagccaagggatcccgggccatttggtacatgtggctgggcgcgagatacctcgagttcgaagctctggggtttctgaacgaggatcattggttctctcgggaaaatagctattccggagtggagggcgaagggctccacaagctgggatacatccttcgcgacatttctaaaatccccggcggggccatgtatgccgatgacaccgctggctgggacacgagaattaccgaggatgacctgcataacgaggaaaagatcacacagcagatggatccggagcaccggcagctcgccaatgctatctttaaactgacctaccaaaacaaggtcgtgaaagtgcagcgccctacacccaagggaaccgttatggacattatcagcagaaaggatcagcggggctccggacaggtgggaacatatggccttaataccttcacgaacatggaagcccaactggtccgccagatggagggggaaggagtgctcagcaaagcggacctggagaatccccatctgctcgagaagaaaattacacagtggctggaaaccaagggcgttgagagacttaaacggatggccatctctggggatgactgcgtggtcaagcctattgatgaccgctttgctaacgccctgctcgctctgaacgatatgggcaaggtgagaaaagacatcccgcagtggcaaccctccaagggatggcatgattggcagcaggtccctttctgtagccaccatttccacgaacttatcatgaaagacggccggaagctggtggttccctgccgccctcaggacgagctcattgggagagcccggatctctcaaggagcgggctggtccctgaaagaaaccgcctgtctggggaaggcttacgcccagatgtggagcctcatgtattttcaccgcagagatctgcggcttgcttctaatgccatttgctccgctgtgcccgtccattgggtgcctacaagcagaaccacatggtccatccacgcccatcaccagtggatgacgaccgaggacatgctgacagtttggaaccgcgtgtggattgaggataatccctggatggaagacaagaccccggtcacaacctgggaggatgtgccttacctcggaaaacgggaagaccaatggtgtggcagcctgatcgggcttacgtctagagcgacctgggcccagaacattctgacagctatccaacaggtgcgcagcctcatcggcgatgaggagttcctggactacatgccctccatgaagcggtttagaaaagaagaggaatctgagggagccatttggtga

SEQ ID NO: 20919 - RNA, 9873 nt, synthetic construct
  misc_feature 1..9873: note = derived and/or modified CDS sequence (opt5) from DENV-3__DQ863638__SS-prME
  source 1..9873: mol_type = other RNA
acaagcctctgcctcatgatgatgctgcccgccacgcttgctttccacctgacgtcccgggacggcgaacctcggatgatcgtggggaagaatgaacgcggaaaatctctcctgtttaagacagccagcggcattaatatgtgtacacttatcgcgatggatctgggggagatgtgcgacgataccgtcacatacaaatgtccgcatattgctgaagttgagcccgaagacatcgattgctggtgtaacctcacctccacatgggtgacctatggaacgtgcaatcaggccggcgagcaccggcgggacaagcgctctgtggccctggctcctcatgtcgggatgggactggataccagaacacagacctggatgagcgccgagggcgcttggagacaggtggaaaaagttgagacatgggccctccgccaccccggcttcaccattctggcgctttttctggcccattacatcgggacgtccctcacacagaaggtggtcatcttcattctgcttatcctggtgaccccttctatggctatgagatgtgttggagtgggcaaccgggactttgtcgaagggctcagcggagccacatgggtggatgtggtcctggagcacggcgggtgcgttaccaccatggctaagaataaacccacactggacattgagctccagaagacggaagccacccagctggcgacacttcgcaaactgtgtatcgagggaaagattaccaacatcacaaccgattccagatgccctacgcagggcgaagccattctcccggaggaacaggaccagaattatgtgtgtaaacacacatacgtggatcggggctgggggaacggatgcggcctgttcgggaagggaagccttgtgacatgcgctaagtttcaatgtctggagtctatcgagggcaaagtggttcagcatgaaaatctcaagtataccgtgatcattacagtccacaccggggaccagcatcaggtgggaaacgagacacaaggcgttacggccgaaatcacaccccaggcttccacagtggaggccattctgcctgaatacggcaccctggggctcgagtgcagcccccgcacaggactggacttcaatgagatgatccttctgaccatgaaaaacaaggcctggatggtccacagacagtggtttttcgatctccctctgccctggacgtctggcgctaccacagaaaccccgacatggaatcggaaagagcttctggtgacctttaagaacgcgcacgccaaaaagcaagaagtcgtggttctcgggtcccaggagggagctatgcatacggccctgacaggcgccaccgaaattcagaatagcgggggcacatctatcttcgctggacacctgaagtgtcgcctcaaaatggacaagctggagcttaaaggcatgtcctatgccatgtgcctgaacacctttgtgctcaagaaagaggtcagcgaaacccagcatgggacaatcctgattaaggtggagtacaagggagaagatgcgccttgtaaaatccccttctccacggaggacggccaagggaaggctcacaacggaagactgattaccgccaatcctgttgtgaccaagaaagaggaacccgtcaacatcgaggccgaaccccctttcggcgagtctaatattgtgatcgggatcggcgataaagctcttaagattaactggtacaagaaaggaagctccatcggcaagatgtttgaagccaccgctagaggggccagacgcatggcgattctcggagacacagcctgggatttcggcagcgtcggcggggttctcaattctctggggaaaatggtccatcagatctttgggtccgcttataccgccctcttcagcggcgtgtcttggattatgaagatcggaattggcgtgctgcttacgtggatcgggctgaacagcaaaaatacatccatgtcttttagctgcatcgctattggaatcattaccctctacctgggcgccgtcgtgcaggcggacatggggtgtgttatcaactggaagggaaaggagctgaaatgcggctccgggattttcgtgaccaatgaggtccacacatggaccgaacagtataagtttcaagccgatagcccgaaacggcttgctacagccatcgctggcgcctgggagaacggagtgtgtggcatcagatctacgacccgcatggaaaatctcctgtggaagcagattgccaacgagctgaattacatcctctgggaaaacaatattaaactgacagttgtggtcggggacatcattggagtgcttgagcagggcaagcggaccctgacaccccagcctatggagctcaaatattcctggaagacctgggggaaggctaaaatcgttacggcggaaacccaaaacagctctttcatcattgatggaccccacacacctgagtgccccagagcctcccgcgcttggaacgtgtgggaagtcgaggactacggctttggcgtgttcaccacaaatatctggctgaagctgcgggaagagtatacccagctttgtgaccatagactcatgagcgccgccgtgaaagatgagcgcgctgtccacgccgacatggggtactggattgaatcccagaagaacggatcttggaaactggagaaggcgagcctgatcgaagttaagacatgcacctggccgaaatcccatacgctctggtctaatggcgtgctggagagcgatatgattatccctaagtcccttgctgggcccatcagccagcacaaccaccggcctggataccatacacaaaccgccggcccctggcacctggggaaactcgagctggactttaattattgcgaaggaaccacagtggtcattaccgagaactgtggcacgagaggcccttctctgcgcacaaccacagtgtccgggaaacttatccatgaatggtgctgtcggagctgcaccctgcccccgctgagatacatgggagaggatggctgttggtatgggatggaaattcggcctatcaatgagaaagaggaaaacatggttaagtctctggcctccgctggaagcggcaaggtggacaatttcacaatggggtttctctgcctggccattcttttcgaggaagtcatgcgcggaaaattcggcaagaaacacatgatcgcgggcgtgtttctgaccttcctcctgctgctttctgggcagattacgtggagagatatggctcataccctgatcatgatcggaagcaacgcctccgaccggatgggcatgggggttacatacctcgccctgattgctacctttaagatccagcccttcctcgccctgggatttttccttagaaaactgacaagccgcgagaattttctcctgggcgtggggctggctatggccaccacgcttcaactgcccgaagatattgagcagatggcgaacggaatcgccctcggcctgatggctctcaagctgattacacagttcgagacctatcagctttggacagccctggtctctctcacctgttccaataccatctttacactgacggtggcttggcggaccgccacactgatccttgccggcgttagcctgctccctgtgtgccaatcctctagcatgagaaagaccgactggctgccgatggctgtcgcggccatgggggtgccccctctccccctgttcatttttagccttaaagatacactgaagcgcagatcttggcctctgaacgaaggagtgatggctgtcggcctcgttagcatcctggcctcctctcttctgcggaatgacgtgcccatggccgggcctctcgtggctggaggcctgctcattgcctgttacgtcatcaccgggacgagcgcggatctgacagtggagaaagctgccgacgttacctgggaagaggaagccgagcagaccggagtgtcccacaaccttatgattacagtcgacgatgacggcaccatgcgcatcaaggatgacgagacagaaaacatcctgacggtgctgctcaaaaccgctctgcttattgttagcggcatcttcccctattctattccggccacactgctcgtgtggcacacctggcagaagcagacacaaagatccggggtcctgtgggatgtgccttctccccctgagacccagaaagcggaactcgaggagggagtctaccggatcaagcagcagggcatttttgggaagacgcaagtgggagttggcgtgcagaaagaaggggtcttccataccatgtggcacgtgacacgcggagctgttctgacccataatggcaagagacttgagcccaactgggcctccgtgaaaaaggacctgatctcctacggcgggggatggcggctgagcgcccagtggcaaaaaggcgaagaggtccaggtgattgctgtggaaccggggaagaatcctaagaacttccagacaatgcccggaatctttcagaccacaacgggcgagatcggggccattgctctcgatttcaaacctggaacctctggctcccccatcattaatcgcgagggcaaggttgtcgggctgtatggaaacggcgtggtgaccaagaatgggggatacgtcagcggcatcgcccaaaccaacgcggaacccgacgggcctaccccggagcttgaagaggaaatgtttaagaaaagaaatctgacaattatggatctccaccccggctccggaaagacgcggaagtatctgcctgccatcgtgcgcgaggctatcaaaagacggctcagaaccctgattcttgcccccacacgcgttgtggctgccgagatggaagaggccctgaagggcctgcctatccggtaccagaccacagctaccaaaagcgaacatacggggagagagattgtcgacctcatgtgccacgcgacattcaccatgcgcctgctttctcccgtgcgggttcctaactataatctgatcattatggatgaagcccactttaccgacccggctagcatcgccgccagaggatacatctccacacgcgtgggcatgggggaggctgccgcgattttcatgaccgctacaccccctggaaccgccgatgcctttccccagtctaacgctcctatccaggacgaggaacgggacattcccgagagaagctggaactccggcaacgaatggatcacggatttcgtcgggaagacagtgtggtttgttccgtctattaaagccggcaatgacatcgcgaactgtctccgcaagaacggaaagaaagtgattcaactgagccggaagaccttcgatacagagtatcagaaaaccaagctgaatgactgggattttgtcgtgacgaccgacatctccgagatgggcgccaacttcaaagctgatagagtgatcgaccctcggcgctgcctcaagcccgtcattcttacagatgggcccgaaagagttatcctggccggacctatgcccgtgaccgctgcctctgctgcccagcggcgcggcagagtggggcggaatcctcagaaggagaacgaccaatacattttcagaggacagccgctgaataacgatgaagaccatgcgcactggacagaggccaaaatgctcctggacaatatcaacacccccgaaggcattatccctgctctttttgagcccgagcgcgaaaagagcgccgctatcgatggggagtaccggctgaaaggcgaatccagaaagacattcgtcgagctcatgcgccggggagacctgcctgtgtggctggcccataaagttgccagcgaaggcattaagtataccgatagaaaatggtgctttgacggggagcgcaataaccagatcctcgaggaaaatatggatgtggagatttggacgaaggaaggagagaagaagaaacttcggcccagatggctggacgctcgcacatactctgatccgctggcgctcaaagagttcaaagactttgccgctggcagaaaatccatcgccctggatcttgtcaccgagattgggcgggtgcctagccacctggcccaccgcaccagaaacgctctcgacaatctggttatgctgcatacatctgagcacggaggccgggcctatcgccatgcggtggaggaactccccgaaaccatggagacacttctgctgctcggcctgatgatccttctgacagggggagccatgctgttcctgatctccggcaaggggattggaaagaccagcatcggcctgatttgtgtcatcgcttcctctgggatgctctggatggccgatgtgcctcttcagtggattgctagcgccatcgtcctggagtttttcatgatggtgctgctcattcccgaacctgagaaacaaagaacaccccaggacaaccagctggcgtacgttgtgatcggaatccttaccctggccgctattgtggccgctaatgaaatgggcctcctggagacaaccaagcgggatctgggcatgtccaaagaaccgggggtcgttagccctacgtcttatctcgacgtggaccttcaccccgcctccgcttggaccctgtacgccgtggcgacaaccgtcatcacacccatgctgagacataccattgagaacagcacggccaatgtgtctctcgctgccatcgctaaccaagccgttgtgctgatgggacttgataagggctggcctattagcaaaatggacctgggggtcccgctcctggccctgggatgctattcccaggtgaaccccctcacacttaccgcggctgtcctgctgctcgccacacactacgctatcatcggccctgggctgcaggccaaggccacccgcgaggctcagaagcggaccgccgcgggaattaccaagaatcccacggtggatggcatcatgaccattgaccttgatcctgttatctacgactctaagtttgaaaaacaactgggccaggtgatgctcctggtcctgtgtgccgtgcagctccttctgatgagaacaagctgggctctgtgcgaggccctcaccctggctacagggcccattaccacgctttgggaaggatcccctggcaagttctggaacacaaccatcgccgtttctatggcgaatatctttcgcgggagctatctggccggagctggcctcgccttctccattatgaaaagcgtggggaccggaaagcggggcacaggctctcagggggagaccctgggagaaaagtggaaaaagaaactgaaccaactctccagaaaggagtttgatctttacaaaaagagcggcatcacagaggtcgaccggacggaagctaaagaggggctgaagcgcggagaaattaccagacacgccgtgtcccggggctctgctaagctgcagtggttcgtggagcgcaatatggttatcccggaagggagagtcattgatctcggatgtggccggggcgggtggagctattactgcgccggactgaaaaaggtgacagaggtgcgcggctataccaaagggggacccggccatgaggaacctgtccccatgtccacatacgggtggaacatcgttaaacttatgtctggaaaagacgtgttctatctgcctcccgagaagtgtgataccctcctgtgcgacattggcgaaagctccccgagccctacggtggaggagtctagaaccatccgggtcctgaagatggtggaaccctggctcaaaaataaccagttttgtatcaaggttcttaatccctacatgcctacagtgattgagcacctggaacgcctgcagagaaaacatggcgggatgctcgtccggaaccccctgtccagaaatagcacccacgagatgtactggatctctaacggaacaggcaatattgtgtccagcgttaacatggtgtctcgccttctgctcaatcggttcaccatgacacacagacgccctaccatcgaaaaggatgtcgacctgggggcgggaacgcggcatgtgaacgccgagccggagacacccaacatggacgtgattggcgaaagaatcaaacgcatcaaggaggaacacaatagcacctggcattatgatgacgagaacccttacaagacctgggcttatcacgggtcctacgaagtcaaagccacaggatctgctagctccatgattaatggcgttgtgaagctgctcacgaaaccctgggatgtggtccctatggtgatccaaatggccatgaccgacacaaccccctttggccagcagcgggttttcaaggagaaagtggatacaagaaccccgcgccctatgcccgggacacggaaggtcatggagattaccgccgaatggctgtggagaacgcttggacgcaacaagcggcctagactgtgcacccgcgaggaatttaccaagaaggtgagaaccaatgcggctatgggcgccgttttcacagaggaaaaccaatgggacagcgcccgggctgccgtggaggatgaggaattttggaaactcgtcgaccgcgagagagaactgcataaacttgggaaatgtggatcctgcgtgtataatatgatgggcaagcgggagaaaaagctgggggagttcggcaaggctaaaggatctagagccatctggtacatgtggctcggcgcgcggtatctggaatttgaggccctggggttctttaacgaagatcactggttcagccgcgaaaattcctactctggagttgaaggcgaggggctccacaagctgggatacattcttagagacatcagcaaaatccccggcggggctatgtatgccgatgacaccgctggctgggacacgcggattacagaggatgacctgcataacgaagagaagatcacccagcagatggatcctgaacaccgccagctcgccaatgcgatttttaaactgacataccaaaacaaggtggtcaaggtgcagagacccaccccgaaaggaacggtcatggacatcatttcccggaaggatcagcgcggctctggacaggtgggaacctatggccttaatacattcaccaacatggaggcccaactggttagacagatggaaggggagggagtgctcagcaaagctgacctggagaatcctcatctgctcgaaaagaaaatcacacagtggctggagaccaagggcgtcgaacggcttaagcgcatggccatctccggggatgactgcgtggtgaaacccattgatgacagattcgctaacgccctgctcgctctgaacgatatgggcaaggttcggaaagacatcccccagtggcaacctagcaagggatggcacgattggcaacaggtgccgttttgttctcaccatttccacgagcttattatgaaagacggccgcaagctggtcgtgccctgcagacctcaggacgaactcatcgggcgggcccgcatttccagaggagcgggctggagcctgaaggagacagcctgtctggggaaggcttacgcccaaatgtggtctctcatgtattttcatcggagagatctgcgccttgcctccaatgctatctgcagcgccgttcccgtgcactgggtccctacctctcggacgacatggtccattcatgcgcaccaccagtggatgaccaccgaggacatgctgacagtgtggaacagagtctggatcgaagataatccctggatggaggacaagacccctgtgacaacgtgggaagatgttccctacctcggaaaacgcgaggaccagtggtgtggcagcctgatcgggcttacctcccgggctacatgggcccaaaacattctgaccgccatccaacaggtgagaagcctcattggcaatgaggagttcctggattatatgccgtctatgaagcgctttaaaaaggaggaagagagcgaaggagctatctggtga

SEQ ID NO: 20920 - RNA, 9873 nt, synthetic construct
  misc_feature 1..9873: note = derived and/or modified CDS sequence (opt5) from DENV-3__KJ737430__SS-prME
  source 1..9873: mol_type = other RNA
acctccctgtgcctgatgatgatgctgcccgccacccttgctttccacctgacgtcccgggacggcgaacctcggatgatcgtggggaagaacgaacgcggaaaatctctcctgtttaagaccgccagcggcattaatatgtgtacacttatcgcgatggatctgggggagatgtgcgacgataccgtcacatacaaatgtccgctcattgctgaagttgagcccgaagacatcgattgctggtgtaacctgacctccacatgggtgacctatggaacgtgcaatcaggccggcgagcatcggcgggacaagcgctctgtggccctggctcctcacgtcgggatgggactcgataccagaacacagacctggatgagcgccgagggcgcttggagacaggtggaaaaagttgagacatgggccctgcgccatcccggcttcaccattcttgcgctgtttctcgcccactacatcgggacgtccctgacacagaaggtggtcatcttcattcttctgatgctcgtgaccccttctatggctatgagatgtgttggagtgggcaaccgggactttgtcgaagggctgagcggagccacatgggtggatgtggtcctggagcatggcgggtgcgttaccaccatggctaagaataaacccacactcgacatcgagctgcagaagacggaagccacccagcttgcgacactgcgcaaactctgtattgagggaaagatcaccaacattacaaccgattccagatgccctacgcagggcgaagccatcctgccggaggaacaggaccagaattatgtgtgtaaacacacatacgtggatcggggctgggggaacggatgcggccttttcgggaagggaagcctggtgacatgcgctaagtttcaatgtctcgagtctattgagggcaaagtggttcagcacgaaaatctgaagtataccgtgatcatcacagtccataccggggaccagcaccaggtgggaaacgacacacaaggcgttacggtggagattacaccccaggcctccacagtcgaagctatcctgcctgagtacggcaccctcgggctggaatgcagcccccgcacaggacttgatttcaatgagatgattctgctcaccatgaaaaacaaggcctggatggtgcatagacagtggtttttcgacctgcctcttccctggacgtctggcgccaccacagagaccccgacatggaatcggaaagaactgctcgtcacctttaagaacgctcacgcgaaaaagcaagaggtggttgtgctggggtcccaggaaggagccatgcacacggctctgacaggcgccaccgagatccagaatagcgggggcacatctattttcgccggacatctcaagtgtcgcctgaaaatggataaacttgaactgaaaggcatgtcctatgctatgtgcctcaacacctttgtcctgaagaaagaggtgagcgagacccagcacgggacaatcctgatcaaggttgaatacaagggagaggacgccccttgtaaaattcccttctccacggaagatggccaagggaaggcgcataacggaagacttatcaccgctaatcctgtggtcaccaagaaggaggagcccgtgaacattgaagccgagccccctttcggcgaatctaatatcgtgattgggatcggcgacaaagccctcaagatcaactggtacaagaaaggaagctccattggcaagatgtttgaggctaccgccagaggggctagacgcatggccatcctgggagatacagcgtgggacttcggcagcgttgggggagtcctcaattctctcggcaaaatggtgcaccagatttttgggtccgcctataccgctctgttcagcggcgtgtcttggatcatgaagattggaatcggcgtccttctgacgtggattgggctcaacagcaaaaatacatccatgtcttttagctgcatcgccatcggaattatcaccctgtacctgggcgctgtggttcaggccgatatggggtgtgtgattaactggaagggaaaggaacttaaatgcggctccgggatcttcgtcaccaatgaggtgcatacatggaccgagcagtataagtttcaagcggacagcccgaaacggctcgccacagctattgccggcgcttgggaaaacggagtttgtggcatcagatctacgacccgcatggagaatctgctgtggaagcagatcgccaacgaactcaattacattctgtgggagaacaatatcaaacttacagtggtcgtgggggatattatcggagttctggaacagggcaagcggaccctcacaccccagcctatggagctgaaatattcctggaagacctgggggaaggccaaaattgtgacggctgagacccaaaacagctctttcatcatcgacggacccaacacacctgaatgcccctccgcgagcagagcctggaatgtctgggaggtggaagactacggctttggcgtgttcaccacaaacatttggctgaaacttcgcgaggtctatacccagtcctgtgatcaccggctcatgtctgctgccatcaaagacgaaagagccgttcacgctgatatggggtactggattgagagccagaagaatggatcctggaaactggagaaggcctcttttatcgaagtgaagacatgcacctggccgaaaagccatacgctgtggtccaacggcgtgctcgagagcgacatgattatccctaagtctctggcggggcccatctcccagcacaatcatcgccctggataccacacacaaaccgctggcccctggcaccttgggaaactggaactcgatttcaactattgcgagggaaccacagtcgtgattaccgagaattgtggcacgcggggccctagcctgagaacaaccacagtttctgggaagctgatccatgaatggtgctgtcgctcctgcacccttcccccgctccggtacatgggagaggacggctgttggtatgggatggaaattagacctatcaacgagaaagaagagaatatggtcaagagcctggtctctgccggaagcggcaaggtggataactttacaatgggggttctgtgcctcgccattctgttcgaggaagtgatgcggggaaaattcggcaagaaacacatgatcgctggcgtcctttttaccttcgtgctgctcctgtccgggcagattacgtggcgcgacatggcccataccctgatcatgatcggaagcaatgcgtctgatagaatgggcatgggggttacataccttgctctgattgccacctttaagatccagcccttcctcgccctgggatttttcctccggaaactgacatccagagagaaccttctgctcggcgtggggctggctatggccaccacgctgcaacttcccgaagacattgagcagatggctaatggaatcgccctgggcctcatggcgctgaagctcattacacagtttgaaacctatcagctgtggacagcccttgtcagcctgacctgttccaacaccatcttcacactcacggtggcttggcgcaccgccacactgatcctggctggcgtgtctcttctgcctgtctgccaaagctcctctatgcggaagaccgattggctcccgatggccgttgccgctatgggggtgccccctctgcccctctttattttcagcctgaaagacacacttaagagacgctcctggcctctgaatgagggagtgatggcggtcggcctggtgtctatcctcgccagctccctgcttagaaacgatgttcccatggctgggcctctggtggccggaggcctcctgattgcctgttacgtcatcaccgggacgagcgctgacctcacagtggagaaagccgcggacgttacctgggaagaggaagctgagcagaccggagtgtctcacaacctgatgattacagtcgatgacgatggcaccatgcggatcaaggacgatgaaacagagaatatccttacggtgctgctgaaaaccgccctcctgattgtctccggcatctttccctatagcattccggccacacttctggtgtggcatacctggcagaagcagacacaacgctctggggttctctgggacgtgccttctccccctgagacccagaaagctgaactggaggaaggagtctacagaatcaagcagcagggcattttcgggaagacgcaagtgggagttggcgtgcagaaagagggggtctttcacaccatgtggcacgtgacacggggagccgtgctcacccataacggcaagcgcctggagcccaattgggcgagcgttaaaaaggatcttatcagctacggcgggggatggagactgtccgctcagtggcaaaaaggcgaagaggtccaggtgattgccgtggaaccggggaagaaccctaagaatttccagacaatgcccggaatcttccagaccacaacgggcgagatcggggccattgctctggactttaaacctggaaccagcggctcccccatcattaaccgggaaggcaaggtcgtggggctctatggaaatggcgttgtgaccaagaacgggggatacgtcagcggcatcgcccaaaccaatgctgagcccgatgggcctaccccggagctggaagaggaaatgttcaagaaacgcaaccttacaattatggacctgcaccccggctctggaaagacgagaaagtatctccctgccatcgtgcgggaggcgatcaaacgcagactgcggaccctcattctggcccccacaagagttgtggctgccgaaatggaggaggctcttaagggcctgcctatccgctaccagaccacagccaccaaaagcgaacatacggggcgggagattgtcgatctgatgtgccacgccacatttaccatgagactcctgtcccccgtgcgcgttcctaattataaccttatcattatggacgaagctcatttcaccgatccggcgtctatcgccgctcggggatacatcagcacaagagtgggcatgggggaggccgccgctatttttatgaccgccacaccccctggaaccgcggaggctttcccccagtccaatgcccctatccaggacgaggagcgcgacattcccgaacggtcttggaacagcggcaatgagtggatcacggattttgtcgggaagacagtgtggttcgtgccgtccattaaagccggcaacgacatcgctaactgtctgagaaagaatggaaagaaagtcattcaactctctcgcaagacctttgatacagaatatcagaaaaccaagctgaacgactgggatttcgttgtgacgaccgacatcagcgagatgggcgccaattttaaagcggatcgggtgatcgaccctagacggtgcctgaagcccgtcattctcacagatgggcccgagcgcgtgatccttgccggacctatgcccgttaccgctgcctccgctgcccagagacggggccgcgtggggagaaaccctcagaaggaaaatgaccaatacattttcacaggacagccgctgaacaatgatgaggaccacgctcactggaccgaagccaaaatgctgctcgacaacatcaatacacccgagggcattatccctgcgctgttcgaacccgagcgggaaaagagcgccgctatcgatggggaatacagacttaaaggcgagtctcgcaagacctttgtcgaactgatgcggagaggagacctccctgtgtggctggcccataaagttgcttccgagggcattaagtatacggatcgcaaatggtgcttcgacggggaacggaacaatcagatcctggaggagaacatggatgtggaaatttggacaaaggagggagaaagaaagaaactccgcccccggtggcttgacgccagaacctacagcgatccgctggccctgaaggagtttaaagacttcgctgcgggccgcaagtctatcgccctcgatctggtcaccgaaattgggagagtgccttcccaccttgctcatcggacacgcaatgccctggacaacctcgtcatgctgcacaccagcgagcacggaggcagagcctatcggcatgctgtggaggaactgcccgagacaatggaaacgctccttctgctgggcctcatgatcctgcttaccgggggagccatgctgtttctcatctccggcaaagggattggaaagacatctatcggcctgatttgtgttatcgtgagctccgggatgctgtggatggcggatgtgcctctccagtggattgccagcgctatcgtccttgagttctttatgatggttctgctgattcccgagcctgaaaagcaacgcacaccccaggacaatcagctcgcctacgtggtgatcggaatcctgacacttgctgccattgtcgcggccaacgagatgggcctgctcgaaaccacgaaaagagatctgggcatgtctaaggagccgggggtggtttcccctaccagctatctggacgtggacctccaccccgcttctgcctggacactttacgctgtcgccaccacagtgatcacccccatgctgcggcatacgattgaaaatagcacagctaacgtctccctggccgcgatcgccaaccaagctgtggttctcatgggactggataaaggctggcctatttctaagatggaccttggggtgccgctgctcgccctgggatgctatagccaggtcaatcccctgaccctcacagctgccgtgcttctgctggttacccactacgccatcatcggccctgggctccaggcgaaagctaccagagaggcccagaagcgcacagctgccggaattatgaagaaccccacggtggatggcatcatgaccattgacctggatcctgtcatctacgactccaaattcgagaagcaacttggccaggtgatgctgctcgtgctgtgtgccgttcagctgctccttatgcggacatcttgggctctgtgcgaagccctgaccctcgcgacagggcccattaccacgctgtgggagggaagccctggcaaattttggaatacaaccatcgccgtctccatggctaacatcttcagagggagctatcttgccggagctggcctggccttttctattatgaagtccgtggggaccggaaaacgcggcacaggcagccagggggaaaccctcggagagaagtggaagaaaaagctgaatcaactgtcccggaaagagttcgatctctacaagaaatctggcatcacagaggtggacagaacggaggcgaaggaagggcttaaacggggagagaccacacatcacgccgtcagccgcggctccgctaagctgcagtggtttgttgaaagaaacatggtgattccggaggggcgggtgatcgatctgggatgtggccgcggcgggtggtcttattactgcgccggactcaagaaagtcaccgaagtgagaggctatacaaaagggggacccggccacgaggagcctgttcccatgagcacctacgggtggaatattgtgaaactgatgtccggaaaggacgtcttctatcttcctcccgaaaaatgtgatacgctgctctgcgacatcggcgagagctctccgtcccctaccgtggaagagagccggacaattcgcgttctgaagatggtggagccctggctgaagaacaatcagttctgtatcaaagtcctcaacccctacatgcctaccgtgatcgaacatcttgagagactgcagcggaagtacggcgggatgctggtgcgcaatcccctctctagaaactccacacacgaaatgtattggattagcaatggaaccggcaacatcgtctctagcgttaatatggtgtcccggctgcttctgaacagatttacaatgacccatcgccggcctacgattgagaaagatgtggacctcggggctggaacaagacacgtcaacgccgaaccggagacccccaatatggacgtgatcggcgagcgcattaagcggatcaaagaagaacactctagcacctggcattacgatgacgaaaacccttataagacatgggcttaccacgggtcctatgaggttaaggccacgggaagcgcgtcctctatgatcaatggcgtggtcaaactgctgaccaagccctgggatgtggttcctatggtgattcaaatggccatgacagacaccacacccttcggccagcagagagtctttaaagaaaaggtggatacccgcacaccgcggcctatgcccgggaccagaaaagttatggagatcacggctgagtggctctggcgcaccctgggacggaacaagagacctcgcctttgcacacgggaagagttcaccaagaaagtgagaacaaatgccgctatgggcgccgtctttaccgaagagaaccaatgggacagcgcccgcgcggctgtggaagatgaggagttctggaagctggtcgacagagaacgggagctccataaactggggaagtgtggatcctgcgtgtacaatatgatgggcaaacgcgaaaagaaacttggggagtttggcaaggccaagggatctagagccatttggtatatgtggctgggcgctcggtacctcgagttcgaagccctggggtttctgaacgaggatcactggttcagcagagaaaattcctactctggagttgagggcgaagggctccataaactgggatatatccttcgggacattagcaagatccccggcggggctatgtacgccgatgacacggcgggctgggacacacgcatcaccgaggatgacctgcacaacgaggagaagattacacagcagatggatcctgagcacagacagctcgccaatgctatctttaagctgacctatcaaaacaaagtggtcaaggtgcagcggcccacgccgaagggaaccgtgatggacattatctcccgcaaagatcagagaggcagcgggcaggttggaacatacggccttaataccttcacaaacatggaagcccaactggtgcggcagatggagggggaaggagtcctctctaaggctgacctggagaatcctcatctgctcgagaaaaagattacccagtggctggaaacaaaaggcgtggagcgccttaagagaatggccatctccggggatgactgcgttgtgaagcccatcgatgaccggtttgcgaacgccctgctcgctctgaacgatatgggcaaagtccgcaaggacattccccagtggcaacctagcaaaggatggcacgattggcaacaggtgccgttctgttctcatcacttccacgaacttatcatgaaggacggcagaaaactggtcgtgccctgccggcctcaggacgagctcattgggcgcgccagaatctcccaaggagctggctggagcctgaaggaaaccgcctgtctggggaaggcttatgcccagatgtggtctctcatgtactttcatcggcgcgatctgagacttgcgtccaatgccatttgcagcgctgttcccgtgcactgggtccctacgtcccggacaacctggagcatccatgcccaccatcagtggatgaccacagaggacatgctgaccgtgtggaacagagtttggattgaggataatccctggatggaagacaaaacacctgtgacgacctgggaggatgtcccctatctcggaaagcgcgaagaccaatggtgtggctctctgatcgggcttacaagccgggccacctgggctcagaacatcctgacagccattcaacaggtgagatccctcatcggcgatgaggagttcctggactacatgccgtctatgaaacgctttcggaaggaagaggaaagcgagggagcgatttggtga

SEQ ID NO: 20921 - RNA, 9873 nt, synthetic construct
  misc_feature 1..9873: note = derived and/or modified CDS sequence (opt5) from DENV-3__AY858040__SS-prME
  source 1..9873: mol_type = other RNA
accagcctctgcctcatgatgatgctccccgccacacttgctttccacctgacgtcccgggacggagagcctcggatgatcgtggggaagaacgaacgcggaaagtctctcctgtttaagaccgccagcggaattaatatgtgtacacttatcgcgatggatctgggggagatgtgcgacgataccgtgacatacaagtgtccgctcattaccgaagttgagcccgaagacatcgattgctggtgtaacctgacatccacctgggtgacgtatggaacctgcaatcaggctggcgagcatagacgggacaagcgctctgtggccctggcccctcacgtcgggatgggactcgatacaagagctcaaacctggatgagcgccgagggcgcttggagacaggtggaaaaagttgagacatgggccttccgccatcccggctttaccattctggcgcttttcctggcccactacatcgggacgtccctcacacagaaggtggtcatctttattctgcttatgctggtgaccccttctatgacaatgagatgtgttggagtgggcaaccgggacttcgtcgaagggctcagcggagctacctgggtggatgtggtcctggagcatggcgggtgcgttaccacaatggccaagaataaacccacgctggacatcgagctccagaagaccgaagctacacaactggccacccttcgcaaactgtgtattgagggaaagatcacaaacgtgaccacggattccagatgccctacacagggcgaagcgattctcccggaggaacaggaccagaattatgtgtgtaaacacacctacgtcgatcggggctgggggaacggatgcggcctgtttgggaagggaagccttgtgacctgcgccaagttccaatgtctggagctcatcgagggcaaagttgtgcagcacgaaaatctgaagtatacagtcattatcaccgtgcatacaggggaccagcaccaggttggaaacgagacgcaaggcgtgaccgctgaaatcacaccccaggcctctaccgtcgaggctattctgcctgaatacggcacactcgggctggagtgcagcccccgcaccggacttgactttaatgagatgatcctgctcacgatgaaaaacaaggcctggatggtgcatagacagtggttctttgatctgcctcttccctggaccagcggcgccacaaccgaaacaccgacctggaataaaaaggagctgctcgtcacgttcaaaaacgctcacgcgaagaagcaagaagtggttgtgctggggtctcaggagggagccatgcacacagctctgaccggcgccacagaaattcagacctccgggggcaccagcatctttgccggacatctcaaatgtcggctgaagatggacaaacttgagctgaagggcatgtcttatgctatgtgctccaatgccttcgtcctcaaaaaggaggtgagcgaaacacagcacgggacgattctgatcaaggttgagtacaaaggagaagatgcgccttgtaagatccccttctccaccgaggacggccaagggaaagctcataacggacgcctgattacagccaaccctgtggtcaccaagaaagaggaacccgtgaatatcgaggccgaacccccttttggcgagtctaacattatcattgggatcggcgataaggctcttaagatcaattggtacaaaaagggaagctccattggcaaaatgttcgaagccacagctagaggggcccggagaatggcgatcctcggagacaccgcctgggattttggcagcgtcgggggagttctgaactctctgggcaagatggtccaccagattttcgggtccgcttatacggccctctttagcggcgtgtcttggatcatgaaaattggaatcggcgtgctgcttacatggattgggctgaatagcaagaacacctccatgtctttcagctgcatcgtcatcggaattatcaccctctacctgggcgctgtggttcaggccgacatggggtgtgtgattaattggaagggaaaagagctgaagtgcggctccgggatctttgtcacaaacgaggtgcatacctggacagaacagtataaattccaagcggatagcccgaagcgccttgccacggctattgccggcgcttgggagaatggagtttgtggcatccggtctaccacaagaatggaaaacctcctgtggaaacagatcgccaatgagctgaactacattctctgggaaaataacatcaagctgaccgtggtcgtgggggacattatcggagttcttgagcagggcaaacgcacactgacaccccagcctatggagctcaagtattcctggaagacgtgggggaaagccaagattgtgaccgctgaaaaacaaaatagctcttttatcatcgatggacccaacacacctgagtgccccaacgcgtcccgggcctggaatgtctgggaagtggaggactacggcttcggcgtgtttaccacaaacatttggctgaagctgagagaaatgtatacccagctttgtgaccaccgcctcatgagcgctgccgtcaaagatgagcgggccgttcacgctgacatggggtactggatcgagtcccagaagaatggatcttggaagctggaaaaagccagcctgattgaggtgaagacatgcacctggccgaaatcccatacgctctggtctaacggcgtgctggaaagcgatatgatcattcctaagtcccttgcggggcccatcagccagcacaattacagacctggatatcatacacaaaccgctggcccctggcacctggggaaactcgagctggacttcaactactgcgagggaaccacagtcgtgatcaccgaaaattgtggcacgcgcggcccttctctgcggacaaccacagtttccgggaaacttattcacgagtggtgctgtagaagctgcaccctgcccccgctgcgctatatgggagaagatggctgttggtacgggatggagatccggcctattaacgaaaaggaggagaatatggtgaaatctctggtctccgccggaagcggcaaggtggacaactttacaatgggggttctctgcctggccatccttttcgaagaggtgatgagaggaaaattcggcaagaaacatatgattgctggcgtcctgtttaccttcgtgctcctgctgtctgggcagatcacgtggcgggatatggcccgcacccttattatgatcggaagcaatgcgtccgacagaatgggcatgggggttacatatctggctctcatcgccacctttaagattcagcccttcctggccctcggatttttcctgcggaaacttacaagcagagaaaacctgctcctgggcgtggggctggctatggccaccacgcttcaactgcccgaggatatcgaacagatggctaatggaattgccctcggcctgatggcgctcaaactgatcacacagtttgagacctaccagctttggacagccctggtctctctcatgtgttccaacaccattttcaccctgacagtggcttggcgcacggccaccctgatccttgctggcatcagcctgatgcctgtgtgccaatcctctagcatgcggaagacagactggctcccgatgaccgtcgccgccatgggggttccccctctgcccctctttattttctccctgaaagatacacttaagagacgctcttggcctctgaatgagggagtgatggctgtgggcctggtcagcatcctcgcgtcctctctgcttagaaacgacgtgcccatggccgggcctctggttgctggaggcctcctgattgcctgttatgtgatcaccgggacgagcgccgatctcacagtcgaaaaagctgccgacgtgacctgggaggaagaggcggaacagaccggagtttcccacaacctgatgattacagtggacgatgacggcaccatgcggatcaaggatgacgagacagagaatatccttacggtcctgctgaaaaccgctctcctgattgtgagcggcatctttccctactctattccggccacacttctggtctggcatacctggcagaagcagacacaacgctccggggtgctctgggatgttccttctccccctgaaacccagaaggccgagctggaagagggagtgtacagaatcaaacagcagggcattttcgggaagacgcaagtcggagtgggcgttcagaaagagggggtgtttcacaccatgtggcatgtcacacggggagctgtgctcacctataacggcaagcgcctggaacccaattgggcctccgtgaaaaaggaccttatctcctacggcgggggatggagactgagcgcgtattggcagaagggcgaggaagttcaagtcattgctgtggagccggggaaaaaccctaagaatttccagacaatgcccggaatcttccagaccacaacgggcgaaatcggggccattgccctggattttaaacctggaacctctggctcccccatcattaaccgggagggcaaggtggtcgggctctacggaaatggcgtggttaccaagaacgggggatatgtgagcggcatcgctcagaccaatgccgagcccgacgggcctaccccggaactggaggaagagatgttcaagaagcgcaaccttacaattatggatctgcaccccggctccggaaaaacgagaaagtacctccctgctatcgtccgggaagccatcaaacgcagactgcggaccctcattctggcgcccacaagagtggttgccgctgagatggaggaagcccttaagggcctgcctgtgcgctatcaaaccacagctaccaaaagcgagcacacggggaaggaaatcgtcgacctgatgtgccatgccacatttaccatgcggctcctgtctcccgtgagagttcctaattacaaccttattatcatggatgaggcccacttcaccgacccggctagcattgcggcccgcggatacatctccacacgggtgggcatgggggaagctgccgccatctttatgaccgctacaccccctggaaccgccgatgcgttcccccagtctaatgctcctattcaggacgaggagagagacatccccgaacgcagctggaactccggcaatgattggattacggactttgccgggaagacagtctggttcgtgccgtctatcaaagccggcaacgatattgctaactgtctgcggaagaatggcaagaaggtgatccagctcagcagaaaaacctttgacacagagtatcaaaagaccaagctgaacgattgggacttcgtcgttacgaccgatatttccgaaatgggcgccaattttaaagcggaccgcgtgatcgatcctcggagatgcctgaagcccgtgatcctcacagacgggcccgagcgggtcattcttgccggacctatgcccgtgaccgttgcttctgccgctcagcgcagaggccgggtggggcgcaaccctcagaaagagaatgatcagtacatcttcacaggacaaccgctgaacaatgacgaagaccatgcccactggaccgaggctaagatgctgctcgataacattaatacacccgaaggcatcattcctgccctgttcgagcccgaaagagagaaaagcgcggccatcgacggggagtatcggcctaagggcgaatccagaaaaacctttgtcgagcttatgcgccggggagatctgcccgtgtggctcgctcataaggttgccagcgaaggcatcaagtacacggacagaaaatggtgcttcgatggggagcgcaacaatcagattctggaagagaacatggacgtggagatctggacaaaggaaggagagaaaaagaaactgcggccgagatggctcgatgctcgcacctattctgaccctcttgccctgaaggaatttaaggatttcgccgctggccggaaatccattgcgctggacctcgtcaccgagatcgggagagtgcccagccacctggcccaccgcacaagaaatgctcttgataacctggtcatgctccatacctctgaacacggaggccgggcctaccgccatgccgtggaggagctgcctgaaacaatggagacgctgctccttctgggcctgatgattctcctgaccgggggagctatgctttttctgatctccggcaagggggttggaaaaacaagcatcggcctcatttgtgtggtggcctcctctgggatgctgtggatggcggacatccccctgcagtggattgccagcgctatcgtcctcgagttctttatgatggttcttctgattcctgagcccgagaagcagagaaccccgcaagataatcagctggcctatgtggtgatcggcattctcacactggctgccatcgtcgcggccaacgaaatgggccttctggagaccacgaaacgggacctcggcatgtccaaggaacctggggtggttagccccacctcttacctggacgtggatctgcaccccgcttccgcctggacactctacgctgtcgccaccacagtgatcacccctatgcttcgccacacgattgagaatagcacagctaacgtctctctggccgcgatcgccaaccaggctgtggttctgatgggactcgacaagggctggccgattagcaaaatggatctgggggtgccccttctggccctcggatgctattcccaagtcaatcctctgaccctgacagctgccgtgctccttctggttacccattacgccatcattggccccgggctgcaggcgaaggctaccagagaagcccagaaacggacagctgccggaatcatgaagaaccctacggtggacggcatcatgaccattgatctcgaccccgtcatctatgattctaaattcgagaagcagctgggccaagtgatgcttctggtgctctgtgccgttcagctgctgctcatgagaacaagctgggctttttgcgaggcccttaccctggcgacagggcctattaccacgctgtgggaaggatccccgggcaagttctggaatacaaccatcgccgtctctatggctaacatttttcgcgggagctacctcgccggagctggcctggccttctccatcatgaaaagcgtggggaccggaaagcggggcacaggctctcagggggagacccttggagaaaaatggaagaaaaagctgaatcagctctccagaaaagagtttgacctgtataaaaagagcggcatcacagaagtggatcgcacggaggcgaaagaggggctgaagcggggagaaattacccaccatgccgtctccagaggctctgctaaactccaatggttcgttgagcggaacatggtgatccccgaagggcgcgtgattgaccttggatgtggcagaggcgggtggagctactattgcgccggactgaagaaagtcacagaggtgcggggctacaccaaagggggacctggccacgaagaacccgttcctatgtccacatacgggtggaatatcgtgaagctgatgtctggaaaagatgtcttctatctgcccccggagaagtgtgacaccctgctttgcgatattggcgaaagctcccctagccccacggtggaggaatctcgcaccatcagagttctgaaaatggtggagccctggctcaagaacaatcagttttgtattaaagtcctgaacccttacatgcccacagtgatcgagcatctggaacggctccagcgcaagcacggcgggatgcttgtgagaaatcctctgtcccggaacagcacccacgagatgtattggatctctaatggaacaggcaacattgtctccagcgttaatatggtgtctcgcctgctcctgaacagattcaccatgacataccggagaccgaccatcgaaaaggacgtggaccttggggctggaacgcgccatgtcaacgccgagcccgaaacacctaatatggatgtgattggcgagcggatcagacgcattaaagaggaacacagctccacctggcattatgacgatgagaacccctacaagacctgggcttatcacgggtcttacgaagttaaagccacaggaagcgcgtccagcatgatcaatggcgtggtcaagctgctcacgaaaccttgggacgtggttcccaccgtgacacagatggccatgaccgatacaaccccgtttggccaacagcgggtcttcaaggagaaggtggacacaagaacccctaaacccatgcctgggacgcgcaaggttatggaaatcaccgctgagtggctgtggcggacactgggaagaaacaaacgcccccggctctgcaccagagaggaatttacaaagaaagtgcgcaccaatgccgctatgggcgccgtcttcacggaggaaaaccagtgggattccgcccgggcggctgtggaggacgaagagttttggaagctggtcgatagagagcgcgaacttcacaaactggggaagtgtggatcttgcgtgtacaatatgatgggcaagagagagaaaaagctcggggagttcggcaaagccaagggaagccgggccatttggtatatgtggctgggcgctcgctaccttgagtttgaggccctggggttcctcaacgaagaccattggttttccagagaaaattcttatagcggagttgaaggcgaggggctgcacaaactgggatacatcctccgggatatttccaagatccctggcggggctatgtatgccgacgacacagcgggctgggataccagaattacagaagacgatctgcataacgaggagaagatcacccaacagatggaacccgagcaccggcagcttgccaatgctatcttcaaactgacgtaccagaacaaggtggtcaaagtgcaacgcccgacccctaagggaacagtgatggacattatctctagaaaagatcagcggggcagcgggcaggttggaacctatggcctcaatacatttaccaacatggaagcccagctgattcgccaaatggagggggaagacgtgctttccaagacagatctggagaatccccatctcctggagaagaaaatcacccagtggctggaaacgaagggagtcgagagactcaaacggatggctattagcggcgacgattgcgtggttaagcccatcgacgatcgcttcgccaacgcgctgcttgccctgaacgacatggggaaagtgagaaaggatatccctcagtggcagccgtctaagggctggcacgactggcaacaggtccccttctgttcccaccattttcacgaactcattatgaaagacggacggaagctggtggtcccttgccgcccccaggatgagcttatcggcagagctcggattagccagggggccggatggtctctgaaagaaacagcttgtctcggcaaggcctacgctcaaatgtgggccctgatgtacttccatcgcagagacctgcggctcgcgtccaatgccatctgcagcgctgtgcctgttcactgggtgcccacctctcgcaccacatggtccattcacgcccatcaccagtggatgaccacagaggatatgctgacggtctggaacagagtgtggatcgaggacaatccttggatggaagataaaacccccgttacaacctgggaggacgtgccgtatcttgggaagcgggaagatcagtggtgtggaagcctgattggcctcacatccagagccacctgggctcaaaacatcctgacggccatccagcaggtccgcagccttattgggaatgaggagtttctggactacatgccttctatgaagcggttcagaaaagaagaggaaagcgagggcgcgatctggtga

SEQ ID NO: 20922 - RNA, 9873 nt, synthetic construct
  misc_feature 1..9873: note = derived and/or modified CDS sequence (opt5) from DENV-3__AY858041__SS-prME
  source 1..9873: mol_type = other RNA
acaagcctgtgcctcatgatgatgctgcccgccacacttgctttccacctgacgtcccgggacggcgagcctcggatgatcgtggggaagaacgaacgcggaaagtctctcctgtttaagaccgccagcggcattaatatgtgtacacttatcgcgatggatctgggggagatgtgcgacgataccgtgacatacaaatgtccgctcattaccgaagttgagcccgaagacatcgattgctggtgtaacctgacatccacctgggtgacgtatggaacctgcaatcaggctggcgagcatcggcgggacaagcgctctgtggccctggcccctcacgtcgggatgggactcgatacaagagctcagacctggatgagcgccgagggcgcttggagacaggtggaaaaagttgagacatgggccttccgccatcccggctttaccattctggcgcttttcctggcccactacatcgggacgtccctcacacagaaggtggtcatctttattctgcttatgctggtgaccccttctatgacaatgagatgtgttggagtgggcaaccgggacttcgtcgaagggctcagcggagctacctgggtggatgtggtcctggagcatggcgggtgcgttaccacaatggccaagaataaacccacgctggacatcgagctccagaagaccgaagctacacagctggccacccttcgcaaactgtgtattgagggaaagatcacaaacgtgaccacggattccagatgccctacacagggcgaagcgattctcccggaggaacaggaccagaattatgtgtgtaaacacacctacgtcgatcggggctgggggaacggatgcggcctgtttgggaagggaagccttgtgacctgcgccaagttccaatgtctggagctcatcgagggcaaagttgtgcagcacgaaaatctgaagtatacagtcattatcaccgtgcatacaggggaccagcaccaggttggaaacgagacgcaaggcgtgaccgctgaaatcacaccccaggcctctaccgtcgaggctattctgcctgaatacggcacactcgggctggagtgcagcccccgcaccggacttgactttaatgagatgatcctgctcacgatgaaaaacaaggcctggatggtgcatagacagtggttctttgatctgcctcttccctggaccagcggcgccacaaccgaaacaccgacctggaataaaaaggagctgctcgtcacgttcaaaaacgctcacgcgaagaagcaagaagtggttgtgctggggtctcaggagggagccatgcacacagctctgaccggcgccacagaaattcagacctccgggggcaccagcatctttgccggacatctcaaatgtcggctgaagatggacaaacttgagctgaagggcatgtcttatgctatgtgctccaatgccttcgtcctcaaaaaggaggtgagcgaaacacagcacgggacgattctgatcaaggttgagtacaaaggagaagatgcgccttgtaagatccccttctccaccgaggacggccaagggcaggctcataacggacgcctgattacagccaaccctgtggtcaccaaaaaggaggaacccgtgaatatcgaggccgaatctccctttggcgagagcaacattatcattgggatcggcgataaagctcttaagatcaattggtacaagaaaggatccagcattggcaagatgttcgaagccacagctagaggggcccggagaatggcgatcctcggagacaccgcctgggattttggctctgtcgggggagttctgaactccctgggcaaaatggtccaccagattttcgggagcgcttatacggccctcttttctggcgtgagctggatcatgaagattggaatcggcgtgctgcttacatggattgggctcaattccaaaaacacctctatgagcttctcctgcatcgtcatcggaattatcaccctctacctgggcgctgtggttcaggccgacatggggtgtgtgattaattggaagggaaaggagctgaaatgcggcagcgggatctttgtcacaaacgaggtgcatacctggacagaacaatataagttccaggcggattctcctaaacgccttgccacggctattgccggcgcttgggagaatggagtttgtggcatccggtccaccacaagaatggaaaacctcctgtggaagcagatcgccaatgagctgaactacattctctgggaaaataacatcaaactgaccgtggtcgtgggggacattatcggagttcttgagcagggcaagcgcacactgaccccgcaacccatggagctcaaatatagctggaagacgtgggggaaggccaaaattgtgaccgctgaaatccaaaattcttcctttatcattgatggacctaacacacccgagtgccctaacgcgagccgggcctggaatgtctgggaagtggaggactacggcttcggcgtgtttaccacaaacatctggctgaagctgagagaaatgtatacccagctttgtgaccaccgcctcatgtccgctgccgtcaaagatgagcgggccgttcacgctgacatggggtactggattgagtctcagaagaatggaagctggaaactggaaaaggcctccctgatcgaggtgaagacatgcacctggcccaaatctcatacgctctggagcaacggcgtgctggaatccgatatgattatcccgaagtcccttgcggggcctatctctcaacacaattacagacccggatatcatacacagaccgctggcccttggcacctggggaaactcgagctggacttcaactactgcgagggaaccacagtcgtgattaccgaaaattgtggcacgcgcggcccctccctgcggacaaccacagttagcgggaaacttatccacgagtggtgctgtagatcttgcaccctccctcccctgcgctatatgggagatgacggctgttggtacgggatggaaattcggccgatcaacgagaaagaagagaatatggtgaagtccctggtcagcgccggatctggcaaggtggataactttacaatgggggttctctgcctggccattcttttcgaggaagtgatgagaggaaaattcggcaagaaacatatgatcgctggcgtcctgtttatgttcgtgctcctgctgagcgggcagattacctggcgggacatggcccgcacgcttatcatgatcggatccaatgcgagcgatagaatgggcatgggggttacctatctggctctcattgccacatttaagatccaacctttcctggccctcggatttttcctgcggaaacttacctctagagagaacctgctcctgggcgtggggctggctatggccacaacccttcagctgcccgaagacattgagcagatggctaatggaatcgccctcggcctgatggcgctcaagctgattacgcagtttgaaacataccaactttggaccgccctggtctccctcacatgtagcaacaccatcttcaccctgacagtggcttggcgcacggccaccctgatccttgctggcatttccctgctccccgtgtgccagtctagctccatgcggaagacagattggctgcctatgaccgtcgccgccatgggggttccgcccctccctctgtttatcttctctcttaaagacacactgaagagacgcagctggcccctgaatgagggagtgatggctgtgggcctcgtctccattctggcgtctagccttctgagaaacgatgtgcctatggccgggcccctcgttgctggaggcctgctcatcgcctgttatgtgattaccgggacgtccgccgacctgacagtcgagaaagctgccgacgtgacctgggaagaggaagcggagcagaccggagttagccacaaccttatgatcacagtggatgacgatggcaccatgcggatcaaggacgatgaaacagagaatattctgacggtcctgctcaaaaccgctctgcttatcgtgtctggcatttttccttactccatccccgccacactgctcgtctggcatacctggcagaagcaaacacagcgcagcggggtgctgtgggacgttccgtctcctcccgagacccagaaagccgaactcgaggaaggagtgtacagaattaagcagcaaggcatcttcgggaagacgcaggtcggagtgggcgttcagaaagagggggtgtttcacaccatgtggcatgtcacacggggagctgtgctgacctataacggcaagcgccttgagcctaattgggcctccgtgaaaaaggatctgattagctacggcgggggatggagactgtctgcgcaatggaaaaagggcgaagaggttcaggtcatcgctgtggaacccgggaagaacccgaaaaatttccagacaatgcctggaatcttccagaccacaacgggcgagattggggccatcgccctcgactttaagcccggaacctccggcagccctattatcaaccgggaaggcaaagtggtcgggctgtatggaaatggcgtggttacaaagaacgggggatacgtgtccggcattgctcaaaccaatgccgagcccgatgggcccacccctgagcttgaagaggaaatgttcaaaaagcgcaacctgacaatcatggacctccacccgggcagcggaaagacgagaaaatatctgcccgctatcgtccgggaggccattaagcgcagactccggaccctgatccttgcgcctacaagagtggttgccgctgaaatggaggaggccctgaaaggcctgcccattcgctaccagaccacagctaccaagtctgaacacacggggaaagagatcgtggatctcatgtgccatgccacatttaccatgcggctgcttagccctgtcagagtgcccaattataacctgattatcatggacgaagcccacttcaccgatcctgcttccatcgcggcccgcggatacatttctacacgggttggcatgggggaggctgccgccatctttatgaccgctacaccgcccggaaccgccgacgcgttccctcagagcaatgctcccattcaggacgaagagagagatatccctgagcgctcctggaactctggcaatgactggattacggattttgccgggaagacagtgtggttcgtccccagcatcaaggccggcaacgacattgctaactgtctccggaaaaatggaaagaaagtgatccaactgtccagaaagacctttgatacagaataccagaaaaccaagctgaacgactgggatttcgtggtcacgaccgacatctctgagatgggcgccaattttaaggcggatcgcgttattgacccgcggagatgcctcaaacctgtgatccttacagatgggcccgaacgggtgattctggccggacccatgcctgtcaccgtggctagcgccgctcagcgcagaggccgggttgggcgcaacccccagaaggagaatgaccaatatatcttcacaggacagcctctgaacaatgacgaggatcatgcccactggaccgaagctaaaatgctcctggacaacattaatacaccggagggcatcatccccgcccttttcgaacctgagagagaaaagtccgcggccattgatggggagtaccggctgaaaggcgagagcagaaagacctttgtggaactcatgcgccggggagacctgcccgtctggctggctcataaagtggcctctgagggcatcaagtatacggatagaaagtggtgcttcgacggggaacgcaacaatcagattctcgaggaaaacatggatgttgagatctggacaaaagagggagaaaagaagaaacttcggcctagatggctggacgctcgcacctactccgatcccctggccctcaaagagtttaaagacttcgccgctggcagaaagagcattgcgctggatcttgtgaccgaaatcgggagagtcccgtctcacctggcccaccgcacaagaaatgctctcgacaacctggtgatgctgcatacctccgagcacggaggccgggcctatcgccatgccgtcgaggaactgcctgagacaatggaaacgcttctgctgctcggcctgatgatccttctgaccgggggagctatgctctttctgattagcggcaaaggggtgggaaagacatccatcggcctgatttgtgttgtggcctctagcgggatgctctggatggcggatatcccccttcagtggattgcctccgctatcgtgctggagttctttatgatggtcctgctcattcctgaacccgagaaacaaagaacccctcaggacaatcagctggcctacgttgtgatcggaatccttacactggctgccattgtggcggccaacgagatgggcctcctggaaaccacgaagcgggacctgggcatgagcaaagagcccggggtcgtgtcttccaccagctatctcgatgttgaccttcacccggcttctgcctggacactgtacgctgtggccaccacagtcatcacccctatgctgcgccacacgattgaaaatagcacagctaacgtgtccctcgccgcgatcgccaaccaagctgtcgtgctgatgggacttgataagggctggcccatttctaagatggacctgggggttcccctcctggccctgggatgctacagccaggtgaatcctctcacccttacagctgccgtcctgctgctcgtgacccattatgccatcatcggcccggggctgcaggcgaaagctaccagagaggcccagaagcggacagctgccggaattatgaaaaaccccacggttgatggcatcatgaccattgaccttgatcctgtgatctacgactccaagttcgaaaaacaactgggccaggtcatgctcctggtgctgtgtgccgtgcagctccttctgatgagaacatcttgggctttttgcgaggccctgaccctcgcgacagggcccattaccacgctgtgggagggaagccctggcaagttctggaatacaaccatcgccgtttccatggctaacatctttcgcgggagctatcttgccggagctggcctggccttctctattatgaagtccgtcgggaccggaaaacggggcacaggcagccagggggaaaccctcggagagaagtggaaaaagaaactgaatcaactgtccagaaaggaatttgatctctacaaaaagtctggcatcacagaggtggaccgcacggaagcgaaggaggggcttaaacggggagagattacccaccatgccgtgagcagaggctccgctaagctgcagtggttcgtcgaacggaacatggttatccccgaggggcgcgtgattgatctgggatgtggcagaggcgggtggtcttattactgcgccggactcaaaaaggtgacagaagtccggggctataccaaagggggacctggccacgaggaaccggtgcccatgagcacatacgggtggaatatcgttaagctgatgtccggaaaggacgtgttctaccttcctcccgagaaatgtgataccctgctctgcgacattggcgagagctctccttcccccacggtcgaagagagccgcaccatcagagtgctgaagatggttgaaccgtggctgaaaaacaatcagttttgtatcaaggtgctcaacccttatatgcccacagtcattgagcatcttgagcggctgcagcgcaaacacggcgggatgctggtgagaaatcccctctctcggaactccacccacgaaatgtactggatcagcaatggaacaggcaacattgtgtctagcgtcaatatggtttcccgcctgcttctgaacagattcaccatgacatatcggagacctaccatcgagaaggacgtggatctcggggctggaacgcgccatgtgaacgccgaacccgagacacctaatatggacgtcattggcgaacggatcagacgcatcaaggaggagcactctagcacctggcattacgatgacgaaaacccgtataaaacctgggcttaccacgggtcctatgaggtgaaggccacaggaagcgcgtcctctatgattaatggcgttgtgaaactgctgacgaagccctgggatgtcgtgcctaccgttacacaaatggccatgaccgacacaaccccctttggccagcagcgggtgttcaaagaaaaggtcgatacaagaacccctaagcccatgccggggacgcgcaaagtgatggagatcaccgctgaatggctctggcggacactgggaagaaacaagcgccctcggctttgcaccagagaggagtttaccaagaaggttcgcaccaatgccgctatgggcgccgtgttcacggaagagaaccaatgggacagcgcccgggcggctgtcgaagatgaggaattttggaaactggtggacagagagcgcgagctccacaagcaggggaaatgtggatcctgcgtctacaatatgatgggcaagagagaaaagaaactgggggagttcggcaaggccaaaggatctcgggccatttggtacatgtggcttggcgctcgctatctggaatttgaggccctcgggttcctgaacgaggatcattggtttagcagagaaaattcctactctggagtggagggcgaagggctgcacaagctcggatatatcctgcgggacattagcaaaatccccggcggggctatgtacgccgacgatacagcgggctgggacaccagaatcacagaggatgaccttcataacgaagagaagattacccagcagatggatcctgagcaccggcaactggccaatgctatcttcaagctcacgtatcagaacaaagttgtgaaggtccagcgccccacccctaaaggaacagtgatggacattatctccagaaaggatcagcggggcagcgggcaagtgggaacctacggcctgaatacatttaccaacatggaagcccagcttattcgccagatggagggggaaggagttctgtctaaaacagacctcgagaatccccatctgctggaaaagaagatcacccagtggctcgagacgaaaggcgtggagagactgaagcggatggctatctccggggatgactgcgtcgtgaaaccgattgatgaccgcttcgccaacgcgcttctggccctcaacgatatgggcaaggttagaaaagacatccctcaatggcagcccagcaagggatggcacgactggcaacaggtgcccttctgttctcaccattttcacgaactgattatgaaggatggccggaaacttgtcgtgccttgccgcccgcaagacgagctgatcgggagagctcggatttcccagggagccggctggagcctcaaggaaacagcttgtctggggaaagcctatgctcagatgtgggccctgatgtacttccatcgcagagatctccggctggcgtctaatgccatctgctccgctgtccccgtgcactgggttcctaccagccgcaccacatggtccattcacgcccatcaccaatggatgaccacagaggacatgcttacggtgtggaacagagtctggatcgaagataatccctggatggaggacaagacccctgtgacaacctgggaggatgttccctacctgggaaaacgggaagaccagtggtgtggcagcctcatcgggctgacatctagagccacctgggctcagaacattcttacggccatccagcaagtgcgcagcctgattggcaatgaggaatttctcgattatatgccttccatgaagcggttcagaaaggaggaggaatctgagggagcgatctggtga

SEQ ID NO: 20923 - RNA, 9873 nt, synthetic construct
  misc_feature 1..9873: note = derived and/or modified CDS sequence (opt5) from DENV-3__KC261634__SS-prME
  source 1..9873: mol_type = other RNA
accagcatctgcctgatgatgatgctccccgctacactggctttccaccttacgtcccgggacggcgagcctcggatgattgtggggaagaacgaacgcggaaagtctctgctctttaagaccgccagcggcatcaatatgtgtacactgattgcgatggatcttggggagatgtgcgacgataccgtgacatacaagtgtccgctgatcgctgaagttgagcccgaagacattgattgctggtgtaacctcacctccacatgggtgacctatggaacgtgcaatcaggccggcgagcacagacgggacaagcgctctgtggccctggctcctcacgtcgggatgggactggataccagaacacagacctggatgagcgccgagggcgcttggagacaggtggaaaaagttgagacatgggccctccgccatcccggcttcaccatcctggcgctttttctggcccactacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcatggcgggtgcgttaccacaatggccaagaatcgccccacgctggacattgagctccagaaaaccgaagctacacagctggccacccttagaaagctgtgtatcgagggaaaaattacaaacatcaccacggattcccggtgccctacacagggcgaagcggtgctcccggaggaacaggaccagaattatgtgtgtaagcacacctacgtcgatcgcggctgggggaacggatgcggcctgttcgggaaaggaagccttgtgacctgcgccaagtttcaatgtctggagcccattgagggcaaggttgtgcagtatgaaaatctcaaatacacagtcatcatcaccgtgcacacaggggaccagcatcaggttggaaacgacacgcaaggcgtgaccgtcgagattacacctcaggcttctaccgtggaagccgtcctgcccgagtatggcacactggggctcgaatgctcccctagaaccggactggatttcaatgagatgatccttctgacgatgaagaacaaggcttggatggtgcaccggcagtggtttttcgacctccccctgccgtggaccagcggcgccacaaccgagacacctacctggaatcgcaaggaacttctggttacgtttaaaaacgcccatgctaagaaacaagaggtggtcgtgctcgggtctcaggaaggagcgatgcacacagccctgaccggcgctacagagattcaaaattccgggggcaccagcatcttcgccggacacctgaagtgtagactcaagatggataaactggaacttaagggcatgtcttacgccatgtgcctgaacacctttgttctcaaaaaggaggtgtccgagacacagcatgggacgattctgatccgggtcgaatacaaaggagaggacgctccctgtaagatccctttcagcaccgaagatggccaagggaaggcccacaacggaagactgattacagcgaatcccgtggtgaccaaaaaggaggagcccgttaacatcgaagctgagcctccgttcggcgaatccaatattgtcatcgggacaggcgacaaagcccttaagattaactggtataaaaagggatctagcatcggcaagatgtttgaggccaccgctcgcggggcccggagaatggctatcctcggagatacggcctgggacttcggctccgtcggcggggtgctgaatagcctggggaaaatggcgcatcagatttttgggtctgcctacacagctctcttctccggcgtcagctggatcatgaagattggaatcggcgtgctgcttacctggattgggctgaactctaaaaataccagcatgtccttttcttgcatcgttattggaatcatcacactctatctgggcgccgtggtccaggctgatatggggtgtgtgattaactggaagggaaaagaactgaagtgcggcagcgggatcttcgttaccaatgaggtgcacacatggacggagcagtacaagtttcaagccgactcccccaaacgccttgcgaccgccattgctggcgcctgggaaaacggagtctgtggcatccggagcacaaccagaatggagaatctcctgtggaagcagattgctaacgaactgaattatatcctctgggagaacaatatcaaactgacagtggttgtgggggatattatcggagtccttgaacagggcaagcgcaccctgacgcctcagcccatggagctcaaatactcttggaagacctgggggaaagccaagattgtgacagccgagatccaaaactccagcttcattatcgacggacctaacacccccgaatgcccgtctgcttcccgggcgtggaatgtgtgggaggtcgaagactatggctttggcgttttcacaaccaacatctggctgaagctgagagaggtgtacacacagagctgtgatcatcgccttatgtccgccgctattaaagacgaacgggccgtgcacgccgatatggggtactggatcgagtctcagaagaatggaagctggaaactcgagaaggcttcctttattgaagtcaaaacctgcacgtggcctaagtctcacacactgtggagcaacggcgtgctggagtccgacatgatcattcccaagagcctcgccgggcctatctctcagcataatcacagacccggatatcatacccaaaccgcgggcccttggcacctggggaaacttgaactggatttcaactactgcgagggaacaaccgttgtgatcacggagaattgtggcacacgcggcccctccctccggaccacaaccgtcagcgggaagctgattcacgaatggtgctgtagatcttgcacactgccgcctcttcggtatatgggagaggacggctgttggtacgggatggaaatccgccccattaacgagaaagaagagaatatggtgaagtccctcgttagcgctggatctggcaaagtggataactttaccatgggggtcctgtgcctggccatcctcttcgaggaagtgatgagaggaaagttcggcaagaaacatatgattgttggcgtgctgtttacgttcgtccttctgctcagcgggcagatcacctggcgggacatgacacacaccctgattatgatcggatccaatgccagcgatagaatgggcatgggggtgacatatctggctcttatcgccacctttaagattcagcccttcctggcgctcggatttttcctgcgcaaactcacgtctcgggagaacctgcttctgggcgtggggctcgctatggccacaaccctgcaactgcctgaagacatcgagcagatggccaatggaattgctcttggcctgatgacactcaagctgatcacccagtttgaaacctaccagctctggacagccctggtctcccttacgtgtagcaacaccattttcacactgaccgttgcttggagaacagccaccctcatcctggcgggcgtgtccctgcttccgctgtgccaatctagctccatgcgcaaaacggattggctccccatgacagtggccgctatgggggtccctcccctgcctctctttatcttctctctgaaggacgcccccaagaaaagaagctggcctcttaatgagggagtgatggctgttggcctggtgtccattctggcctctagcctcctgcggaacgatgtccccatggccgggccgcttgtggctggaggcctgctcatcgcgtgttatgttattaccgggacctccgccgacctgacagtggagaaggctgccgacgtcacctgggaagaggaagccgagcagacaggagtgagccataacctcatgatcacggtcgatgacgatggcaccatgcgcattaaagacgatgaaacagagaatatcctgaccgtgcttctgaagacagctctgctcatcgtttctggcatttttccttactccatccccgccaccctgcttgtgtggcacacgtggcagaaacagacccaaagaagcggggtcctgtgggacgtgccttctcccccggagacacagaaggcggaactcgaggaaggagtttaccggattaaacagcagggcatcttcgggaagacccaagtgggagtcggcgtgcagaaggagggggtgtttcatacaatgtggcacgttacccgcggagctgtcctgacacacaacggcaaaagactcgagcctaattgggcctccgtgaagaaagatctgattagctatggcgggggatggcggctttctgcccagtggcaaaagggcgaagaggtgcaggtcatcgctgtggaacccgggaaaaaccctaagaatttccagacgatgcccggaattttccagaccacaaccggcgagatcggggccatcgcgctggactttaagcccggaacctccggcagccctattatcaaccgcgaaggcaaagttgtggggctgtacggaaatggcgtcgtgacaaagaacgggggatatgtttccggcattgctcaaacgaatgccgagccggatgggcccacccctgagctcgaagaggaaatgttcaaaaagagaaacctgacaatcatggaccttcatcccggcagcggaaaaacccggaagtacctgcctgccattgtgcgcgaggctatcaagagacggctcagaacactgatcctcgcccccacccgcgtcgtggctgccgaaatggaggaggcgctgaaaggccttcctattcggtatcagacgacagccaccaagtctgaacacaccgggagagagatcgttgatctgatgtgccatgctacatttaccatgcgcctgctcagcccggtgcgggtccccaattacaacctgattatcatggacgaagcccacttcacagatcctgcttccattgccgccagaggatatatctctacccgcgtgggcatgggggaggctgcggccatctttatgacggctacaccccctggaaccgccgaagccttcccccagagcaatgctccgattcaggacgaggagcgggacatccctgaaagatcctggaactctggcaatgagtggattacagattttgtggggaaaaccgtctggttcgttcccagcatcaaggccggcaacgacattgcgaactgtcttcgcaaaaatggaaagaaggtgatccaactgtcccggaaaacgtttgataccgaataccagaagacaagactcaacgactgggatttcgtggtcaccacagacatttctgagatgggcgctaattttaaagccgatcgggtgatcgacccccgcagatgcctgaagcctgttatcctgaccgatgggcccgagcgggtgattctcgccggacctatgccggtcacagctgccagcgcggcccagcgcagaggccgggtggggagaaacccccagaaagaaaatgaccaatacatcttcaccggacagcctcttaacaatgatgaggaccatgctcactggacggaagccaagatgctgctggacaacattaatacacccgagggcatcattcctgctctcttcgaacccgagcgcgagaagtccgccgctatcgatggggaatatcggctgaaaggcgagagcagaaagacctttgttgaacttatgcgccggggagacctgccggtgtggctcgcccacaaagtcgcgtctgagggcatcaagtacaccgatagaaaatggtgcttcgacggggaacgcaacaatcagattctggaggagaacatggatgtggaaatctggacaaaggagggagaacggaaaaagctgagacctcgctggctcgacgccagaacctattccgatccccttgctctgaaggagtttaaagacttcgccgctggccggaaaagcattgccctggatctcgtcacagaaatcgggcgcgtgccttctcatctggcccacagaacgcggaatgctcttgacaacctggttatgctccatacctccgagcacggaggccgcgcgtacagacacgccgtggaggaactgcccgagacaatggaaaccctgctccttctgggcctgatgattctcctgacagggggagctatgctttttctgatcagcggcaaagggatcggaaagacctccattggcctcatctgtgtgattgtctctagcgggatgctgtggatggccgatgttcctctgcagtggatcgcctccgctattgtgctcgagttctttatgatggtgcttctgatccccgagccggaaaaacaacggacgcctcaggacaatcagctggcctatgtcgtgattggaatcctcaccctggcggccatcgttgctgccaacgagatgggccttctggaaacaaccaagagagatctcggcatgagcaaggagcccggggctgtgtcttccacaagctacctggacgtcgacctgcatcccgcctctgcgtggaccctctatgccgtggctacgacagtcattacccctatgcttcgccacacaatcgaaaatagcaccgccaacgtgtccctggctgccattgctaaccaagccgttgtgctgatgggactcgataaaggctggccgatctctaagatggacctgggggtcccccttctggcgctcggatgctacagccaggtgaatcctctgaccctgacagccgctgttctccttctggtgacgcattacgccattatcggccccgggctgcaggctaaagccacccgggaggcccagaagagaacagcggctggaatcatgaaaaaccctaccgtcgatggcattatgacaatcgacctcgatcccgtgatttatgactccaagttcgagaagcaactgggccaggtgatgcttctggttctctgtgccgtccagctgctgctcatgcgcacctcttgggctctttgcgaagccctgacgctggccacagggcctatcaccaccctctgggagggaagcccgggcaaattttggaatacaaccattgctgtgtccatggccaacatcttccgggggagctacctggcgggagccggccttgctttttctatcatgaagtccgtggggacaggaagacggggcacgggcagccagggggaaaccctgggagagaaatggaagaaacgcctcaatcaactgtccagaaaggagttcgatctgtataagaaatctggcattacagaggtcgaccggaccgaggccaaggaagggctcaaacgcggagagacaacccaccatgctgttagcagaggctccgccaaacttcagtggtttgtggaacggaacatggtgatccccgaggggcgcgtcattgatctgggatgtggcagaggcgggtggtcttactattgcgcgggactgaaaaaggtgacggaagttcggggctacaccaaagggggacctggccacgaggagcccgtgcctatgagcacatatgggtggaatatcgtcaagctcatgtccggaaaggacgtgttctacctgcccccggaaaaatgtgatacccttctgtgcgacattggcgagagctctccttcccccacagttgaagagagccgcaccatcagagtgctcaagatggtcgagccctggctgaaaaacaatcagttctgtattaaggtgctgaacccttacatgcccacagtgatcgaacacctcgagcggcttcagagaaaatatggcgggatgctggtccgcaatcctctgtctcggaactccacccatgaaatgtactggatcagcaatggaacgggcaacattgtttctagcgtgaatatggtgtccagactcctgcttaaccgctttacaatgacccaccggagaccgaccatggagaaggatgtcgacctgggggccggaacacgccatgtgaacgctgaacccgagacgcctaatatggacgttatcggcgagcggattaagagaatcaaagaagaacactctagcacctggcactatgatgacgaaaacccctacaagacatgggcctatcatgggtcctacgaggtgaaagctaccggaagcgcctcctctatgattaatggcgtcgtgaagctcctgacaaaaccttgggatgttgtgcccatggtcacccaaatggctatgacagacaccacgccgttcggccagcagcgcgtgtttaaggaaaaggttgatacccggacacctagacccatgcctgggacccgcaaagtgatggagatcacagccgagtggctgtggcggaccctcggaagaaacaagaaaccccgcctgtgcacgagagaagagttcacaaagaaagtccggaccaatgcggccatgggcgctgtgtttacagaagagaaccaatgggacagcgcccgcgctgccgtcgaagatgaggagttctggaaacttgtggacagagaacgggagctgcacagactcgggaagtgtggatcctgcgtttataatatgatgggcaaacgggaaaagaaactgggggagtttggcaaggccaaaggatctcgcgcgatctggtacatgtggcttggcgctagatacctggagttcgaagccctcgggtttctgaacgaggatcattggttcagccgggaaaattcctattctggagtggagggcgaagggctgcacaagctcggatacattctgcgcgacatcagcaaaattcctggcggggccatgtatgctgatgacaccgccggctgggacacgagaatcaccgaggatgaccttcataacgaggaaaagattacacagcagatggatcccgagcaccggcgcctggcttccgccatctttaagctcacctaccagaataaagtcgtgaaggtgcaaagaccgacacctaaaggaaccgttatggacatcattagccggaaggatcagcgcggctctggacaggtgggaacatatggcctgaacaccttcacgaatatggaagcgcagcttgtcagacaaatggagggggaaggagtgctgtccaaagccgacctcgaggatccccatctgctggagaagaagatcacacagtggctcgaaaccaaaggcgttgagcggctgaagcgcatggctattagcggggacgattgcgtggtcaaacccatcgacgatagatttgccaacgcccttctggccctcaatgacatgggcaaggtgcggaaagatattcctcagtggcagccgtctaagggatggcatgactggcaacaggtccccttctgttcccaccatttccacgaactgatcatgaaggacggccgcaaacttgtggttccttgcagaccccaggatgagctgatcgggcgggcgagaattagccagggagccggctggtctctcaaggaaaccgcttgtctggggaaagcctacgctcaaatgtggtccctgatgtattttcaccgccgggacctcagactggccagcaacgctatctgctccgccgtgcctgtccattgggtgcccacaagccgcaccacatggtctattcacgcgcatcaccagtggatgacgaccgaggatatgcttacagtttggaaccgggtgtggatcgaggacaatccttggatggaagataagacccccgtcacaacctgggaggacgtgccgtacctgggaaaaagagaagatcagtggtgtggcagcctcattgggctgacgtcccgcgccacctgggctcaaaacatccttacagccattcaacaggtgcggtctctgatcggcgacgaggagttcctcgattacatgcctagcatgaagagatttcgcaaggaagaggaatccgagggagccatctggtga

SEQ ID NO: 20924 - RNA, 9873 nt, synthetic construct
  misc_feature 1..9873: note = derived and/or modified CDS sequence (opt5) from DENV-3__JN662391__SS-prME
  source 1..9873: mol_type = other RNA
accagcctgtgcctcatgatgatcctgcccgccgctcttgccttccacctgacatccagagacggcgagcctcggatgattgtggggaagaacgaacgcggaaaatctctcctgtttaagacggcgagcggcatcaatatgtgtacccttattgctatggatctgggggagatgtgcgacgatacagtcacctacaaatgtccgcatatcacagaagttgagcccgaagacattgattgctggtgtaacctcacctccacatgggtgacctatggaacgtgcaatcaggccggcgagcacagacgggacaagcgctctgtggccctggctcctcatgtcgggatgggactggataccagaacacaaacctggatgagcgccgagggcgcttggcggcaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccagaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggagtacaagggagaagatgccccctgtaaaattcctttcagcaccgaggacgagcaaggcaaggcgcataacgggagactgatcacagctaatcccgttgtgaccaaaaaggaagagcccgtcaacattgaagccgagcctccgttcggagaatccaatatcgtgattggcatcggggataacgccctgaaaatcaattggtataagaagggctctagcattggaaaaatgtttgaggctacggcccggggcgctagacgcatggccatccttggggacacagcgtgggatttcggatccgtgggcggggttctcaacagcctgggaaagatggtccaccagatttttggctctgcctacaccgctctgttctccggggtgagctgggtgatgaaaatcggcattggagtcctcctgacctggatcggccttaattctaagaacacaagcatgtccttttcttgcattgccatcgggatcattaccctgtatctcggagctgtggttcaggccgacatgggctgtgtgatcaattggaaagggaaggagctgaagtgcggaagcggcattttcgtcacaaacgaagtgcatacgtggaccgagcagtacaaatttcaagcggattcccccaagcggctggccacagctatcgccggggcttgggaaaatggcgtttgtggaattagaagcaccacacgcatggagaaccttctctggaaacagatcgccaatgaactgaactatatcctgtgggagaataacattaagctcaccgtggtcgtgggcgacacgatcggggttctggagcagggaaaacggacccttacacctcagcccatggaactgaagtactcttggaaaacctggggcaaggccaagattgtgacagctgagacccaaaactccagcttcatcattgatgggcctaatacacccgaatgcccgtctgcgtccagagcctggaacgtctgggaggtggaagactatggatttggcgtgttcaccacgaatatctggctcaaactgcgcgaggtctacacacagatgtgtgaccaccggctgatgagcgctgccgttaaggatgagagagccgtgcacgctgacatgggctactggatcgaatcccagaaaaacgggtcttggaagcttgagaaagccagcctcattgaagtgaagacctgcacctggcctaagtcccatacactgtggtctaatggagtcctggagagcgatatgatcattcccaaatccctcgcgggccctatcagccagcacaactatcgccccgggtaccatacccaaacggctggaccttggcacctgggcaagcttgagctggactttaattattgcgaagggacaaccgtggttattacagagaactgtggaacccggggcccctctctcagaacaaccacggtgtccggcaaactgatccacgaatggtgctgtcgcagctgcaccctgccgcctcttcggtacatgggggaggatggatgttggtatggcatggaaatcagacccatttctgagaaggaggaaaatatggtcaaatccctcgtgagcgccgggtctggaaaggttgacaacttcacaatgggcgtgctgtgcctggccatcctctttgaggaagtcatgcgggggaagttcggaaaaaagcatatgattgctggcgtgttcctgacctttatgcttctgctcagcggccagatcacatggcgcgatatggcccacaccctgattatgatcgggtccaatgcgagcgacagaatgggaatgggcgttacgtacctggctcttattgccacattcaaaatccagccctttctggccctcgggttctttctgcggaagctcacctctagagagaacctgcttctgggagtgggcctcgctatggccacaaccatccaactgcctgaagatattgagcagatggctaatgggatcgccctgggacttatggcgctgaaactcattacccagttcgagacatatcagctgtggacggccctcatctccctgacctgtagcaacacaatttttacccttacagtcgcttggcgcaccgccacgctgatcctcgctggcgtgtccctgctgccggtgtgccaatctagctccatgcggaagacagactggcttcccatgaccgtcgccgccatgggcgttcctcccctgcctctcttcatcttttctctgaaggataccctcaaaagacgcagctggcccctgaatgaaggggtgatggctgtgggacttgtctccattctggcgtctagcctgctcagaaacgacgtgcctatggccggccccctggttgctgggggacttctgatcgcctgttacgtgattacaggcacctccgccgatctcacagtcgagaaggctgccgacgtgacgtgggaagaggaagcggagcagaccggggttagccataacctgatgatcacagtggacgatgacggaaccatgcggattaaagatgacgagacagaaaatatcctcaccgtcctgcttaagacggctctgctgatcgtgtctggcattttcccgtactccatccctgccaccctcctggtctggcacacatggcagaaacagacccaacgcagcggcgtgctttgggatgttccctctcctcccgagacacagaaggccgaactggaggagggggtgtatagaattaaacagcagggaatcctcggcaagacccaagtcggggtgggagttcagaaggaaggcgtgtttcatacaatgtggcacgtcacgcggggggctgtgctgacccacaacggaaaacgcctcgagccgaattgggcctccgtgaagaaagacctgattagctacggcggcgggtggagactttctgcgcagtggcaaaagggagaagaggttcaggtcatcgctgtggaacctggcaaaaaccccaagaatttccagacaatgcctgggacctttcagaccacaacgggagagattggcgccatcgccctggatttcaagcccgggacctccggaagccccatcattaaccgggagggcaaagtggtcggcctgtatgggaatggagtggttacaaagaacggcgggtacgtgtccggaatcgctcaaaccaatgccgaacctgacggcccgacacccgagctcgaagaggaaatgttcaaaaagcgcaacctgaccattatggatcttcatcctgggagcggcaaaacgagaaagtatctgcccgctatcgtccgggaggccattaagcgcagactccggacactgatcctcgcgcctaccagagtggttgccgctgagatggaagaggccctgaaaggacttcccatccgctaccagaccacagctaccaagtctgaacacacaggccgggagattgtggacctgatgtgccatgccacctttacgatgagactgctcagccctgtccgcgtgccgaattataacctgatcattatggatgaagcccacttcacagaccccgcttccatcgcggcccgggggtacatttctaccagagttggaatgggcgaggctgccgccatctttatgacagctacccctcccgggacggccgatgcgttccctcagagcaatgctcccatccaggacgaggaacgcgacattccggagcggtcctggaactctggaaatgaatggatcaccgattttgccggcaaaacagtgtggttcgtccctagcattaaggccgggaacgacatcgctaactgtcttagaaaaaatggcaagaaggtgattcaactgtcccgcaaaacctttgatacagagtaccagaagaccaaactcaacgactgggatttcgtggtcacaaccgacatctctgagatgggagccaattttaaggcggatcgggttattgaccccagacggtgcctgaaacccgtgatcctgacggatggccctgaacgcgtgatcctcgccgggcccatgcctgtcacagtggctagcgccgctcagagacggggacgcgttggcagaaacccgcagaaggagaatgaccaatatattttcaccgggcagccccttaacaatgatgaagaccatgcccactggaccgaggctaagatgctgctggacaacatcaatacacctgaaggaattatccccgccctctttgagcctgagcgggaaaaatccgcggccattgatggcgagtacagactgaagggggaaagccgcaaaaccttcgtggagcttatgcggagaggcgacctgcccgtctggctcgctcacaaggtggcctctgaaggaatcaaatatacagatcgcaagtggtgcttcgacggccagcggaacaatcagatcctggaggagaacatggatgttgaaatttggacgaaagagggggaaaagaagaaactgagaccgcgctggctcgacgctcggacctactccgatcctcttgccctgaaggagtttaaagacttcgccgctggaagaaagagcatcgcgctggatctcgtgacagaaattggccgcgtcccctctcatctggcccacagaacccggaatgctcttgacaacctggtgatgctccatacatccgagcacgggggacgcgcctatagacacgccgtcgaggaactgcctgagaccatggaaacgctgctccttctgggcctgatgatcctcctgaccggcggggctatgctttttctgattagcggaaaaggcatcgggaagacatccatcggactcatttgtgtgatcgcctctagcggcatgctgtggatggcggagattcccctgcaatggatcgcctccgctattgttctcgagttctttatgatggtgcttctgatccctgaacccgagaagcagcggaccccgcaggataatcaactggcctacgtggtcattgggatcctcacactggctgccatcattgcggccaacgaaatgggacttctggagaccacgaaacgcgacctcggcatgagcaaggaacctggcgttgtgtctcccacatcctatctggatgtggacctgcatcccgctagcgcctggaccctctacgctgtcgccacaaccgtgatcacccctatgcttagacacacaattgagaattctacggctaacgttagcctggccgcgatcgccaaccaggctgtggtcctgatggggctcgacaaaggatggccgatttccaagatggatctgggcgtgccccttctggccctcgggtgctactctcaggtcaatcctctgaccctgacagctgccgtgctccttctggttacccattatgccatcatcggacccggcctgcaggcgaaagctacacgggaggcccaaaagagaaccgctgccgggattatgaagaaccctacggtggacggaatcattacaatcgatctcgaccccgtcatttacgatagcaaattcgaaaagcagctgggccaggtgatgcttctggttctctgtgccgtgcagctgctgctcatgcgcacctcctgggctctttgcgaggccctgaccctggcgacaggccctatcaccacactctgggaagggtctccgggaaaattttggaatacgaccatcgccgtcagcatggctaacattttccggggctcctatctggccggggctggacttgcctttagcatcatgaagtctgtgggcacagggaaaagaggaaccggctcccaaggcgagacactgggggaaaagtggaagaaaaagctcaatcagctgagccgcaaagagttcgacctgtacaagaaatccggaattaccgaggtggatcggacggaagcgaaggagggcctcaaaagaggggaaaccacacaccatgccgtttctcggggaagcgctaagcttcagtggtttgtcgagcgcaacatggtgatccccgaaggcagagtgattgacctggggtgtggacggggcggctggtcctattactgcgccgggctgaagaaagtcaccgaggttcgcggatatacaaagggcgggcctggacacgaggaacccgtgcctatgtctacccacggctggaatatcgtgaaactcatgagcgggaaggatgtcttctacctgcccccggagaaatgtgacacacttctgtgcgatattggagaatccagcccttctcccaccgtggaggagtccagaacgatccgggttctcaagatggtggaaccctggctgaagaacaatcagttttgtatcaaagtcctgaacccttacatgcccgctgtgattgagcatctcgaacgccttcaaagaaagcacggcggcatgctggttcggaatcctctgagccgcaactctacacatgagatgtattggatctccaatgggaccggaaacattgtgagctctgtcaatatggtgagcagactcctgcttaaccggttcaccatgacacacagacgcccgacgatcgaaaaagacgtggatctgggcgccgggacccggcacgtcaacgctgagcccgagacacctaatatggacgttattggagaaagaatccgccggatcaaggaggaacataactccacctggcactacgacgatgagaatccctataaaacatgggcctaccatggctcttatgaagtgaaggcgaccgggagcgcctccagcatgattaacggagtggtcaagctcctgacaaaaccttgggacgtggttcccatggtgacccagatggctatgacggataccacaccgttcggccagcaaagagtctttaaggagaaagtggacacccgcacacctcggcccatgcctggcaccagaaaggttatggagatcacggccgaatggctgtggcgcacactcgggcggaataaaagaccccgcctgtgcacccgggaggaattcacaaagaaggtgagaaccaacgctgccatgggagccgtctttacggaggaaaatcagtgggattccgcgaaagctgccgtggaggacgaggaattctggaagcttgttgatcgcgagagagaactgcacaaactcggcaagtgtgggtcttgcgtgtacaacatgatgggaaaacgggagaagaaactgggcgagtttgggaaggccaagggcagccgcgctatttggtatatgtggcttggagccagatacctggaattcgaggctctcggctttctgaatgaagaccattggttctcccgggagaactcttacagcggggtcgaaggagagggcctgcacaaactcgggtatatcctgagagatatttccaagatccctggaggcgccatgtacgcggacgataccgccgggtgggacacacggatcaccgaggacgatcttcacaatgaagagaaaattacacagcagatgaaccccgaacatcgcctgctcgctaatgccatctttaagctgacctatcaaaacaaagtggtcaaggtgcagagaccgacacctaccggcacggttatggacattatctctcggaaggatcagcgcggaagcggccaggtggggacatacggacttaataccttcaccaacatggaggctcaactggtcagacagatggaaggcgagggggtgctctccaaagccgacctggagaacccccacctgcccgaaaagaaaattacacagtggctcgagaccaagggagtggaacggctgaaacgcatggcgatcagcggcgatgactgcgttgtgaagcctatcgatgacagatttgccaatgctcttctggccctcaacgatatggggaaggtccggaaagacattccgcagtggcaaccctctaagggctggcatgattggcagcaggtgcctttctgttcccaccactttcatgagctgatcatgaaagacggacgcaagcttgttgtgccctgcagacctcaggatgaactgattggccgggctcgcatcagccaaggggccggatggtctctcagagagacagcttgtctgggcaaagcctatgcgcagatgtggtccctgatgtacttccaccggcgcgacctcagactggccagcaatgctatttgctctgccgtccccgtgcattgggtccctacgtcccggaccacatggagcatccacgcccatcaccagtggatgaccacagaggacatgcttaccgtgtggaacagagtttggattgaagataatccctggatggaggacaagacgccggtgaccacatgggaaaacgtcccttatctggggaagcgcgaggatcaatggtgtggatccctcatcggcctgaccagccgggctacatgggcccagaatatctctaccgcgattcagcaggtgagaagccttatcgggaacgaggaattcctggactacatgccctccatgaaacgctttcggaaggaggaagagtctgaaggcgctatttggtga

SEQ ID NO: 20925 - RNA, 9873 nt, synthetic construct
  misc_feature 1..9873: note = derived and/or modified CDS sequence (opt5) from DENV-3__AY858043__SS-prME
  source 1..9873: mol_type = other RNA
accagcctgtgcctcatgatgatgctgcccgccacccttgctttccacctgacgtcccgggacggcgaacctcggatgatcgtggggaagaacgaacgcggaaagtctctcctgtttaagaccgccagcggcattaatatgtgtacccttatcgcgatggatctgggggagatgtgcgacgataccgtgacatacaagtgtccgctcattaccgaagttgagcccgaagacatcgattgctggtgtaacctgacatccacctgggtgacgtatggaacctgcaatcaggctggcgagcatagacgggacaagcgctctgtggccctggcccctcacgtcgggatgggactcgatacaagagctcaaacctggatgagcgccgagggcgcttggcggcaggccgaaaaggtggagacatgggcgctgcgccatcccggcttcaccattcttgccctgtttctcgctcactacatcgggacgtccctgacacagaaggttgtgatcttcattcttctgatgctcgtcaccccttctatgacaatgagatgtgtgggagttggcaaccgggactttgtggaagggctgagcggagccacctgggtcgatgtggtgctggagcatggcgggtgcgtcaccacaatggctaagaataagcccacgctcgacatcgagctgcagaagaccgaagccacacaacttgcgaccctgcgcaaactctgtattgagggaaagatcacaaacgttaccacggattccagatgccctacacagggcgaagccattctgccggaggaacaggaccagaattatgtgtgtcggcacacctacgtggatcgcggctgggggaacggatgcggccttttcgggaaaggaagcctggtgacatgcgctaagtttcaatgtctcgagctgatcgagggcaaggtggttcagcacgaaaatctgaaatatacagtgattatcaccgtccatacaggggaccagcaccaggtgggaaacgagacgcaaggcgttaccgccgaaatcacaccccaggcttctaccgtggaggccattctccctgaatacggcacactggggcttgagtgctcccccagaaccggactggacttcaatgagatgatcctcctgacgatgaagaacaaagcctggatggtccatcggcagtggtttttcgatcttcctctgccctggaccagcggcgctacaaccgaaacaccgacctggaataagaaagagctcctggtgacgtttaagaacgcgcacgccaaaaagcaagaagtcgtggttctggggtctcaggagggagctatgcacacagccctcaccggcgccacagaaattcagacctccgggggcaccagcatcttcgctggacatctgaagtgtcgccttaaaatggacaagctggagctcaaaggcatgtcttatgccatgtgctccaatgcgtttgtgctgaagaaagaggtcagcgaaacacagcacgggacgattctgatcaaggtggagtacaagggagaagatgctccttgtaaaatccccttctccaccgaggacggccaagggaaggttcataacggaagacttattacagccaaccctgtggtcaccaaaaaggaggaacccgtgaatatcgaggccgaaccccctttcggcgagtctaacattatcattgggatcggcgataaagctctcaagatcaattggtacaagaaaggaagctccattggcaagatgtttgaagccacagctagaggggctagacgcatggcgatcctgggagacaccgcctgggatttcggcagcgtcgggggagttctgaactctctcggcaaaatggtccaccagatttttgggtccgcttatacggccctgttcagcggcgtgtcttggatcatgaagattggaatcggcgtgcttctgacatggattgggctcaatagcaaaaacacctccatgtcttttagctgcatcgtcatcggaattatcaccctgtacctgggcgctgtggttcaggccgacatggggtgtgtgattaattggaagggaaaggagcttaaatgcggctccgggatcttcgtcacaaacgaggtgcatacctggacagaacagtataagtttcaagcggatagcccgaaacggctcgccacggctattgccggcgcttgggagaatggagtttgtggcatcagatctaccacacgcatggaaaacctgctgtggaagcagatcgccaatgagctcaactacattctgtgggaaaataacatcaaacttaccgtggtcgtgggggacattatcggagttctggagcagggcaagcggacactcacaccccagcctatggagctgaaatattcctggaagacgtgggggaaggccaaagtggtcaccgctgaaattcaaaatagctctttcatcatcgatggacccaacacacctgagtgccccaacgcgtccagagcctggaatgtgtgggaagtggaggactacggctttggcgtcttcaccacaaacatttggctgaaacttcgcgaaatgtatacccagctctgtgaccaccggctgatgagcgctgccgttaaagatgagagagccgtgcacgctgacatggggtactggatcgagtcccagaagaatggatcttggaaactggaaaaggccagcctcattgaggtgaagacatgcacctggccgaaatcccatacgctgtggtctaacggcgtccttgaaagcgatatgatcattcctaagtccctggcggggcccatcagccagcacaattaccgccctggatatcatacacaaaccgctggcccctggcacctcgggaaactggagctggactttaactactgcgagggaaccacagtggttatcaccgaaaattgtggcacgcggggcccttctcttagaacaaccacagtgtccgggaagctcattcacgagtggtgctgtcgcagctgcaccctgcccccgctgcggtatatgggagaagatggctgttggtacgggatggagatcagacctattaacgaaaaagaggagaatatggtcaagtctctcgtgtccgccggaagcggcaaggttgacaacttcacaatgggggtgctgtgccttgccatcctgtttgaagaggtcatgcggggaaaattcggcaagaaacatatgattgctggcgtcctcttcatgtttgttctgctgctttctgggcagatcacctggcgcgatatggccagaacgctgattatgatcggaagcaatgcgtccgaccggatgggcatgggggtgacctatctcgctctgatcgccacattcaagattcagccctttctcgccctgggattctttcttagaaaactgaccagccgcgaaaacctcctgctgggcgtcgggcttgctatggccacaaccctgcaactccccgaggatatcgaacagatggctaatggaattgccctgggcctcatggcgctgaaacttatcacgcagttcgagacataccagctgtggaccgccctcgtgtctctgacatgttccaacaccatttttaccctgacagtggcttggcggacggccacccttatcctggctggcatcagcctcctgcctgtctgccaatcctctagcatgagaaagacagactggctcccgatgaccgttgccgccatgggggtgccccctctgccccttttcatttttagcctgaaagatacactgaagcgcagatcttggcctctcaatgagggagtgatggctgtcggcctggtgagcatccttgcgtcctctctgctccggaacgacgttcccatggccgggcctctggtggctggaggcctcctgattgcctgttatgtcatcaccgggacgagcgccgatcttacagtggaaaaagctgccgacgttacctgggaggaagaggcggaacagaccggagtgtcccacaacctgatgattacagtcgacgatgacggcaccatgcgcatcaaggatgacgagacagagaatatcctgacggtgctcctgaaaaccgcccttctgattgtcagcggcatcttcccctactctattccggccacactcctggtgtggcatacctggcagaagcagacacaaagatccggggttctctgggatgtgccttctccccctgaaacccagaaagccgagctggaagagggagtctaccggatcaagcagcagggcatttttgggaagacgcaagtgggagttggcgtgcagaaagagggggtcttccacaccatgtggcatgtgacacgcggagctgtgcttacctataacggcaagagactggaacccaattgggcctccgttaaaaaggacctgatctcctacggcgggggatggcggctcagcgcgcagtggcgcaaaggcgaggaagtccaagtgattgctgtggagccggggaagaaccctaagaattttcagacaatgcccggaatcttccagaccacaacgggcgaaatcggggccattgccctggatttcaaacctggaacctctggctcccccatcattaacagagagggcaaggtcgtggggctttatggaaatggcgttgtgaccaagaacgggggatacgtcagcggcatcgctcagaccaatgccgagcccgacgggcctaccccggaactggaggaagagatgtttaagaaacggaacctcacaattatggatctgcaccccggctccggaaagacgcgcaagtatctccctgctatcgtgagagaagccatcaaacggagactgcgcacccttattctggcgcccacacgggttgtggccgctgagatggaggaagccctgaagggcctccctatcagataccaaaccacagctaccaaaagcgagcacacggggaaggaaattgtcgacctgatgtgccatgccacattcaccatgcgccttctgtctcccgtgcgggttcctaattataacctcatcattatggatgaggcccactttaccgacccggctagcatcgcggccagaggatacatctccacacgcgtgggcatgggggaagctgccgccattttcatgaccgctacaccccctggaaccgccgatgcgtttccccagtctaatgctcctatccaggacgaggagcgggacattcccgaaagaagctggaactccggcaatgattggatcacggacttcgccgggaaaacagtctggtttgtgccgtctattaaggccggcaacgatatcgctaactgtctgcgcaagaatggcaaaaaggtgattcagctgagccggaaaaccttcgacacagagtaccaaaagaccaaactcaacgattgggactttgtcgttacgaccgatatctccgaaatgggagccaatttcaaggcggacagagtgatcgatcctcggcgctgccttaagcccgtgattctgacagacgggcccgagagagtcatcctggccggacctatgcccgtgaccgttgcttctgccgctcagcggcgcggcagagtggggcggaaccctcagaaagagaatgatcagtatatttttacaggacaaccgctcaacaatgacgaagaccatgcccactggaccgaggctaagatgctgcttgataacatcaatacacccgaaggcattatccctgccctgttcgagcccgaaagagagaaaagcgcggccatcgacggggagtaccgcctcaagggcgaatcccggaaaaccttcgtcgagctgatgagacgcggagatctgcctgtgtggctcgctcataaggttgccagcgaaggcattaaatatacggaccggaagtggtgctttgatggggagagaaacaatcagatccttgaagagaacatggacgtggagatttggacaaaggaaggagagaaaaagaaactgcgcccccggtggctggatgctagaacctactctgacccgctcgccctgaaggagttcaaagattttgccgctggccgcaagtccatcgcgcttgacctggtcaccgagattgggagagtgcctagccacctcgcccaccggacacgcaatgctctggataacctggtcatgctccatacctctgaacacggaggcagagcctatcggcatgccgtggaggagcttcccgaaacaatggagacgttcctgctgctcggcctgatgatccttctgaccgggggagctatgctctttctgatctccggcaagggggttggaaaaacaagcattggcctgatctgtgtggtggcctcctctgggatgctctggatggcggacattcctcttcagtggatcgccagcgctattgtcctggagttctttatgatggttctgctcatccccgagcctgagaagcagcgcacaccccaagataatcagctggcctacgtggtgattggaatccttacactggctgccatcgtcgcggccaacgaaatgggcctcctggagaccacgaaaagagacctgggcatgtccaaggaaccgggggtggttagccctacctcttatctcgacgtggatcttcaccccgcttccgcctggacactgtacgctgtcgccaccacagtgattacccccatgctgcggcacacgatcgagaatagcacagctaacgtctctctcgccgcgattgccaaccaggctgtggttctgatgggacttgacaaaggctggcctatcagcaagatggatctgggggtgccgctcctggccctgggatgctactcccaagtcaatcccctcacccttacagctgccgtgctgctgctcgttacccattatgccattatcggccctgggctgcaggcgaaggctaccagagaagcccagaaacgcacagctgccggaatcatgaagaaccccacggtggacggcattatgaccatcgatcttgaccctgtcatttacgattctaaattcgagaagcagctgggccaagtgatgctcctggtgctgtgtgccgttcagctccttctgatgcggacaagctgggctttttgcgaggccctgaccctcgcgacagggcccatcaccacgctgtgggaaggatcccctggcaaattctggaatacaaccattgccgtctctatggctaacatctttagagggagctatcttgccggagctggcctggccttctccatcatgaaaagcgtggggaccggaaagcgcggcacaggctctcagggggagaccctcggagaaaaatggaagaaaaagctgaatcagctgtcccggaaagagtttgacctctacaagaaaagcggcattacagaagtggatagaacggaggcgaaggaggggcttaagcggggagaaaccacacaccatgccgtctcccgcggctctgctaaactgcaatggttcgttgagagaaacatggtgatcccggaagggcgggtgattgacctgggatgtggccgcggcgggtggagctattactgcgccggactcaagaaagtcaccgaggtgagaggctatacaaaagggggacccggccacgaagaacctgttcccatgtccacctacgggtggaatatcgtgaaactgatgtctggaaaggatgtcttctaccttcctcccgagaagtgtgacacgctgctctgcgatattggcgaaagctccccgagccctaccgtggaggaatctcggacaatccgcgttctgaaaatggtggagccctggctgaagaacaatcagttttgtattaaagtcctcaacccctatatgcctaccgtgatcgagcatcttgaaagactgcagcggaagcacggcgggatgctggtgcgcaatcccctctccagaaacagcacacacgagatgtactggatctctaatggaaccggcaacattgtctccagcgttaatatggtgtctcggctgcttctgaacagattcacaatgacctatcgccggcctacgatcgaaaaagacgtggacctcggggctggaacaagacatgtcaacgccgagccggaaacccccaatatggatgtgattggcgagcgcatccggagaattaaggaggaacacagctccacctggcattacgacgatgagaacccttataagacatgggcttaccacgggtcttatgaagttaaagccacgggaagcgcgtccagcatgatcaatggcgtggtcaagctgctgaccaaaccctgggacgtggttcctacagtgacccagatggccatgacagataccacaccctttggccaacagcgcgtcttcaaggagaaagtggacacccggacgccgaagcctatgcccgggaccagaaaggttatggaaatcacagctgagtggctctggcgcaccctgggacggaacaaaagacctcgcctttgcacacgggaggaatttaccaagaaagtgagaacgaatgccgctatgggcgccgtcttcacagaggaaaaccagtgggattccgcccgcgcggctgtggaggacgaagagttttggaagctggtcgatagagagcgggaactccacaaacaagggaagtgtggatcttgcgtgtacaatatgatgggcaaacgcgagaagaagctgggggagttcggcaaagccaagggaagcagagccatttggtacatgtggcttggcgctcggtatctggagtttgaggccctcgggttcctgaacgaagaccattggttttccagagaaaattcttacagcggagttgaaggcgaggggctgcacaaactcggatatatcctgcgggatatttccaagatccccggcggggctatgtacgccgacgacaccgcgggctgggatacacgcattaccgaagacgatcttcataacgaggagaaaatcacgcagcagatggaccctgaacacagacagctggccaatgctatcttcaagctcacctatcaaaacaaggtggtcaaagtgcagcggcccacaccgaagggaaccgtgatggatattatctctcgcaaagaccagagaggcagcgggcaggttggaacatacggcctgaatacctttacaaacatggaggcccaacttattcggcagatggaaggggagggagtgctgtccaagaccgatctcgaaaatcctcatctgctggagaaaaagatcattcagtggctcgagacgaagggcgtcgaacgcctgaaaagaatggctatcagcggggacgattgcgtggttaagcccatcgacgatcggttcgccaacgcgcttctggccctcaacgacatgggcaaagtgcgcaaggatattccccagtggcaaccttctagaggatggcacgactggcagcaggtcccgttctgttcccaccattttcacgagctgatcatgaaagacggccggaaacttgtggtcccctgccgccctcaggatgaactgattgggagagctcggatcagccaaggagccggctggtctctcaaggagacagcttgtctggggaaagcctatgctcagatgtgggccctgatgtacttccatcgcagagacctccggctggcgtccaatgccatttgcagcgctgtgcccgttcactgggtgcctacctctagaaccacatggtccatccacgcccatcaccagtggatgaccacagaagatatgcttacggtctggaaccgcgtgtggattgaggacaatccctggatggaggataagacccctgttacaacctgggaagacgtgccctacctgggaaaacgggaggatcaatggtgtggcagcctcatcgggctgacatccagagccacctgggctcagaacatccttacggccattcagcaggtccgcagcctgatcggcaatgaagagtttctcgactatatgccgtctatgaagcggttcagaaaagaggaagagagcgaaggagcgatttggtga

SEQ ID NO: 20926 - RNA, 9873 nt, synthetic construct
  misc_feature 1..9873: note = derived and/or modified CDS sequence (opt5) from DENV-3__AY858044__SS-prME
  source 1..9873: mol_type = other RNA
accagcctctgcctcatgatgatgctgcccgccacccttgctttccacctgacgtccagagacggagagcctcggatgatcgtcgggaagaacgaacgcggaaagtctctcctgtttaagaccgccagcggaattaatatgtgtacccttatcgcgatggatctgggggagatgtgcgacgataccattacatacaagtgtccgctcatcaccgaagtcgagcccgaagacattgattgctggtgtaacctgacatccacctgggttacgtatggaacctgcaatcaggctggcgagcatagacgggacaagcgctctgtggccctggcccctcacgtggggatgggactcgatacaagagctcaaacctggatgagcgccgagggcgcttggcggcaggtcgaaaaggtggagacatgggccttccgccatcccggctttaccatcctggcgcttttcctggcccactacatcgggacgtccctcacacagaaggttgtgatttttatcctgcttatgctggtcaccccttctatgacaatgagatgtgtgggagttggcaaccgggacttcgtggaagggctcagcggagctacctgggtcgatgtggtgctggagcatggcgggtgcgtcaccacaatggccaagaataaacccacgctggacattgagctccagaagaccgaagctacacaactggccacccttcgcaaactgtgtatcgagggaaagattacaaacgttaccacggattccagatgccctacacagggcgaagcgatcctcccggaggaacaggaccagaattatgtgtgtaaacacacctacgtggatcggggctgggggaacggatgcggcctgtttgggaagggaagccttgtgacctgcgccaagttccaatgtctggagctcattgagggcaaagtggttcagcacgaaaatctgaagtatacagtgatcatcaccgtccatacaggggaccagcaccaggtgggaaacgagacgcaaggcgttaccgctgaaattacaccccaggcctctaccgtggaggctatcctgcctgaatacggcacactcgggctggagtgcagcccccgcaccggacttgactttaatgagatgattctgctcacgatgaaaaacaaggcctggatggtccatagacagtggttctttgatctgcctcttccctggaccagcggcgccacaaccgaaacaccgacctggaataaaaaggagctgctcgtgacgttcaaaaacgctcacgcgaagaagcaagaagtcgtggttctggggtctcaggagggagccatgcacacagctctgaccggcgccacagaaatccagacctccgggggcaccagcatttttgccggacatctcaaatgtcggctgaagatggacaaacttgagctgaagggcatgtcttatgctatgtgctccaatgccttcgtgctcaaaaaggaggtcagcgaaacacagcacgggacgatcctgatcaaggtggagtacaaaggagaagatgcgccttgtaagattcccttctccaccgaggacggccaagggaaagctcataacggacgcctgatcacagccaaccctgttgtgaccaagaaagaggaacccgtcaatattgaggccgaacccccttttggcgagtctaacatcattatcgggatcggcgataaggctcttaagattaattggtacaaaaagggaagctccatcggcaaaatgttcgaagccacagctagaggggcccggagaatggcgattctcggagacaccgcctgggattttggcagcgtcgggggagtgctgaactctctgggcaagatggttcaccagatcttcgggtccgcttatacggccctctttagcggcgtctcttggattatgaaaatcggaattggcgtgctgcttacatggatcgggctgaatagcaagaacacctccatgtctttcagctgcatcgtgattggaatcattaccctctacctgggcgctgtcgtgcaggccgacatggggtgtgttatcaattggaagggaaaagagctgaagtgcggctccgggatttttgtgacaaacgaggtccatacctggacagaacagtataaattccaagcggatagcccgaagcgccttgccacggctatcgccggcgcttgggagaatggagtgtgtggcatccggtctaccacaagaatggaaaacctcctgtggaaacagattgccaatgagctgaactacatcctctgggaaaataacattaagctgaccgttgtggtcggggacatcattggagtgcttgagcagggcaaacgcacactgacaccccagcctatggagctcaagtattcctggaagacgtgggggaaagccaagatcgttaccgctgaaatccaaaatagctcttttattatcgatggacccaacacacctgagtgccccaacgcgtcccgggcctggaatgtgtgggaagtcgaggactacggcttcggcgtgtttaccacaaacatttggctgaaactgagagaaatgtatacccagctttgtgaccaccgcctcatgagcgctgccgtgaaggatgagcgggccgtccacgctgacatggggtactggatcgagtcccagaaaaatggatcttggaagctggaaaaggccagcctgattgaggttaaaacatgcacctggccgaagtcccatacgctctggtctaacggcgtgctggaaagcgatatgatcatccctaaatcccttgcggggcccattagccagcacaattacagacctggatatcatacacaaaccgctggcccctggcacctggggaagctcgagctggacttcaactactgcgagggaaccacagtggtcatcaccgaaaattgtggcacgcgcggcccttctctgcggacaaccacagtgtccgggaaacttattcacgagtggtgctgtagaagctgcaccctgcccccgctgcgctatatgggagaagatggctgttggtacgggatggagatccggcctattaacgaaaaggaggagaatatggttaagtctctggtgtccgccggaagcggcaaagtcgacaactttacaatgggggtgctctgcctggccatccttttcgaagaggttatgagaggaaagttcggcaaaaagcatatgattgctggcgtgctgtttatgttcgtcctcctgctgtctgggcagatcacctggcgggatatggcccgcacgcttatcatgattggaagcaatgcgtccgacagaatgggcatgggggtgacctatctggctctcatcgccacatttaaaattcagcccttcctggccctcggatttttcctgcggaaacttaccagcagagaaaacctgctcctgggcgttgggctggctatggccacaacccttcaactgcccgaggatatcgaacagatggctaatggaattgccctcggcctgatggcgctcaagctgatcacgcagtttgagacataccagctttggaccgccctggtgtctctcacatgttccaacaccatcttcaccctgacagtcgcttggcgcacggccaccctgattcttgctggcatcagcctgctccctgtgtgccaatcctctagcatgcggaaaacagactggctgccgatgaccgtggccgccatgggggtgccccctctccccctgtttattttctcccttaaggatacactgaaaagacgctcttggcctctgaatgagggagttatggctgtgggcctcgtgagcatcctggcgtcctctcttctgagaaacgacgtccccatggccgggcctctcgtggctggaggcctgctcattgcctgttatgttatcaccgggacgagcgccgatctgacagtggaaaaggctgccgacgtcacctgggaggaagaggcggaacagaccggagtgtcccacaaccttatgatcacagttgacgatgacggcaccatgcggattaaagatgacgagacagagaatatcctgacggtgctgctcaagaccgctctgcttattgtcagcggcatctttccctactctattccggccacactgctcgtgtggcatacctggcagaaacagacacaacgctccggggtcctgtgggatgtgccttctccccctgaaacccagaaggccgagctcgaagagggagtttacagaatcaagcagcagggcattttcgggaaaacgcaagtgggagtcggcgtgcagaaggagggggtttttcacaccatgtggcatgtgacacggggagctgtcctgacctataacggcaaacgccttgaacccaattgggcctccgtgaagaaagacctgatctcctacggcgggggatggagactgagcgcgcagtggcaaaagggcgaggaagtgcaggttatcgctgtcgagccggggaagaaccctaaaaatttccagacaatgcccggaattttccagaccacaacgggcgaaatcggggccattgccctcgattttaagcctggaacctctggctcccccatcattaaccgggagggcaaagtggtggggctgtatggaaatggcgtcgtgacaaagaacgggggatacgttagcggcatcgctcaaaccaatgccgagcccgacgggcctaccccggaacttgaggaagagatgttcaaaaagcgcaacctgacaatcatggatctccaccccggctccggaaagacgagaaaatatctgcctgctattgtgcgggaagccatcaagcgcagactccggaccctgattcttgcgcccacaagagtcgtggccgctgagatggaggaagccctgaaaggcctgcctatccgctaccagaccacagctaccaagagcgagcacacggggaaagaaattgttgacctcatgtgccatgccacatttaccatgcggctgctttctcccgtgagagtccctaattataacctgatcatcatggatgaggcccacttcaccgacccggctagcattgcggcccgcggatacatctccacacgggtgggcatgggggaagctgccgccatttttatgaccgctacaccccctggaaccgccgatgcgttcccccagtctaatgctcctatccaggacgaggagagagacattcccgaacgcagctggaactccggcaatgattggatcacggactttgccgggaagacagtttggttcgtgccgtctattaaggccggcaacgatatcgctaactgtctccggaaaaatggaaagaaagtcatccaactgagcagaaagacctttgacacagagtaccagaaaaccaagctgaacgattgggacttcgtggtgacgaccgatatttccgaaatgggcgccaattttaaggcggaccgcgtcatcgatcctcggagatgcctcaaacccgttattcttacagacgggcccgagcgggtgatcctggccggacctatgcccgtgaccgtcgcttctgccgctcagcgcagaggccgggtggggcgcaaccctcagaaggagaatgatcaatatattttcacaggacagccgctgaacaatgacgaagaccatgcccactggaccgaggctaaaatgctcctggataacatcaatacacccgaaggcatcattcctgcccttttcgagcccgaaagagaaaagagcgcggccatcgacggggagtaccggctgaaaggcgaatccagaaagacctttgttgagctcatgcgccggggagatctgcctgtgtggctggctcataaagtcgccagcgaaggcattaagtatacggacagaaagtggtgcttcgatggggagcgcaacaatcagatcctcgaagagaacatggacgtggagatttggacaaaagaaggagagaagaagaaacttcggcccagatggctggatgctcgcacctactctgacccgctggccctcaaagaatttaaagatttcgccgctggccggaagtccatcgcgctggaccttgttaccgagatcgggagagtgcctagccacctggcccaccgcacaagaaatgctctcgataacctggtcatgctgcatacctctgaacacggaggccgggcctatcgccatgccgtggaggagctccccgaaacaatggagacgcttctgctgctcggcctgatgattcttctgaccgggggagctatgctctttctgatctccggcaaaggggtcggaaagacaagcattggcctgatctgtgtggttgcctcctctgggatgctctggatggcggacattcctcttcagtggatcgccagcgctattgtgctggagttctttatgatggtgctgctcatccccgagcctgagaaacaaagaacaccccaggataatcagctggcctacgtcgttatcggcattcttacactggctgccatcgtggcggccaacgaaatgggcctcctggagaccacgaagcgggacctgggcatgtccaaagaaccgggggtggtcagccctacctcttatctcgacgtggatcttcaccccgcttccgcctggacactgtacgctgttgccaccacagtgattacccccatgctgcgccacacgatcgagaatagcacagctaacgtctctctcgccgcgattgccaaccaagctgtggtcctgatgggacttgacaagggctggcctatcagcaagatggatctgggggtgccgctcctggccctgggatgctactcccaggttaatcccctcacccttacagctgccgtgctgctgctcgtcacccattatgccatcattggccctgggctgcaggcgaaagctaccagagaagcccagaagcggacagctgccggaatcatgaaaaaccccacggtggacggcattatgaccatcgatcttgaccctgttatttacgattctaagttcgagaaacaactgggccaggtgatgctcctggtcctgtgtgccgtgcagctccttctgatgagaacaagctgggctttttgcgaggccctgaccctcgcgacagggcccatcaccacgctgtgggaaggatcccctggcaagttctggaatacaaccatcgccgtgtctatggctaacatttttcgcgggagctatcttgccggagctggcctggccttctccatcatgaaaagcgttgggaccggaaaacggggcacaggctctcagggggagaccctcggagaaaagtggaaaaagaaactgaatcaactgtccagaaaggagtttgacctctacaaaaagagcggcattacagaagtcgatcgcacggaggcgaaggaggggcttaaacggggagaaaccacacaccatgccgtgtccagaggctctgctaagctgcagtggttcgtggagcggaacatggtcatcccggaagggcgcgttattgacctgggatgtggcagaggcgggtggagctattactgcgccggactcaaaaaggtgaccgaggtgcggggctatacaaaagggggacccggccacgaggaacctgtccccatgtccacctacgggtggaatatcgtgaagctgatgtctggaaaggatgttttctaccttcctcccgagaaatgtgacacgctgctctgcgatattggcgaaagctccccgagccctaccgtggaggaatctcgcacaatcagagtcctgaagatggtggagccctggctgaaaaacaatcagttttgtatcaaggttctcaacccctatatgcctaccgtgattgagcatcttgaacggctgcagcgcaaacacggcgggatgctggtcagaaatcccctctcccggaacagcacacacgagatgtactggatctctaatggaaccggcaacattgtgtccagcgtgaatatggtctctcgcctgcttctgaacagattcacaatgacctatcggagacctacgatcgaaaaggacgttgacctcggggctggaacacgccatgtgaacgccgagccggaaacccccaatatggatgtgattggcgagcggatcagacgcatcaaggaggaacacagctccacctggcattacgacgatgagaacccttataaaacatgggcttaccacgggtcttatgaagtcaaggccacgggaagcgcgtccagcatgattaatggcgtggttaaactgctgaccaagccctgggacgtggtccctacagtgacccaaatggccatgacagataccacaccctttggccagcagcgggttttcaaagagaaggtggacaccagaacgccgaagcctatgcccgggacccgcaaagtcatggaaatcacagctggatggctctggcggaccctgggcagaaacaagcgccctcggctttgcacaagagaggagtttaccaaaaaggtgcgcacgaatgccgctatgggggccgttttcacagaagagaaccaatgggattccgcccgggcggctgtggaagacgaggaattttggaaactggtcgatagagagcgcgagctccacaagcagggaaaatgtggctcttgcgtgtacaatatgatggggaagagagaaaagaaactgggcgagttcggaaaggccaaaggcagccgggccatttggtacatgtggcttggggctcgctatctggaatttgaggccctcggattcctgaacgaggaccattggttttccagagaaaattcttacagcggcgtcgagggggaaggactgcacaagctcggctatatcctgcgggatatttccaaaatccccgggggcgctatgtacgccgacgacaccgcgggatgggatacaagaatcaccgaggacgatcttcataacgaagagaagattacgcagcagatggaccctgagcaccggcaactggccaatgctatcttcaagctcacctatcagaacaaagtggttaaggtgcagcgccccacaccgaaaggcaccgtcatggatattatctctagaaaggaccagcgggggagcggacaagtgggcacatacgggctgaatacctttacaaacatggaagcccagcttattcgccagatggagggagaaggcgtgctgtccaaaaccgatctcgagaatcctcatctgctggaaaagaagatcacgcagtggctcgagacaaaaggggttgagagactgaagcggatggctatcagcggcgacgattgcgtggtcaaacccattgacgatcgcttcgccaacgcgcttctggccctcaacgacatgggaaaggtgagaaaagatatcccccaatggcagccttctaagggctggcacgactggcagcaggttccgttctgttcccaccattttcacgaactgattatgaaggacgggcggaaacttgtggtcccctgccgccctcaagatgagctgatcggcagagctcggattagccagggcgccgggtggtctctcaaggaaaccgcttgtctgggaaaagcctatgctcagatgtgggccctgatgtacttccatcgcagagacctccggctggcgtccaatgccatctgcagcgctgtgcccgtccactgggtgcctacctctcgcacaacctggtccattcacgcccatcaccaatggatgacaacggaggatatgcttaccgtttggaacagagtgtggatcgaagacaatccctggatggaggataagacacctgtcaccacatgggaggacgtgccctacctgggcaaacgggaagatcagtggtgtgggagcctcatcggcctgacctccagagccacgtgggctcagaacattcttaccgccatccagcaagttcgcagcctgattggaaatgaggaatttctcgactatatgccgtctatgaagcggttcagaaaggaggaggaaagcgagggcgcgatctggtga

SEQ ID NO: 20927 - RNA, 9873 nt, synthetic construct
  misc_feature 1..9873: note = derived and/or modified CDS sequence (opt5) from DENV-3__AY858045__SS-prME
  source 1..9873: mol_type = other RNA
accagcctgtgcctcatgatgatgctgcccgccacccttgctttccacctgacgtccagagacggagagcctcggatgatcgtggggaagaacgaacgcggaaaatctctcctgtttaagaccgccagcggcattaatatgtgtacacttatcgcgatggatctgggggagatgtgcgacgataccattacatacaaatgtccgctcatcaccgaagtcgagcccgaagacattgattgctggtgtaacctgacatccacctgggttacgtatggaacctgcaatcaggctggcgagcatagacgggacaagcgctctgtggccctggcccctcacgtggggatgggactcgatacaagagctcaaacctggatgagcgccgagggcgcttggcggcaggtcgaaaaagtggagacatgggccttccgccatcccggctttaccatcctggcgcttttcctggcccactacatcgggacgtccctcacacagaaggttgtgatttttatcctgcttatgctggtcaccccttctatgacaatgagatgtgtgggagttggcaaccgggacttcgtggaagggctcagcggagctacctgggtcgatgtggtgctggagcatggcgggtgcgtcaccacaatggccaagaataaacccacgctggacattgagctccagaagaccgaagctacacaactggccacccttcgcaaactgtgtatcgagggaaagattacaaacgttaccacggattccagatgccctacacagggcgaagcgatcctcccggaggaacaggaccagaattatgtgtgtaaacacacctacgtggatcggggctgggggaacggatgcggcctgtttgggaagggaagccttgtcacatgcgccaagttccaatgtctggagctcattgagggcaaagtggttcagcacgaaaatctgaagtatacagtgatcatcaccgtccatacaggggaccagcaccaggtgggaaacgagacgcaaggcgttaccgctgaaattacaccccaggcctctaccgtggaggctatcctgcctgaatacggcacactcgggctggagtgcagccccagaaccggacttgactttaatgagatgattctgctcacgatgaaaaacaaggcctggatggtccatagacagtggttctttgatctgcctcttccctggaccagcggcgccacaaccgaaacaccgacctggaataaaaaggagctgctcgtgacgttcaaaaacgctcacgcgaagaagcaagaagtcgtggttctggggtctcaggagggagccatgcacacagctctgaccggcgccacagaaatccagacctccgggggcaccagcatttttgccggacatctcaaatgtcggctgaagatggacaaacttgagctgaagggcatgtcttatgctatgtgctccaatgccttcgtgctcaaaaaggaggtcagcgaaacacagcacgggacgatcctgatcaaggtggagtacaaaggagaagatgcgccttgtaagattcccttctccaccgaggacggccaagggaaagctcataacggacgcctgatcacagccaaccctgttgtgaccaagaaagaggaacccgtcaatattgaggccgaacccccttttggcgagtctaacatcattatcgggatcggcgataaggctcttaagattaattggtacaaaaagggaagctccatcggcaaaatgttcgaagccacagctagaggggcccggagaatggcgattctcggagacaccgcctgggattttggcagcgtcgggggagtgctgaactctctgggcaagatggttcaccagatcttcgggtccgcttatacggccatttttagcggcgtctcttggatcatgaaaattggaatcggcgtgctcctgacatggatcgggcttaatagcaagaacacctccatgtctttcagctgcattgtgatcggaattatcaccctgtacctcggcgctgtcgtgcaggccgacatggggtgtgttattaattggaagggaaaagagctgaagtgcggctccgggatctttgtgacaaacgaggtccatacctggacagaacagtataaattccaagcggatagcccgaagcgcctggccacggctatcgccggcgcttgggagaatggagtgtgtggcattcggtctaccacaagaatggaaaaccttctctggaaacagatcgccaatgagctgaactacattctgtgggaaaataacatcaagctcaccgttgtggtcggggacattatcggagtgctggagcagggcaaacgcacacttacaccccagcctatggagctgaagtattcctggaagacgtgggggaaagccaagatcgttaccgctgaaattcaaaatagctcttttatcattgatggacccaacacacctgagtgccccaacgcgtcccgggcctggaatgtgtgggaagtcgaggactacggcttcggcgtgtttaccacaaacatctggctcaaactgagagaaatgtatacccagctgtgtgaccaccgccttatgagcgctgccgtgaaggatgagcgggccgtccacgctgacatggggtactggattgagtcccagaaaaatggatcttggaagctcgaaaaggccagcctgatcgaggttaaaacatgcacctggccgaagtcccatacgctgtggtctaacggcgtgctcgaaagcgatatgatcattcctaaatccctggcggggcccatcagccagcacaattacagacctggatatcatacacaaaccgctggcccctggcaccttgggaagctggagctcgacttcaactactgcgagggaaccacagtggtcattaccgaaaattgtggcacgcgcggcccttctctgcggacaaccacagtgtccgggaaactgatccacgagtggtgctgtagaagctgcacccttcccccgctccgctatatgggagaagatggctgttggtacgggatggagattcggcctatcaacgaaaaggaggagaatatggttaagtctctggtgtccgccggaagcggcaaagtcgacaactttacaatgggggtgctgtgcctcgccattctgttcgaagaggttatgagaggaaagttcggcaaaaagcatatgatcgctggcgtgctttttatgttcgtcctgctcctgtctgggcagatcacctggcgggatatggcccgcacgctgattatgatcggaagcaatgcgtccgacagaatgggcatgggggtgacctatcttgctctgattgccacatttgaaatccagcccttcctcgccctgggatttttcctccggaaactgaccagcagagagaaccttctgctcggcgttgggctggctatggccacaaccctgcaacttcccgaagatattgagcagatggctaatggaatcgccctgggcctcatggcgctgaagctcatcacgcagtttgagacataccagctgtggaccgcccttgtgtctctgacatgttccaacaccattttcaccctcacagtcgcttggcgcacggccaccctgatcctggctggcattagccttctgcctgtgtgccaatcctctagcatgcggaagacagactggctcccgatgaccgtggccgccatgggggtgccccctctgcccctctttatcttctccctgaaagatacacttaagagacgctcttggcctctgaatgaaggagttatggctgtgggcctggtgagcattctcgcgtcctctctgcttagaaacgacgtccccatggccgggcctctggtggctggaggcctcctgatcgcctgttatgttatcaccgggacgagcgccgatctcacagtggagaaagctgccgacgtcacctgggaagaggaagcggagcagaccggagtgtcccacaacctgatgattacagttgacgatgacggcaccatgcggatcaaggatgacgagacagaaaatattcttacggtgctgctgaaaaccgctctcctgatcgtcagcggcatttttccctactctatcccggccacacttctggtgtggcatacctggcagaagcagacacaacgctccggggtcctctgggatgtgccttctccccctgagacccagaaagccgaactggaggagggagtttacagaattaagcagcagggcatcttcgggaagacgcaagtgggagtcggcgtgcagaaagaaggggtttttcacaccatgtggcatgtgacacggggagctgtcctcacctataacggcaagcgcctggagcccaattgggcctccgtgaaaaaggaccttatctcctacggcgggggatggagactgagcgcgcagtggcaaaaaggcgaagaggtgcaggttattgctgtcgaaccggggaagaaccctaagaatttccagacaatgcccggaatcttccagaccacaacgggcgagattggggccatcgccctggattttaaacctggaacctctggctcccccattatcaaccgggagggcaaggtggtggggctctatggaaatggcgtcgtgaccaagaacgggggatacgttagcggcatcgctcaaaccaatgccgaacccgacgggcctaccccggagctggaagaggaaatgttcaagaaacgcaaccttacaattatggatctgcaccccggctccggaaagacgagaaagtatctccctgctatcgtgcgggaggccattaaacgcagactgcggaccctcatcctggcgcccacaagagtcgtggccgctgagatggaagaggcccttaagggcctgcctattcgctaccagaccacagctaccaaaagcgaacacacggggaaggagatcgttgacctgatgtgccatgccacatttaccatgcggctcctgtctcccgtgagagtccctaattataaccttatcattatggatgaagcccacttcaccgacccggctagcatcgcggcccgcggatacatttccacacgggtgggcatgggggaggctgccgccatctttatgaccgctacaccccctggaaccgccgatgcgttcccccagtctaatgctcctattcaggacgaggaaagagacatccccgagcgcagctggaactccggcaatgattggattacggactttgccgggaaaacagtttggttcgtgccgtctatcaaggccggcaacgatatcgctaactgtctgcggaagaatggcaagaaggtcattcaactcagcagaaaaacctttgacacagaataccagaagaccaaactgaacgattgggacttcgtggtgacgaccgatatctccgagatgggcgccaattttaaggcggaccgcgtcattgatcctcggagatgcctgaagcccgttatcctcacagacgggcccgagcgggtgattcttgccggacctatgcccgtgaccgtcgcttctgccgctcagcgcagaggccgggtggggcgcaaccctcagaaagaaaatgatcaatatatcttcacaggacagccgctgaacaatgacgaggaccatgcccactggaccgaagctaagatgctgctcgataacatcaatacacccgagggcattatccctgccctgttcgaacccgagagagagaaaagcgcggccattgacggggaataccggcttaagggcgagtccagaaaaacctttgttgaactgatgcgccggggagatctccctgtgtggctggctcataaggtcgccagcgagggcatcaaatatacggacagaaagtggtgcttcgatggggaacgcaacaatcagattctggaggagaacatggacgtggaaatctggacaaaggagggagagaaaaagaaactccggcccagatggcttgatgctcgcacctactctgacccgctggccctgaaggagtttaaagatttcgccgctggccggaagtccatcgcgctcgacctggttaccgaaattgggagagtgcctagccaccttgcccaccgcacaagaaatgctctggataacctcgtcatgctgcatacctctgagcacggaggccgggcctatcgccatgccgtggaggaactgcccgagacaatggaaacgctccttctgctgggcctcatgatcctgcttaccgggggagctatgctgtttctcatttccggcaagggggtcggaaaaacaagcatcggcctgatttgtgtggttgcctcctctgggatgctgtggatggcggacatccctctccagtggattgccagcgctatcgtgcttgagttctttatgatggtgctgctgatccccgagcctgaaaagcaaagaacaccccaggataatcagctcgcctacgtcgttattggaatcctgacacttgctgccattgtggcggccaacgagatgggcctgctcgaaaccacgaaacgggacctgggcatgtccaaggagccgggggtggtcagccctacctcttatctggacgtggatctccaccccgcttccgcctggacactttacgctgttgccaccacagtgatcacccccatgctgcgccacacgattgaaaatagcacagctaacgtctctctggccgcgatcgccaaccaagctgtggtcctcatgggactggacaaaggctggcctatcagcaagatggatcttggggtgccgctgctcgccctgggatgctactcccaggttaatcccctgaccctcacagctgccgtgcttctgctggtcacccattatgccattatcggccctgggctccaggcgaaggctaccagagaggcccagaaacggacagctgccggaattatgaagaaccccacggtggacggcatcatgaccattgatctggaccctgttatctacgattctaaattcgagaagcaacttggccaggtgatgctgctcgtcctgtgtgccgtgcagctgctccttatgagaacaagctgggctttttgcgaagccctgaccctggcgacagggcccatcaccacgctctgggagggatcccctggcaaattctggaatacaaccattgccgtgtctatggctaacatctttcgcgggagctatctggccggagctggccttgccttctccattatgaaaagcgttgggaccggaaagcggggcacaggctctcagggggaaaccctgggagagaaatggaagaaaagactcaatcaactgtcccgcaaggaatttgacctgtacaaaaagagcggcatcacagaggtcgatcggacggaggcgaaagaagggctcaagagaggagagattacccaccatgccgtgtcccggggctctgctaaacttcagtggttcgtggaacgcaacatggtcatcccggaggggagagttattgacctgggatgtggccggggcgggtggagctattactgcgccggactgaaaaaggtgacagaagtgcgcggctataccaaagggggacccggccacgaggagcctgtccccatgtccacatacgggtggaatatcgtgaagctcatgtctggaaaagatgttttctacctgcctcccgaaaagtgtgacacccttctgtgcgatatcggcgagagctccccgagccctacggtggaagagtctagaaccattcgggtcctcaagatggtggagccctggctgaaaaacaatcagttttgtatcaaggttctgaacccctatatgcctacagtgattgaacatctcgagcgccttcagagaaaacacggcgggatgctggtccggaatcccctgtcccgcaacagcacccacgaaatgtactggatctctaatggaacaggcaacattgtgtccagcgtgaatatggtctctagactcctgcttaaccggttcaccatgacatatagacgccctaccatcgagaaggacgttgacctgggggctggaacgcggcatgtgaacgccgaaccggagacacccaatatggatgtgatcggcgagcgcattcgccggatcaaagaagaacacagctccacctggcattacgacgatgaaaacccttataagacctgggcttaccacgggtcttatgaggtcaaggccacaggaagcgcgtccagcatgattaatggcgtggttaaactcctgacgaagccctgggacgtggtccctaccgtgacacaaatggccatgaccgatacaaccccctttggccagcagagagttttcaaagaaaaggtggacacacgcaccccgaaacctatgcccgggacgcggaaggtcatggagatcaccgctggatggctgtggagaacactcggccgcaacaagcggcctagactgtgcacccgcgaggaatttaccaaaaaggtgcggaccaatgccgctatgggggccgttttcacggaggaaaaccaatgggattccgccagagcggctgtggaggacgaagagttttggaaacttgtcgatcgcgagagagaactgcacaagcagggaaaatgtggctcttgcgtgtacaatatgatggggaagcgggagaaaaagctcggcgagttcggaaaggccaaaggcagccgcgccatttggtacatgtggctgggggctagatatcttgagtttgaggccctgggattcctcaacgaagaccattggttttcccgggaaaattcttacagcggcgtcgaaggggagggactgcacaagctgggctatatcctcagagatatctccaaaattcccgggggcgctatgtacgccgacgacacagcgggatgggatacccggatcacagaagacgatctgcataacgaggagaagattacccagcagatggaccctgaacaccgccaacttgccaatgctatcttcaaactgacgtatcagaacaaggtggttaaggtgcagagacccaccccgaaaggcacagtcatggatattatctctcggaaggaccagcgcgggagcggacaagtgggcacctacgggctcaatacatttaccaacatggaggcccagctgatcagacagatggaaggagagggcgtgctttccaaaacagatctggaaaatcctcatctcctggagaagaaaattacccagtggctggagacgaagggggttgaacggctcaagcgcatggctatcagcggcgacgattgcgtggtcaaacccattgacgatagattcgccaacgcgctgcttgccctgaacgacatgggaaaggtgcggaaagatatcccccaatggcagccttctaagggctggcacgactggcagcaggttccgttctgttcccaccattttcacgagctcattatgaaagacgggcgcaagctggtggtcccctgcagacctcaagatgaacttatcggacgggctcgcattagccagggcgccgggtggtctctgaaggagacagcttgtctcggaaaagcctatgctcagatgtgggccctgatgtacttccatagacgggacctgcgcctcgcgtccaatgccatctgcagcgctgtgcccgtccactgggtgcctacctctagaaccacatggtccatccacgcccatcaccaatggatgaccacagaagatatgctgacggtttggaaccgggtgtggattgaggacaatccctggatggaggataagacccctgtcacaacctgggaagacgtgccctaccttggcaaaagagaggatcagtggtgtgggagcctgatcggcctcacatcccgcgccacctgggctcagaacattctgacggccatccagcaagttcggagccttattggaaatgaagagtttctggactatatgccgtctatgaagagattccgcaaagaggaagagagcgaaggcgcgatctggtga

SEQ ID NO: 20928 - RNA, 9873 nt, synthetic construct
  misc_feature 1..9873: note = derived and/or modified CDS sequence (opt5) from DENV-3__AY858046__SS-prME
  source 1..9873: mol_type = other RNA
accagcctctgcctcatgatgatgctgcccgccacccttgctttccacctgacgtcccgggacggagagcctcggatgatcgtggggaagaacgaacgcggaaagtctctcctgtttaagaccgccagcggcattaatatgtgtacccttatcgcgatggatctgggggagatgtgcgacgataccattacatacaagtgtccgctcatcaccgaagtggagcccgaagacattgattgctggtgtaacctgacatccacctgggttacgtatggaacctgcaatcaggtgggcgagcatagacgggacaagcgctctgtggctctggcccctcacgtcgggatgggactcgatacaagagcccagacctggatgagcgctgagggcgcctggagacaggtggaaaaggttgagacatgggctttccgccatcccggctttaccatcctggcccttttcctggcgcactacatcgggacgtccctcacacagaaggtggtcatttttatcctgcttatgctggtgaccccttctatgacaatgagatgtgttggagtgggcaaccgggacttcgtcgaagggctcagcggagccacctgggtggatgtggtcctggagcatggcgggtgcgttaccacaatggctaagaataagcccacgctggacattgagctccagaagaccgaagccacacaactggctacccttcgcaaactgtgtatcgagggaaagattacaaacgtgaccacggattccagatgccctacacagggcgaagccatcctcccggaggaacaggaccagaattatgtgtgtaaacacacctacgtcgatcggggctgggggaacggatgcggcctgtttgggaagggaagccttgtgacctgcgcgaagttccaatgtctggagctcattgagggcaaagttgtgcagcacgaaaatctgaagtatacagtcatcatcaccgtgcatacaggggaccagcaccaggttggaaacgagacgcaaggcgtgaccgccgaaattacaccccaggcttctaccgtcgaggccatcctgcctgaatacggcacactcgggctggagtgcagcccccgcaccggacttgactttaatgagatgattctgctcacgatgaaaaacaaggcttggatggtgcatagacagtggttctttgatctgcctcttccctggaccagcggcgccacaaccgaaacaccgacctggaataaaaaggagctgctcgtcacgttcaaaaacgcccacgctaagaagcaagaagtggttgtgctggggtctcaggagggagcgatgcacacagccctgaccggcgctacagaaatccagacctccgggggcaccagcatttttgccggacatctcaaatgtcggctgaagatggacaaacttgagctgaagggcatgtcttatgccatgtgctccaatgctttcgtcctcaaaaaggaggtgagcgaaacacagcacgggacgatcctgatcaaggttgagtacaaaggagaagatgccccttgtaagattcccttctccaccgaggacggccaagggaaagcgcataacggacgcctgatcacagctaaccctgtggtcaccaagaaagaggaacccgtgaatattgaggccgaacccccttttggcgagtctaacatcattatcgggatcggcgataaggcccttaagattaattggtacaaaaagggaagctccatcggcaaaatgttcgaagctacagccagaggggctcggagaatggccattctcggagacaccgcgtgggattttggcagcgtcgggggagttctgaactctctgggcaagatggtccaccagatcttcgggtccgcctatacggctctctttagcggcgtgtcttggattatgaaaatcggaattggcgtgctgcttacatggatcgggctgaatagcaagaacacctccatgtctttcagctgcatcgtcattggaatcattaccctctacctgggcgccgtggttcaggctgacatggggtgtgtgatcaattggaagggaaaagagctgaagtgcggctccgggatttttgtcacaaacgaggtgcatacctggacagaacagtataaattccaagccgatagcccgaagcgccttgcgacggccatcgctggcgcctgggagaatggagtttgtggcatccggtctaccacaagaatggaaaacctcctgtggaaacagattgctaatgagctgaactacatcctctgggaaaataacattaagctgaccgtggtcgtgggggacatcattggagttcttgagcagggcaaacgcacactgacaccccagcctatggagctcaagtattcctggaagacgtgggggaaagccaagatcgtgaccgccgaaatccaaaatagctcttttattatcgatggacccaacacacctgagtgccccaacgcttcccgggcgtggaatgtctgggaagtggaggactacggcttcggcgtgtttaccacaaacatttggctgaaactgagagaaatgtatacccagctttgtgaccaccgcctcatgagcgccgctgtcaaggatgagcgggccgttcacgccgacatggggtactggatcgagtcccagaaaaatggatcttggaagctggaaaaggctagcctgattgaggtgaaaacatgcacctggccgaagtcccatacgctctggtctaacggcgtgctggaaagcgatatgatcatccctaaatcccttgccgggcccattagccagcacaattacagacctggatatcatacacaaaccgcgggcccctggcacctggggaagctcgagctggacttcaactactgcgagggaaccacagtcgtgatcaccgaaaattgtggcacgcgcggcccttctctgcggacaaccacagtttccgggaaacttattcacgagtggtgctgtagaagctgcaccctgcccccgctgcgctatatgggagaagatggctgttggtacgggatggagatccggcctattaacgaaaaggaggagaatatggtgaagtctctggtctccgctggaagcggcaaagtggacaactttacaatgggggttctctgcctggccatccttttcgaagaggtgatgagaggaaagttcggcaaaaagcatatgattgccggcgtcctgtttatgttcgtgctcctgctgtctgggcagatcacctggcgggatatggctcgcacgcttatcatgattggaagcaatgcctccgacagaatgggcatgggggttacctatctggcgctcatcgctacatttaaaattcagcccttcctggccctcggatttttcctgcggaaacttaccagcagagaaaacctgctcctgggcgtggggctggccatggctacaacccttcaactgcccgaggatatcgaacagatggccaatggaattgctctcggcctgatggccctcaagctgatcacgcagtttgagacataccagctttggaccgcgctggtctctctcacatgttccaacaccatcttcaccctgacagtggcctggcgcacggctaccctgattcttgccggcatcagcctgctccctgtgtgccaatcctctagcatgcggaaaacagactggctgccgatgaccgtcgctgccatgggggttccccctctccccctgtttattttctcccttaaggatacactgaaaagacgctcttggcctctgaatgagggagtgatggccgtgggcctcgtcagcatcctggcttcctctcttctgagaaacgacgtgcccatggcggggcctctcgttgccggaggcctgctcattgcttgttatgtgatcaccgggacgagcgccgatctgacagtcgaaaaggccgctgacgtgacctgggaggaagaggccgaacagaccggagtttcccacaaccttatgatcacagtggacgatgacggcaccatgcggattaaagatgacgagacagagaatatcctgacggtcctgctcaagaccgcgctgcttattgtgagcggcatctttccctactctattccggctacactgctcgtctggcatacctggcagaaacagacacaacgctccggggtgctgtgggatgttccttctccccctgaaacccagaaggccgagctcgaagagggagtgtacagaatcaagcagcagggcattttcgggaaaacgcaagtcggagtgggcgttcagaaggagggggtgtttcacaccatgtggcatgtcacacggggagccgtgctgacctataacggcaaacgccttgaacccaattgggcttccgtgaagaaagacctgatctcctacggcgggggatggagactgagcgcccagtggcaaaagggcgaggaagttcaggtcatcgcggtggagccggggaagaaccctaaaaatttccagacaatgcccggaattttccagaccacaacgggcgaaatcggggctattgccctcgattttaagcctggaacctctggctcccccatcattaaccgggagggcaaagtggtcgggctgtatggaaatggcgtggttacaaagaacgggggatacgtgagcggcatcgcccaaaccaatgctgagcccgacgggcctaccccggaacttgaggaagagatgttcaaaaagcgcaacctgacaatcatggatctccaccccggctccggaaagacgagaaaatatctgcctgccattgtccgggaagctatcaagcgcagactccggaccctgattcttgcccccacaagagtggttgcggccgagatggaggaagctctgaaaggcctgcctatccgctaccagaccacagccaccaagagcgagcacacggggaaagaaattgtggacctcatgtgccatgctacatttaccatgcggctgctttctcccgtcagagtgcctaattataacctgatcatcatggatgaggcccacttcaccgacccggccagcattgctgcgcgcggatacatctccacacgggttggcatgggggaagccgctgccatttttatgaccgccacaccccctggaaccgctgatgccttcccccagtctaatgcgcctatccaggacgaggagagagacattcccgaacgcagctggaactccggcaatgattggatcacggactttgctgggaagacagtgtggttcgtcccgtctattaaggccggcaacgatatcgccaactgtctccggaaaaatggaaagaaagtgatccaactgagcagaaagacctttgacacagagtaccagaaaaccaagctgaacgattgggacttcgtggtcacgaccgatatttccgaaatgggcgctaattttaaggccgaccgcgttatcgatcctcggagatgcctcaaacccgtgattcttacagacgggcccgagcgggtgatcctggcgggacctatgcccgtcaccgtggcctctgctgcccagcgcagaggccgggttgggcgcaaccctcagaaggagaatgatcaatatattttcacaggacagccgctgaacaatgacgaagaccatgctcactggaccgaggccaaaatgctcctggataacatcaatacacccgaaggcatcattcctgctcttttcgagcccgaaagagaaaagagcgccgcgatcgacggggagtaccggctgaaaggcgaatccagaaagacctttgtggagctcatgcgccggggagatctgcctgtctggctggcccataaagtggctagcgaaggcattaagtatacggacagaaagtggtgcttcgatggggagcgcaacaatcagatcctcgaagagaacatggacgttgagatttggacaaaagaaggagagaagaagaaacttcggcccagatggctggatgcccgcacctactctgacccgctggctctcaaagaatttaaagatttcgccgccggccggaagtccatcgctctggaccttgtgaccgagatcgggagagtccctagccacctggcgcaccgcacaagaaatgccctcgataacctggtgatgctgcatacctctgaacacggaggccgggcttatcgccatgccgtcgaggagctccccgaaacaatggagacgcttctgctgctcggcctgatgattcttctgaccgggggagccatgctctttctgatctccggcaaaggggtgggaaagacaagcattggcctgatctgtgttgtggcttcctctgggatgctctggatggccgacattcctcttcagtggatcgcgagcgccattgtgctggagttctttatgatggtcctgctcatccccgagcctgagaaacaaagaacaccccaggataatcagctggcttacgttgtgatcggcattcttacactggccgctatcgtggccgcgaacgaaatgggcatgctcgagaccacgaagcgggacctgggcatgtccaaagaaccgggggtcgtgagccctacctcttatctggacgttgatctccaccccgcctccgcttggacactttacgccgtggctaccacagtcattacccccatgctgcgccacacgatcgagaatagcacagccaacgtgtctctggctgccattgcgaaccaagccgtcgtgctcatgggactggacaagggctggcctatcagcaagatggatcttggggttccgctgctcgctctgggatgctactcccaggtgaatcccctgaccctcacagccgctgtccttctgctggtgacccattatgccatcattggccctgggctccaggccaaagcgaccagagaagctcagaagcggacagccgctggaatcatgaaaaaccccacggttgacggcattatgaccatcgatctggaccctgtgatttacgattctaagttcgagaaacaacttggccaggtcatgctgctcgtgctgtgtgccgtgcagctgctccttatgagaacaagctgggccttttgcgaggctctgaccctggccacagggcccatcaccacgctctgggaaggatcccctggcaagttctggaatacaaccatcgcggtttctatggccaacatttttcgcgggagctatctggctggagccggccttgctttctccatcatgaaaagcgtcgggaccggaaaacggggcacaggctctcagggggagaccctgggagaaaagtggaaaaagaaactcaatcaactgtccagaaaggagtttgacctgtacaaaaagagcggcattacagaagtggatcgcacggaggccaaggaggggctccggagaggagaaatcacccaccatgcggtgtcccggggctctgccaaacttcagtggttcgtcgagcgcaacatggttattccggaagggagagtgatcgacctgggatgtggccggggcgggtggagctattactgcgctggactgaagaaagtgacagaggtccgcggctataccaaagggggacccggccacgaagaacctgtgcccatgtccacatacgggtggaatattgttaaactcatgtctggaaaggatgtgttctacctgcctcccgagaagtgtgacacccttctgtgcgatatcggcgaaagctccccgagccctacggtcgaggaatctagaaccatccgggtgctcaaaatggttgagccctggctgaagaacaatcagttttgtattaaagtgctgaacccctatatgcctacagtcatcgagcatctcgaacgccttcagagaaagcacggcgggatgctggtgcggaatcccctgtcccgcaacagcacccacgagatgtactggatttctaatggaacaggcaacatcgtgtccagcgtcaatatggtttctagactcctgcttaaccggttcaccatgacatatagacgccctaccattgaaaaagacgtggacctgggggccggaacgcggcatgtgaacgctgagccggaaacacccaatatggatgtcatcggcgagagaatccgccggattaaggaggaacacagctccacctggcattacgacgatgagaacccttataagacctgggcctaccacgggtcttatgaagtgaaagctacaggaagcgcctccagcatgatcaatggcgttgtgaagctcctgacgaaaccctgggacgtcgtgcctaccgttacacaaatggcgatgaccgatacaaccccctttggccagcagagagtgttcaaggagaaagtcgacacacgcaccccgaagcctatgcccgggacgcggaaggccatggaaattaccgctggatggctgtggagaacactcggccgcaacaaacggcctagactgtgcacccgcgaggagtttacaaagaaagtgcggaccaatgccgctatgggggccgttttcacggaagagaaccaatgggattccgccagagcggctgtggaagacgaggaattttggaaacttgtcgatcgcgagagagagctgcacaaacagggaaagtgtggctcttgcgtgtacaatatgatggggaaacgggaaaagaagctcggcgagttcggaaaagccaagggcagccgcgccatctggtacatgtggctgggggctagatatcttgaatttgaggccctgggattcctcaacgaggaccattggttttcccgggaaaattcttacagcggcgtcgagggggaaggactgcacaaactgggctatattctcagagatatctccaagatccccgggggcgctatgtacgccgacgacacagcgggatgggatacccggattacagaggacgatctgcataacgaagagaaaatcacccagcagatggaccctgagcaccgccaacttgccaatgctattttcaagctgacgtatcagaacaaggtggttaaagtgcagagacccaccccgaagggcacagtcatggatatcatttctcggaaagaccagcgcgggagcggacaagtgggcacctacgggctcaatacatttaccaacatggaagtgcagctgatcagacagatggagggagaaggcgttctttccaagacagatctggagaatcctcatctcctggagaagaagatcacccagtggctggagacgaagggggtggagcggctcaaacgcatggccattagcggcgacgattgcgtcgtgaagcccatcgacgatagattcgctaacgccctgcttgcgctgaacgacatgggaaaagttcggaaggatattccccaatggcagccttctaaaggctggcacgactggcaacaggtgccgttctgttcccaccattttcacgaactcatcatgaaggacgggcgcaagctggtcgtgccctgcagacctcaagatgagcttattggacgggcccgcatcagccagggcgctgggtggtctctgaaagaaacagcctgtctcggaaaggcttatgcccagatgtgggctctgatgtacttccatagacgggacctgcgcctcgcctccaatgcgatttgcagcgccgtccccgtgcactgggttcctacctctagaaccacatggtccatccacgctcatcaccaatggatgaccacagaggatatgctgacggtgtggaaccgggtctggatcgaagacaatccctggatggaggataaaacccctgtgacaacctgggaggacgttccctaccttggcaagagagaagatcagtggtgtgggagcctgattggcctcacatcccgcgccacctgggcccagaacatcctgacggctattcagcaagtgcggagccttatcggaaatgaggaatttctggactatatgccgtctatgaaaagattccgcaaggaggaggaaagcgagggcgccatttggtga

SEQ ID NO: 20929 - RNA, 9873 nt, synthetic construct
  misc_feature 1..9873: note = derived and/or modified CDS sequence (opt5) from DENV-3__AY858047__SS-prME
  source 1..9873: mol_type = other RNA
accagcctgtgcctcatgatgatgctgcccgccacccttgctttccacctgacgtccagagacggagagcctcggatgatcgtggggaagaacgaacgcggaaaatctctcctgtttaagaccgccagcggaattaatatgtgtacacttatcgcgatggatctgggggagatgtgcgacgataccgtgacatacaaatgtccgctcattaccgaagttgagcccgaagacatcgattgctggtgtaacctgacatccacctgggtgacgtatggaacctgcaatcaggctggcgagcatagacgggacaagcgctctgtggccctggcccctcacgtcgggatgggactcgatacaagagctcagacctggatgagcgccgagggcgcttggcggcaagtggaaaaagttgagacatgggccttccgccatcccggctttaccattctggcgcttttcctggcccactacatcgggacgtccctcacacagaaggtggtcatctttattctgcttatgctggtgaccccttctatgacaatgagatgtgttggagtgggcaaccgggacttcgtcgaagggctcagcggagctacctgggtggatgtggtcctggagcatggcgggtgcgttaccacaatggccaagaataaacccacgctggacatcgagctccagaagaccgaagctacacaactggccacccttcgcaaactgtgtattgagggaaagatcacaaacgtgaccacggattccagatgccctacacagggcgaagcgattctcccggaggaacaggaccagaattatgtgtgtaaacacacctacgtcgatcggggctgggggaacggatgcggcctgtttgggaagggaagccttgtgacctgcgccaagttccaatgtctggagctcatcgagggcaaagttgtgcagcacgaaaatctgaagtatacagtcattatcaccgtgcatacaggggaccagcaccaggttggaaacgagacgcaaggcgtgaccgctgaaatcacaccccaggcctctaccgtcgaggctattctgcctgaatacggcacactcgggctggagtgctcccccagaaccggacttgactttaatgagatgatcctgctcacgatgaaaaacaaggcctggatggtgcatagacagtggttctttgatctgcctcttccctggaccagcggcgccacaaccgaaacaccgacctggaataaaaaggagctgctcgtcacgttcaaaaacgctcacgcgaagaagcaagaagtggttgtgctggggtctcaggagggagccatgcacacagctctgaccggcgccacagaaattcagacctccgggggcaccagcatctttgccggacatctcaaatgtcggctgaagatggacaaacttgagctgaagggcatgtcttatgctatgtgctccaatgccttcgtcctcaaaaaggaggtgagcgaaacacagcacgggacgattctgatcaaggttgagtacaaaggagaagatgcgccttgtaagatccccttctccaccgaggacggccaagggaaagctcataacggacgcctgattacagccaaccctgtggtcaccaagaaagaggaacccgtgaatatcgaggccgaacccccttttggcgagtctaacattatcattgggatcggcgataaggctcttaagatcaattggtacaaaaagggaagctccattggcaaaatgttcgaagccacagctagaggggcccggagaatggcgatcctcggagacaccgcctgggattttggcagcgtcgggggagttctgaactctctgggcaagatggtccaccagattttcgggtccgcttatacggccctctttagcggcgtgtcttggatcatgaaaattggaatcggcgtgctgcttacatggattgggctgaatagcaagaacacctccatgtctttcagctgcatcgtcatcggaattatcaccctctacctgggcgctgtggttcaggccgacatggggtgtgtgattaattggaagggaaaagagctgaagtgcggctccgggatctttgtcacaaacgaggtgcatacctggacagaacagtataaattccaagcggatagcccgaagcgccttgccacggctattgccggcgcttgggagaatggagtttgtggcatccggtctaccacaagaatggaaaacctcctgtggaaacagatcgccaatgagctgaactacattctctgggaaaataacatcaagctgaccgtggtcgtgggggacattatcggcattcttgagcagggcaaacgcacactgacaccccagcctatggagctcaagtattcctggaagacgtgggggaaagccaagatcgttaccgctgaaatccaaaatagctcttttattatcgatggacccaacacacctgagtgccccaacgcgtcccgggcctggaatgtgtgggaagtcgaggactacggcttcggcgtgtttaccacaaacatttggctgaaactgagagaaatgtatagccagctttgtgaccaccgcctcatgtccgctgccgtgaaggatgagcgggccgtccacgctgacatggggtactggatcgagtctcagaaaaatggaagctggaagctggaaaaggcctccctgattgaggttaaaacctgcacatggccgaagtctcataccctctggagcaacggcgtgctggaatccgatatgatcatccctaaaagccttgcggggcccatttctcagcacaattacagacctggatatcatacgcaaacagctggcccctggcacctggggaagctcgagctggacttcaactactgcgagggaaccaccgtggtcatcacagaaaattgtggcacccgcggcccttccctgcggacgacaaccgtgagcgggaaacttattcacgagtggtgctgtagatcttgcacactgcccccgctgcgctatatgggagaagatggctgttggtacgggatggagatccggcctattaacgaaaaggaggagaatatggttaagtccctggtgagcgccggatctggcaaagtcgacaactttaccatgggggtgctctgcctggccatccttttcgaagaggttatgagaggaaagttcggcaaaaagcatatgattgctggcgtgctgtttacattcgtcctcctgctgagcgggcagatcacctggcgggatatggcccgcacgcttatcatgattggatccaatgcgagcgacagaatgggcatgggggtgacctatctggctctcatcgccacatttaaaattcagcccttcctggccctcggatttttcctgcggaaacttacctctagagaaaacctgctcctgggcgttgggctggctatggccacaacccttcaactgcccgaggatatcgaacagatggctaatggaattgccctcggcctgatggcgctcaagctgatcacgcagtttgagacataccagctttggaccgccctggtgtccctcatgtgtagcaacacaatcttcaccctgaccgtcgcttggcgcacagccacgctgattcttgctggcatctccctgctccctctgtgccaatctagctccatgcggaaaaccgactggctcccgatgacagtggccgccatgggggtgccccctctgcccctttttattttctctctgaaggataccctgaaaagacgcagctggcctctcaatgagggagtcatggctgttggcctggtgtccatccttgcgtctagcctgctcagaaacgacgtgcccatggccgggcctctggtcgctggaggcctcctgattgcctgttatgtgatcacagggacctccgccgatcttacggttgaaaaggctgccgacgtgacatgggaggaagaggcggaacagaccggagtcagccacaacctgatgatcaccgtggacgatgacggcacaatgcggattaaagatgacgagaccgagaatatcctgacagttctcctgaagacggcccttctcattgtgtctggcatctttccctactccattccggctaccctcctggtctggcatacatggcagaaacgcacccagagaagcggggtgctctgggatgtcccttctccccctgaaacacaaaaggccgagctggaagagggagtgtaccggatcaagcagcagggcattcttgggaaaacccaggttggagtgggcgtccaaaaggagggggtgttccacacgatgtggcatgttacccgcggagctgtgctgacatataacggcaaaagactggaacccaattgggcctccgtcaagaaagacctcatcagctacggcgggggatggcggctgtctgcgcagtggcagaagggcgaggaagtgcaagtgatcgctgttgagccggggaagaaccctaaaaattttcagaccatgcccggaattttccagacaaccacaggcgaaatcggggccattgcccttgatttcaagcctggaacgtccggcagccccatcattaaccgcgagggcaaagtcgtggggctgtatggaaatggcgtggtcaccaagaacgggggatacgtgtccggcatcgctcagacaaatgccgagcccgacgggcctaccccggaactcgaggaagagatgtttaaaaagagaaacctgaccatcatggatctccaccccggcagcggaaagacacggaaatatctgcctgctattgttcgcgaagccatcaagagacggcttagaacgctgattctggcgcccacccgcgtggtcgccgctgagatggaggaagccctcaaaggcctgcctatccggtaccaaacaaccgctacaaagtctgagcacaccgggaaagaaattgtggaccttatgtgccatgccacgttcacaatgagactgctcagccccgttcgcgtgcctaattataacctgatcatcatggatgaggcccactttaccgacccggcttccattgcggcccggggatacatctctaccagagtcggcatgggggaagctgccgccattttcatgacagctacaccccctggaacagccgatgcgtttccccagagcaatgctcctatccaggacgaggagcgcgacattcccgaacggtcctggaactctggcaatgattggatcaccgacttcgccgggaagacggtgtggtttgttccgagcattaaggccggcaacgatatcgctaactgtctgcgcaagaatggaaagaaagtgatccagctctcccgcaagacattcgacaccgagtaccagaagacgaaacttaacgattgggactttgtcgtgaccacggatatttctgaaatgggcgccaatttcaaggcggaccgggtgatcgatcctagacggtgcctgaaacccgtcattctgaccgacgggcccgagcgcgttatcctcgccggacctatgcccgtgacagtggctagcgccgctcagagacggggccgcgtcgggagaaaccctcagaaggagaatgatcagtatatttttaccggacaaccgctgaacaatgacgaagaccatgcccactggacagaggctaaaatgcttctggataacatcaatacccccgaaggcatcattcctgccctcttcgagcccgaacgggagaagtccgcggccatcgacggggagtacagactgaaaggcgaaagccgcaagacattcgtggagctgatgcggagaggagatctccctgtttggcttgctcataaagtggcctctgaaggcattaagtataccgaccgcaagtggtgctttgatggggagcggaacaatcagatcctggaagagaacatggacgtcgagatttggacgaaagaaggagagaagaaaaagctgagaccccgctggctcgatgctcggacatactccgacccgctggcccttaaagagttcaaggattttgccgctggcagaaagagcatcgcgctggacctcgtgaccgagatcgggcgcgttccttctcacctggcccacagaacccggaatgctctggataacctcgtgatgcttcatacatccgaacacggaggccgcgcctatagacatgccgtcgaggagctgcccgaaaccatggagacactgctcctgcttggcctgatgattctcctgacagggggagtgatgctgttcctcatcagcggcaaaggggtcggaaagacctccattggccttatctgtgtggttgcttctagcgggatgctgtggatggccgacattcctctgcagtggatcgcgtccgccattgtgctcgaatttttcatgatggtgctgcttatccccgagcctgagaaacagcggacaccccaagataatcagctggcttacgtcgttatcggcattctcaccctggccgctatcgtggccgcgaacgaaatgggcctgctcgagacaaccaagcgcgaccttggcatgagcaaagaaccgggggtggcctctcctacgtcctatctggacgtcgatctgcaccccgctagcgcctggaccctctacgctgtggccacaaccgttattacacccatgctgagacacaccatcgaaaattctacggctaacgtgagccttgccgcgattgccaaccaggctgtcgtgctgatgggactcgacaagggctggcctatctccaagatggatctgggggtcccgctgctcgcccttggatgctactctcaagtgaatcccctgacactgaccgctgccgttctcctgcttgtgacacattatgccatcattggccctgggctgcaggcgaaagctacccgggaagcccagaagagaaccgctgccggaatcatgaaaaaccccacagtcgacggcattatgacgatcgatctcgaccctgtgatttacgatagcaagtttgagaaacagctgggccaagttatgctgctcgtgctttgtgccgtccagctgctgctcatgcgcacctcctgggctttctgcgaggccctgacacttgcgaccgggcccatcacaaccctgtgggaaggatctcctggcaagttttggaatacgacaatcgccgtgagcatggctaacattttccgggggtcctatctcgccggagctggcctggcctttagcatcatgaagtctgtggggaccggaaaaagaggcaccggctcccagggggagacactgggagaaaagtggaaaaagaaactcaatcagcttagccgcaaggagttcgacctgtacaaaaagtccggcattaccgaagttgatcggacagaggcgaaggaggggctgaaaagaggagaaatcacgcaccatgccgtctctcggggcagcgctaagctccaatggtttgtggagcgcaacatggtgattccggaagggagagtcatcgacctgggatgtggccggggcgggtggtcctattactgcgccggacttaaaaaggttaccgaggtgcgcggctatacaaaagggggacccggccacgaagaacctgtgcccatgtctacctacgggtggaatattgtcaagctgatgagcggaaaggatgtgttctacctccctcccgagaaatgtgacacactgctgtgcgatatcggcgaatccagcccgtctcctaccgttgaggaatccagaacgatccgggtgctcaagatggtcgagccctggcttaaaaacaatcagttctgtattaaggtgctgaacccctatatgcctgctgttatcgagcatctggaacgcctccagagaaaacacggcgggatgctggtgcggaatccccttagccgcaactctacccacgagatgtactggatttccaatggaacaggcaacatcgtcagctctgtgaatatggtgagcagactgctcctgaaccggtttaccatgacatatagacgccctaccattgaaaaggacgtcgacctgggggccggaacacggcatgttaacgctgagccggaaacccccaatatggatgtgatcggcgagagaatccgccggattaaggaggaacactcctctacgtggcattacgacgatgagaacccttataaaacatgggcctaccacgggagctatgaagtgaaggcgaccggatccgccagctccatgatcaatggcgtcgtgaaactcctgaccaagccctgggacgttgtgcctacagtcacgcagatggctatgaccgatacaacccccttcggccaacagagagtgtttaaagagaaggttgacacacgcaccccgaagcctatgcccgggacacggaaagtgatggaaattaccgccgagtggctttggagaacgctgggacgcaacaagcggcctagactctgcacccgcgaggagttcaccaaaaaggtccggaccaatgctgccatgggcgccgtgtttacagaggaaaaccagtgggattctgcgaaagctgccgttgaggacgaagagttctggaagctggtggatagagagcgcgaacttcacaaactggggaagtgtggaagctgcgtctacaatatgatgggcaagagagagaaaaagctcggggaatttggcaaagccaagggatcccgggctatctggtacatgtggctgggcgcccgctatctggagttcgaggctctcgggtttctgaacgaagaccattggttctctagagagaatagctactccggagtggaaggcgaggggcttcacaaactgggatatattctccgggatatctctaagatccccggcggggccatgtacgcggacgacaccgccggctgggatacgagaattacagaagacgatctgcataacgaggagaagatcacccaacagatggaccctgaacaccggcagcttgctaatgccatttttaaactgacatatcagaacaaggtcgtgaaagttcaacgccccaccccgaagggaacggtgatggatatcattagcagaaaagaccagcggggctccgggcaggtcggaacctacggcctcaatacattcaccaacatggaggctcagctgatccgccaaatggaaggggagggagtgctgagcaagacagatctcgaaaatcctcatctgcttgagaagaaaatcacccagtggctggagacaaagggcgtggaaagactcaaacggatggccatttctggggacgattgcgttgtgaagcccatcgacgatcgctttgcgaacgccctgcttgctctgaacgacatgggcaaagtcagaaaggatattccccagtggcagccttccaagggatggcacgactggcaacaggtgccgttctgtagccaccatttccacgagctcatcatgaaagacggccggaagctggttgtgccctgccgccctcaggatgaactgattgggagagcccggatctctcagggagctggctggtccctcaaagagaccgcctgtctggggaaggcttatgcccaaatgtgggcgcttatgtactttcatcgcagagacctgcggctcgccagcaatgctatttgctctgccgtccccgtgcactgggtccctacgtcccgcacaacctggagcatccacgcccatcaccagtggatgaccacagaagatatgctgatcgtgtggaacagagtttggattgaggacaatccctggatggaggataaaacccctgtgacaacgtgggaagacgtcccctaccttggaaagcgggaggatcagtggtgtggctccctgatcgggctcaccagcagagctacatgggcccaaaacattctgaccgcgatccaacaggtgcgctctctgattggcaatgaagagttcctcgactatatgccgagcatgaagcggtttagaaaagaggaagagtccgaaggagctatctggtga

SEQ ID NO: 20930 - RNA, 9873 nt, synthetic construct
  misc_feature 1..9873: note = derived and/or modified CDS sequence (opt5) from DENV-3__HQ332170__SS-prME
  source 1..9873: mol_type = other RNA
acaagcctctgcctcatgatgatcctgcccgccgctcttgccttccacctgacatcccgggacggcgaacctcggatgattgtggggaagaacgaacgcggaaagtctctcctgtttaagacggcgagcggcatcaatatgtgtacccttattgctatggatctgggggaaatgtgcgacgatacagtgacctacaaatgtccgcatatcacagaagttgaacccgaagacattgattgctggtgtaacctcacctccacatgggtgacctatggaacgtgcaatcaggccggcgaacaccggcgggacaagcgctctgtggccctggctcctcatgtcgggatgggactggatacccggacacagacctggatgagcgccgagggcgcttggagacaggtggaaaaagttgagacatgggccctccgccaccccggcttcaccatcctggcgctttttctggcccattacatcgggacgtccctcacacagaaggtggtcattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacaactggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctaccacagaggctatcctgcccgaatatggcaccctggggctcgagtgctcccctcgcacgggactggacttcaatgagatgattcttctgaccatgaaaaacaaggcctggatggtccatagacagtggtttttcgatctccccctgccgtggacaagcggcgccaccacagaaacccctacgtggaatcggaaagagcttctggtgacatttaagaacgctcacgcgaaaaagcaagaagtcgtggttctcgggtctcaggagggagccatgcacaccgctctgacaggcgccaccgaaatccaaaattccgggggcaccagcattttcgccggacatctgaagtgtcgcctcaaaatggacaagctggagcttaaaggcatgtcttacgctatgtgcacaaacacgtttgtgctgaagaaagaggtctccgaaacccagcacgggacaatcctcatcaaggtggattacaagggagaggacgttccctgtaaaattcctttcagcaccgaagatggccaagggaaggcccataacggaagactgatcacagcgaatcccgtggtcaccaaaaaggaggagcccgtgaacattgaagctgagcctccgttcggcgaatccaatatcgtgattgggatcggcgacaacgccctgaaaatcaattggtataagaagggatctagcattggcaaaatgtttgaggccacggctagaggggccagacgcatggctatccttggagatacagcctgggacttcggctccgttgggggagtcctcaacagcctgggcaagatggtgcaccagatttttgggtctgcgtacaccgccctgttctccggcgtgagctgggtcatgaaaatcggaattggcgtgctcctgacctggatcgggcttaattctaagaacacaagcatgtccttttcttgcattgctatcggaatcattaccctgtatctcggcgccgttgtgcaggctgatacagggtgtgtcatcaattggaaaggaaaggaactgaagtgcggcagcgggattttcgtgacgaacgaggttcatacctggacagagcagtacaaatttcaagccgactcccccaagcggctggcgaccgccatcgctggcgcctgggaaaatggagtgtgtggcattagaagcacaacccgcatggagaaccttctctggaaacagatcgctaatgaactgaactatatcctgtgggagaataacattaagctcacggtcgtggttggggatatcattggagtgctggaacagggcaaacggacccttacacctcagcccatggagctgaagtactcttggaaaacctgggggaaggccaagatcgtcacagccgagacccaaaactccagcttcattatcgacggacctaatacacccgaatgcccgtctgcttccagagcgtggaacgtgtgggaggtggaagactatggctttggcgtcttcaccacgaatatctggctcaaactgcgcgaggtttacacacagcagtgtgatcaccggctgatgagcgccgctgtgaaggacgaaagagccgtgcacgccgatatggggtactggattgagtcccagaaaaacggatcttggaaacttgagaaagctagcctcatcgaagtcaagacctgcacctggcctaagtcccatacactgtggtctaatggcgtgctggagagcgacatgattatccccaaatccctcgccgggcctattagccaacacaactatcgccccggataccatacccagacggcgggcccttggcacctggggaaacttgaactggattttaattattgcgagggaacaaccgttgtgatcacagagaactgtggcacccggggcccctctctcagaacaaccacggtctccgggaaactgatccacgaatggtgctgtcgcagctgcaccctgccgcctcttcggtacatgggagaggacggctgttggtatgggatggaaattagacccatctctgagaaggaagagaatatggtgaaatccctcgttagcgctggatctggcgaggtggataacttcacaatgggggtcctgtgcctggccattctctttgaagaggtgatgcggggaaagttcggcaagaaacatatgatcgccggcgttttctttaccttcgtgctgcttctgagcgggcagattacatggcgcgacatggctcacaccctcatcatgattggatccaatgccagcgatagaatgggcatgggggtcacgtacctggcgctgatcgctacatttaagatccaacccttccttgccctgggatttttcctccggaaactgacctctagagaaaacctcctgcttggcgtggggctggccatggctacaaccctccagctgcctgaggacattgaacagatggccaatggaatcgctctgggccttatggccctgaagctcattacccagtttgagacatatcaactgtggacggcgctcatctccctgacctgtagcaacacaattttcacccttacagtggcctggcgcaccgctacgctgatcctcgccggcgtctccctgctgccggtttgccagtctagctccatgcggaaaacagattggcttcccatgaccgtggctgccatgggggtgcctcccctgcctctctttatcttctctctgaaggacaccctcaagagacgcagctggcccctgaatgagggagtcatggccgtgggccttgtttccattctggcttctagcctgctcagaaacgatgtgcctatggcggggcccctggtcgccggaggccttctgatcgcttgttacgtgattacagggacctccgccgacctcacagttgaaaaagccgctgacgtgacgtgggaggaagaggccgaacagaccggagtcagccataacctgatgatcacagtggatgacgatggcaccatgcggattaaggacgatgagacagagaatatcctcaccgtcctgcttaaaacggcgctgctgatcgtgtctggcatttttccgtactccatccctgctaccctcctggtttggcacacatggcagaagcaaacccagcgcagcggggtgctttgggacgtcccctctcctcccgaaacacagaaagccgagctggaagagggagtgtatagaattaagcagcaaggcatcttcgggaaaacccaggttggagtgggcgtccagaaggagggggtgtttcatacaatgtggcacgtgacgcggggagccgttctcacctacaacggcaagcgcctggaaccgaattgggcttccgtcaaaaaggatctcattagctatggcgggggatggagactgtctgcccaatggcagaaaggcgaggaagtccaggtgatcgcggtcgagcctgggaagaaccccaaaaatttccagacaatgcctggaaccttccaaaccacaacgggcgaaattggggctatcgcccttgactttaagcccggaacctccggcagccccatcattaaccgggagggcaaggtggttgggctgtacggaaatggcgtggtcaccaagaacgggggatatgtgtccggcatcgcccagaccaatgctgagcctgatgggccgacacccgaactggaggaagagatgttcaagaaacgcaacctcaccattatggacctgcaccctggcagcggaaagacgagaaaataccttcccgccatcgttcgggaagctattaagcgcagactgcggacactcatcctggcccctaccagagtggtcgcggccgagatggaggaagctctcaagggcctgcccatccgctatcagaccacagccaccaaatctgagcatacagggcgggaaattgtggatcttatgtgccacgctacctttacgatgagactgctgagccctgttcgcgtgccgaattacaacctcatcattatggacgaggcccatttcacagatcccgcctccatcgctgcgcggggatacatttctaccagagtcggcatgggggaagccgctgccatctttatgacagccacccctcccggaacggctgacgccttccctcagagcaatgcgcccatccaagacgaggagcgcgatattccggaacggtcctggaactctggcaatgagtggatcaccgactttgctgggaagacagtgtggttcgtgcctagcattaaagccggcaacgatatcgccaactgtctgagaaagaatggcaaaaaggtcattcagctttcccgcaagacctttgacacagaatatcagaaaaccaagctgaacgattgggacttcgttgtgacaaccgatatctctgagatgggagctaattttaaagccgaccgggtgattgatcccagacggtgcctcaagcccgtcatcctgacggacgggcctgagcgcgtgatcctggcgggacccatgcctgttacagccgctagcgccgctcagagacggggccgcgtggggagaaacccgcaaaaagaaaatgatcagtacattttcaccggacagcccctcaacaatgacgaggaccacgcccattggaccgaagctaagatgcttctggataacatcaatacacctgagggcattatccccgccctgttcgaacctgagcgggagaagtccgcggccattgacggggaatatagactcaaaggcgagagccgcaagacctttgtcgaactgatgcggagaggagatcttcccgtgtggctggctcacaaagttgcctctgagggcatcaagtacacagaccgcaaatggtgcttcgatgggcagcggaacaatcaaatcctcgaagagaacatggacgtggagatttggacgaaggaaggagagaaaaagaagctgagaccgcgctggctggatgctcggacctattccgaccctctcgcccttaaagaatttaaggatttcgccgctggcagaaaaagcatcgcgctggacctggtcacagagattgggcgcgtgccctctcacctcgcccatagaacccggaatgctctggataaccttgtcatgctgcacacatccgaacatggaggcaaggcctaccgccacgccgtggaggagctccctgaaaccatggagacgctgctgctccttggcctgatgatcctgctcaccgggggagctatgctgtttcttattagcggcaaagggatcggaaagacatccatcggcctgatttgtgttatcgcctctagcgggatgctctggatggcggaaattcccctgcagtggatcgcctccgctattgtgctggagttctttatgatggtgctccttatccctgagcccgaaaagcagagaaccccgcaagacaatcagctggcctatgtcgttattggaatcctgacactcgctgccatcattgcggccaacgagatgggcctgcttgaaaccacgaaacgggatctgggcatgagcaaggagcctggggtggtgtctcccacatcctacctcgacgtcgacctgcaccccgctagcgcctggaccctgtacgctgtggccacaaccgttatcacccctatgctccgccatacaattgaaaattctacggctaacgtgagccttgccgcgatcgccaaccaggctgtcgtgctgatgggactggataaaggctggccgatttccaagatggacctcggggtccccctgcttgccctgggatgctattctcaggtgaatcctctcaccctgacagctgccgttctgctccttatcacccactacgccatcattggccccgggctgcaagcgaaagctacaagagaggcccagaagcggaccgctgccggaatcatgaagaaccctacggtggatggcattatgacaatcgacctggatcccgtcatttatgacagcaaattcgagaagcagctcggccaggtgatgctgcttgttctgtgtgccgtgcaactcctgctgatgagaacctcctgggctctctgcgaagcccttaccctggcgacagggcctatcaccacactgtgggagggatctccgggcaaattttggaatacgaccatcgccgtcagcatggctaacattttccgcgggtcctacctcgccggagctggcctggcctttagcatcatgaagtctgtggggacaggaaaacggggcaccggctcccagggggaaacacttggagagaagtggaagaaaaagctgaatcagctcagcagaaaagagttcgatctgtataagaaatccggcattaccgaggtggaccgcacggaggcgaaggaagggctgaaacggggagagatcacccatcacgccgtttctagaggcagcgctaagctccagtggtttgtcgaacggtccatggtgattcccgaggggcgcgtgatcgatcttggatgtggcagaggcgggtggtcttactattgcgccggactgaagaaagtcacagaagttcggggctacaccaaagggggacctggccatgaggagcccgtgcctatgagcacatacgggtggaacattgtgaaactgatgtccggaaaggacgtcttctatctgcccccggaaaaatgtgataccctgctttgcgacatcggcgagagctctccttcccccacagtggaagagagccgcaccatcagagttctgaagatggtggagccctggctcaagaataaccaattctgtattaaagtcctgaatccttacatgcccacggtgatcgaacacctggagcggctccagcgcaagcacggcgggatgcttgttagaaaccctctgtctagaaattccacacatgaaatgtattggattagcaacggaaccggcaatatcgtggcttctgtcaacatggtgagccgcctgctcctgaatagatttaccatgacacaccggagaccgacgattgagaaagatgtggaccttggggccggaacccgccatgtcaacgctgaacccgagacacctaacatggacgttatcggcgagcggatcaagagaattaaagaagaacacaattccacctggcactacgatgacgaaaacccctataagacatgggcctaccatgggtcttatgaggtgaaggcgaccggaagcgcctccagcatgatcaatggcgtggtcaaactgctcacaaagccttgggatgtggttcccatggtgacccagatggctatgacggacaccacaccgttcggccaacagcgcgtctttaaagaaaaggtggatacccggacacctagatccatgcccgggacccgccgggttatgggaattacggccgagtggctgtggagaacactgggccgcaacaaaaagcctcggctctgcaccagagaggagttcacaaagaaagtgcgcaccaatgctgccatgggggccgtctttacggaggaaaaccagtgggactctgcgaaggctgccgtggaggatgaagacttctggaaactggttgatcgggagagagagcttcacaagctgggaaaatgtggcagctgcgtgtacaatatgatggggaagcgcgagaagaagctcggcgagtttggaaaggccaaaggctccagagctatctggtacatgtggctgggggcccggtatcttgagttcgaggctctgggatttctcaacgaggaccattggttctctcgcgaaaatagctactccggcgtcgagggggaaggactgcacaagctgggctatattctcagagatatctctaaaatccccgggggcgccatgtacgcggacgacaccgccggatgggatacacggattaccgaggacgatctgcataacgaagagaagatcacacagcaaatggaccctgagcacaaacagcttgctaatgccatttttaagctgacctatcagaacaaggtggtcaaagtgcagagacccacaccgaccggcacggttatggatatcattagccggaaggaccaacgcgggtccggacaggtgggcacatacgggctcaataccttcaccaacatggaagctcagctgatcagacagatggagggagaaggcgtccttagcaaagccgatctggagaatcctcacctccccgaaaagaaaatcacacaatggctggagaccaagggggtggagcggctgaagcgcatggcgatttctggcgacgattgcgtggttaaacccatcgacgatagatttgccaacgctctcctggcccttaacgacatgggaaaggtgcggaaagatattcctcagtggcagccgtccaagggctggcatgactggcagcaagtccccttctgtagccaccatttccacgaactgatcatgaaagacgggcgcaagctcgtggttccttgcagaccccaggatgagctgattggacgggctcgcatctctcagggcgccgggtggtcccttagagaaacagcttgtctgggaaaggcctatgcgcaaatgtggagcctcatgtactttcaccggcgcgacctgagactggcctctaatgctatttgctccgccgtgcctgtccattgggtgcccacgagccggaccacatggtccatccacgcccatcaccagtggatgaccacagaggatatgctcaccgtctggaaccgcgtgtggatcgaagacaatccttggatggaggataaaacgcccgttaccacatgggagaacgtgccgtacctgggcaagagagaagaccagtggtgtgggagccttattggcctgacctctcgggctacatgggcccagaatatccctaccgcgattcaacaggtcagaagcctcatcggaaacgaggagttcctggattatatgccctccatgaaacgctttcggaaggaggaggaatctgagggcgctatttggtga

SEQ ID NO: 20931 - RNA, 9873 nt, synthetic construct
  misc_feature 1..9873: note = derived and/or modified CDS sequence (opt5) from DENV-3__AY858038__SS-prME
  source 1..9873: mol_type = other RNA
accagcctgtgcctcatgatgatgctgcccgccacccttgctttccacctgacgtcccgggacggagagcctcggatgatcgtggggaagaacgaaagaggaaagtctctcctgtttaagaccgccagcggcattaatatgtgtacacttatcgcgatggatctgggggagatgtgcgacgataccgtcacatacaaatgtccgctcattaccgaagttgagcccgaagacatcgattgctggtgtaacctgacatccacctgggtgacgtatggaacctgcaatcaggctggcgagcacagacgggacaagcgctctgtggccctggcccctcacgtcgggatgggactcgatacaagaacccagacatggatgagcgctgagggcgcctggagacaggtggaaaaagttgagacctgggctttccgccatcccggctttacgattctggcccttttcctggcgcactacatcgggacatccctcacccagaaggtggtcatctttattctgcttatgctggtgacaccttctatgaccatgagatgtgttggagtgggcaaccgggacttcgtcgaagggctcagcggagccacctgggtggatgtggtcctggagcatggcgggtgcgttacaacgatggctaagaataaacccaccctggacatcgagctccagaagacagaagccacccaactggctacacttcgcaaactgtgtattgagggaaagatcaccaacgtgacgacagattccagatgccctacccagggcgaagccattctcccggaggaacaggaccagaattatgtgtgtaaacacacctacgtcgatcggggctgggggaacggatgcggcctgtttgggaagggaagccttgtgacatgcgcgaagttccaatgtctggagtctatcgagggcaaagttgtgcagcacgaaaatctcaagtataccgtcattatcacagtgcatacgggggaccagcaccaggttggaaacgagacccaaggcgtgacagccgaaatcacaccccaggcttccacagtcgaggccattctgcctgaatacggcaccctggggctcgagtgcagcccccgcacgggactggactttaatgagatgatccttctgaccatgaaaaacaaggcttggatggtgcatagacagtggttctttgatctccctctgccctggacatctggcgccaccacagaaaccccgacgtggaataaaaaggagcttctggtcacattcaaaaacgcccacgctaagaagcaagaagtggttgtgctcgggtcccaggagggagcgatgcacaccgccctgacaggcgctaccgaaattcagaccagcgggggcacatctatctttgccggacatctgaaatgtcggctcaagatggacaaactggagcttaagggcatgtcctatgccatgtgcctgaatgctttcgtcctcaaaaaggaggtgagcgaaacgcagcacgggaccattctgatcaaggttgagtacaaaggagaagatgccccttgtaagatccccttctccacagaggacggccaagggaaagcgcataacggacgcctgattaccgctaaccctgtggtcacaaagaaagaggaacccgtgaatatcgaggccgaacccccttttggcgagtctaacattgtgatcgggattggcgataaggcccttaagatcaattggtacaaaaagggaagctccatcggcaaaatgttcgaagctaccgccagaggggctcggagaatggccattctcggagacacggcgtgggattttggcagcgttgggggagtcctgaactctctgggcaagatggtgcaccagatcttcgggtccgcctatacagctctctttagcggcgtgtcttggattatgaaaatcggaattggcgtcctgcttacctggatcgggctgaatagcaagaacacctccatgtctttcagctgcattgccatcggaatcattacactctacctgggcgctgtggttcaggccgacatggggtgtgtgatcaattggaagggaaaagagctgaagtgcggctccgggatttttgtcaccaacgaggtgcatacatggacggaacagtataaattccaagcggatagcccgaagcgccttgccaccgctatcgccggcgcttgggagaatggagtttgtggcattcggtctacaaccagaatggaaaacctcctgtggaaacagatcgccaatgagctgaactacatcctctgggaaaataacattcgcctgacagtggtcgtgggggacaccatcggagttcttcagcagggcaagcggacgctgccccctcaacccatggagctcaaatattcctggaagacctgggggaaggccaaaattgtgacagctaagacccagaatagctcttttatcattgatggacctaacacacccgagtggccgtccgcgagcagagcctggaacgtctgggaagtggaggactacggcttcggcgtgtttaccacaaatatctggctgaaactgcgcgaaatgtatacccagctttgcgaccaccggctcatgtccgctgccgtcaaggatgagagagccgttcacgctgacatggggtactggatcgaatctcagaaaaacggaagctggaagctggagaaggcctccctgattgaggtgaaaacgtgtacatggcctaagtctcataccctctggagcaatggcgtgctggaatccgatatgatcattcccaaaagccttgcggggcctatctctcaacacaactaccgccccggatatcatacccagacagctggcccttggcacctggggaagctcgagctggacttcaattactgcgaaggaaccacggtcgtgattacagagaactgcggcacccggggcccctccctgagaacaaccacagttagcgggaaacttatccacgagtggtgttgccgctcttgtaccctcccgcctctgcggtatatgggagaagatggctgctggtacgggatggagatcagacccattaatgaaaaggaggaaaacatggtgaagtccctggtcagcgccggatctggcaaagtggacaattttacgatgggggttctctgtctggccatccttttcgaggaggtgatgcggggaaagttcggcaaaaagcatatgattgctggcgtcctgtttaccttcgtgctcctgctgagcgggcagatcacatggcgcgatatggccagaacccttattatgatcggatccaacgcgagcgaccggatgggcatgggggttacatatctggctctcattgccacctttaaaatccaacccttcctggccctcggatttttcctgagaaaacttacgtctcgcgaaaatctgctcctgggcgtggggctggctatggccacaacccttcagctgcctgaggatatcgaacagatggctaacggaattgccctcggcctgatggcgctcaagctggtcacacagtttgagacctaccaactttggaccgccctggtgtccctcatgtgcagcaatacaatcttcacgctgaccgtggcttggcggacagccaccctgattcttgctggcatctccctgctcccggtctgtcagtctagctccatgagaaaaacagactggctgcccatgaccgttgccgccatgggggtgcctcccctccctctgtttattttctctcttaaggatacgctgaaacgcagaagctggcccctgaacgaaggagtgatggctgtcggcctcgtgtccatcctggcgtctagccttctgcggaatgacgttcctatggccgggcccctcgtggctggaggcctgctcatcgcctgctatgtcattacagggacctccgccgatctgaccgtggagaaggctgccgacgttatctgggaggaagaggcggaacagacaggagtgagccacaaccttatgattaccgtcgacgatgacggcacaatgcgcatcaaagatgacgagacggaaaacattctgaccgtgctgctcaagacagctctgcttatcgtctctggcatctttccgtactccattcctgccaccctgctcgtgtggcatacatggcagaaacaaacccagagaagcggggttctgtgggatgtgccctctcctcccgagacgcagaaggccgagctcgaagagggagtctaccggatcaagcagcaaggcattttcgggaaaacccaggtgggagttggcgtgcagaaggaaggggtctttcacacaatgtggcatgtgacccgcggagctgtgctgacacacaatggcaaaagacttgagccgaactgggcctccgttaagaaagacctgatcagctatggcgggggatggcggctgtctgcgcaatggcagaagggcgaggaagtccaggtgattgctgtggagcctgggaagaatcccaaaaacttccagaccatgcctggaatcttccaaacaacgaccggcgaaattggggccatcgccctcgattttaagcccggaacatccggcagccccatcattaatcgcgagggcaaagtcgtggggctgtacggaaacggcgttgtgaccaagaatgggggatatgtctccggcatcgctcagaccaacgccgaacctgacgggccgacacccgagcttgaggaagagatgttcaaaaagagaaatctgacgattatggatctccaccctggcagcggaaagacccggaaatacctgcccgctatcattcgcgaagccatcaagagacggctcagaacactgatccttgcgcctacccgcgtggttgccgctgagatggaagaggccctgaaaggcctgcccattcggtatcagacaaccgctacgaagtctgagcatacagggaaagaaatcgtggacctcatgtgtcacgccacctttaccatgagactgcttagccctgtccgcgtgccgaactacaatctgattatcatggatgaggcccatttcacagaccccgcttccattgcggcccggggatatatctctaccagagttggcatgggggaagctgccgccatctttatgacagctacccctcccggaacggccgatgcgttccctcagagcaacgctcccattcaagacgaggaacgcgacatcccggagcggtcctggaactctggcaacgattggattacagactttgccgggaagaccgtgtggttcgtccctagcatcaaggccggcaatgatattgctaactgcctccgcaagaatggaaagaaagtgatccagctgtcccgcaagacatttgacaccgagtaccagcggacgaaactgaatgattgggacttcgtggtcaccacagatatttctgaaatgggcgccaactttaaggcggacagagttatcgatccccggcgctgtctcaagcccgtgatccttaccgacgggcctgagagagtgattctggccggacccatgcctgtcacagtggctagcgccgctcagcggcgcggcagagttgggcggaatccgcaaaaagaaaacgatcagtacatcttcaccggacagcccctgaataacgacgaggaccacgcccattggacagaggctaagatgctcctggataatattaacacccctgaaggcatcattcccgcccttttcgagcctgaaagagagaaatccgcggccatcgacggggaatatcgcctgaagggcgagagccggaaaacgtttgtggagctcatgagacgcggagatctgcccgtctggctggctcacaaggtggcctctgaaggcatcaaatacacagaccggaagtggtgcttcgatggggagagaaataaccagattctcgaagagaatatggacgttgaaatctggaccaaggagggagagaaaaagaaacttcgcccgcggtggctggatgctagaacctattccgaccctctggccctcaaggaatttaaagatttcgccgctggccgcaagagcattgcgctggaccttgtgacagagatcgggagagtcccctctcacctggcccatcggacccgcaacgctctcgataatctggtgatgctgcacacatccgaacatggaggcagagcctaccggcacgccgtcgaggaactccctgagacgatggagacccttctgctgctcggcctgatgattcttctgacagggggagctatgctctttctgatcagcggcaaggggatcggaaaaacctccattggcctgatctgcgtggttgcctctagcgggatgctctggatggcggacgtgccccttcaatggattgcctccgctatcgtgctggagttctttatgatggtcctgctcattcctgagcccgaaaagcagcgcacaccgcaggataaccaactggcctatgttgtgatcggcattcttaccctggctgccatcgtggcggccaatgagatgggcctcctggagacgaccaaaagagacctgggcatgagcaaggaacctggggtcgtgtctcccacatcctacctcgacgttgatcttcaccccgctagcgcctggaccctgtatgctgtggccacaaccgtcatcacgcctatgctgcggcatacaattgagaactctaccgctaatgtgagcctcgccgcgatcgccaaccaggctgtcgtgctgatgggacttgacaaaggctggccgatttccaagatggatctgggggttcccctcctggccctgggatgttactctcaggtgaaccctctcacacttaccgctgccgtcctgctgctcgtgacccactacgccatcattggccccgggctgcaggcgaaggctacaagagaagcccaaaaacgcacggctgccggaatcatgaagaatcctaccgttgacggcatcatgacaattgatcttgaccccgtgatctatgatagcaaattcgagaagcagctgggccaggtcatgctcctggtgctgtgcgccgtgcagctccttctgatgcggacctcctgggctttttgtgaagccctgacactcgcgaccgggcctattacgacactgtgggagggatctccgggcaaattctggaacaccaccatcgccgttagcatggctaatatttttagagggtcctaccttgccggagctggcctggccttcagcatcatgaagtctgtcgggacaggaaagcgcggcaccggctcccaaggggagacactcggagaaaaatggaagaaaaagctgaaccagctgagccggaaagagtttgacctctataagaaatccggcatcacggaagtggatagaaccgaggcgaaggaagggcttaagcggggagagattacacatcacgccgtgtctcgcggcagcgctaaactgcagtggttcgtcgagagaaatatggttatccccgaagggcgggtgattgacctgggatgcggccgcggcgggtggtcctactattgtgccggactcaagaaagtgaccgaggtcagaggctacacaaaagggggacctggccatgaagaacccgtgcctatgtctacctatgggtggaacatcgttaaactgatgagcggaaaggatgtgttctaccttcccccggaaaagtgcgacacgctgctctgtgatattggcgagtccagcccttctcccaccgtcgaggaatcccggacaatccgcgtgctgaaaatggttgagccctggctgaagaataaccagttttgcattaaagtgctcaatccttacatgcccaccgtcatcgaacaccttgagagactgcaacggaagcacggcgggatgctggtgcgcaaccctctcagcagaaattctacacatgagatgtattggatctccaacggaaccggcaatattgtgagctctgtcaacatggttagccggctgcttctgaatagattcacaatgacccaccgccggccgacgatcgaaaaagacgtggacctcggggctggaacaagacatgtgaacgccgagcccgaaacccctaacatggatgtcattggcgagcgcatccggagaattaaggaagaacactcctctacctggcactacgacgatgagaatccctataagacatgggcttaccatgggagctatgaagtgaaagccacgggatccgcgagctccatgatcaacggcgttgtgaagctgctgaccaaaccttgggacgtcgtgcccacagttacccagatggccatgacagataccacaccgtttggccagcaacgcgtgttcaaggagaaagtcgacacccggacgcctagacccatgcctgggacccgcaaggtgatggaaatcacagctgagtggctctggcggaccctgggaagaaataagcgcccccggctttgtacaagagaagagtttaccaaaaaggttcgcacgaacgccgctatgggcgccgtgttcacagaggaaaatcagtgggattctgccagagcggctgtcgaggacgaagagttttggaaactggtggatcgggaacgcgagctccacaagctggggaaatgcggaagctgtgtctacaacatgatgggcaagagagagaagaaacttggggagttcggcaaagccaaaggatcccgggccatttggtatatgtggctgggcgctagatacctcgagtttgaagccctggggttcctgaatgaggaccattggttttctcgggagaacagctactccggagtggaaggcgaggggctccacaagctgggatatatccttcgcgatatttctaaaatccctggcggggctatgtacgccgacgacaccgcgggctgggatacaagaattaccgaagacgatctgcataatgaggaaaagatcacgcagcagatggaccccgagcaccggcaactcgccaacgctatcttcaaactgacctatcagaataaggttgtgaaggtccagcgcccgacacctaaaggaaccgtgatggatattatcagcagaaaggaccagcggggctccgggcaagtgggaacatacggccttaacacctttacaaatatggaggcccagctgattcgccagatggaaggggagggagttctcagcaaagctgatctggaaaacccccatctgctcgagaagaaaatcacccagtggctggaaacgaagggcgtggagagacttaagcggatggccatttctggggacgattgcgtcgtgaaacccatcgacgatcgcttcgcgaatgccctgctcgctctgaacgacatgggcaaggttagaaaagatatccctcaatggcagccgtccaagggatggcatgactggcaacaggtgcccttctgcagccaccattttcacgagcttattatgaaagacggccggaagctggtcgtgccttgtcgcccccaagatgaactcatcgggagagcccggatttctcagggagctggctggtccctgaaggagacagcctgcctggggaaggcttatgcccagatgtgggcgctcatgtacttccaccgcagagacctgcggcttgccagcaacgctatctgttctgccgtccctgtgcattgggttcccacctccagaaccacatggagcattcacgcccatcaccaatggatgaccacagaagatatgctgacggtgtggaatcgcgtctggatcgaggacaacccttggatggaagataagacccccgtgacaacctgggaggacgttccgtatctcggaaaacgggaggatcagtggtgcggctccctgattgggcttacaagcagagctacctgggcccagaatatcctgacggcgatccagcaagtgcgctctctcattggcaacgaagagtttctggactacatgcctagcatgaagcggttcagaaaagaagaggagtccgaaggagctatctggtga

SEQ ID NO: 20932 - RNA, 9873 nt, synthetic construct
  misc_feature 1..9873: note = derived and/or modified CDS sequence (opt5) from DENV-3__AY858039__SS-prME
  source 1..9873: mol_type = other RNA
acctccctgtgcctcatgatgatgctgcccgccacccttgctttccacctgacgtccagagacggcgagcctcggatgatcgtggggaagaacgaacgcggaaaatctctcctgtttaagaccgccagcggcattaatatgtgtacacttatcgcgatggatctgggggagatgtgcgacgataccgtgacatacaaatgtccgctcattaccgaagttgagcccgaagacatcgattgctggtgtaacctgacatccacctgggtgacgtatggaacctgcaatcaggctggcgagcatagacgggacaagcgctctgtggccctggcccctcacgtcgggatgggactcgatacaagagctcaaacctggatgagcgccgagggcgcttggcggcaagtggaaaaagttgagacatgggccttccgccatcccggctttaccattctggcgcttttcctggcccactacatcgggacgtccctcacacagaaggtggtcatctttattctgcttatgctggtgaccccttctatgacaatgagatgtgttggagtgggcaaccgggacttcgtcgaagggctcagcggagctacctgggtggatgtggtcctggagcatggcgggtgcgttaccacaatggccaagaataaacccacgctggacatcgagctccagaagaccgaagctacacaactggccacccttcgcaaactgtgtattgagggaaagatcacaaacgtgaccacggattccagatgccctacacagggcgaagcgattctcccggaggaacaggaccagaattatgtgtgtaaacacacctacgtcgatcggggctgggggaacggatgcggcctgtttgggaagggaagccttgtgacctgcgccaagttccaatgtctggagctcatcgagggcaaagttgtgcagcacgaaaatctgaagtatacagtcattatcaccgtgcatacaggggaccagcaccaggttggaaacgagacgcaaggcgtgaccgctgaaatcacaccccaggcctctaccgtcgaggctattctgcctgaatacggcacactcgggctggagtgctcccccagaaccggacttgactttaatgagatgatcctgctcacgatgaaaaacaaggcctggatggtgcatagacagtggttctttgatctgcctcttccctggaccagcggcgccacaaccgaaacaccgacctggaataaaaaggagctgctcgtcacgttcaaaaacgctcacgcgaagaagcaagaagtggttgtgctggggtctcaggagggagccatgcacacagctctgaccggcgccacagaaattcagacctccgggggcaccagcatctttgccggacatctcaaatgtcggctgaagatggacaaacttgagctgaagggcatgtcttatgctatgtgctccaatgccttcgtcctcaaaaaggaggtgagcgaaacacagcacgggacgattctgatcaaggttgagtacaaaggagaagatgcgccttgtaagatccccttctccaccgaggacggccaagggaaagctcataacggacgcctgattacagccaaccctgtggtcaccaagaaagaggaacccgtgaatatcgaggccgaacccccttttggcgagtctaacattatcattgggatcggcgataaggctcttaagatcaattggtacaaaaagggaagctccattggcaaaatgttcgaagccacagctagaggggcccggagaatggcgatcctcggagacaccgcctgggattttggcagcgtcggaggggttctgaactctctgggcaagatggtccaccagattttcgggtccgcttatacggccctctttagcggcgtgtcttggatcatgaaaattggaatcggcgtgctgcttacatggattgggctgaatagcaagaacacctccatgtctttcagctgcatcgtcatcggaattatcaccctctacctgggcgctgtggttcaggccgacatggggtgtgtgattaattggaagggaaaagagctgaagtgcggctccgggatctttgtcacaaacgaggtgcatacctggacagaacagtataaattccaagcggatagcccgaagcgccttgccacggctattgccggcgcttgggagaatggagtttgtggcatccggtctaccacaagaatggaaaacctcctgtggaaacagatcgccaatgagctgaactacattctctgggaaaataacatcaagctgaccgtggtcgtgggggacattatcggagttcttgagcagggcaaacgcacactgacaccccagcctatggagctcaagtattcctggaagacgtgggggaaagccaagattgtgaccgctgaaatccaaaatagctcttttatcattgatggacccaacacacctgagtgccccaacgcgtcccgggcctggaatgtctgggaagtggaggactacggcttcggcgtgtttaccacaaacatctggctgaaactgagagaaatgtatacccagctttgtgaccaccgcctcatgagcgctgccgtcaaggatgagcgggccgttcacgctgacatggggtactggattgagtcccagaaaaatggatcttggaagctggaaaaggccagcctgatcgaggtgaaaacatgcacctggccgaagtcccatacgctctggtctaacggcgtgctggaaagcgatatgattatccctaaatcccttgcggggcccatcagccagcacaattacagacctggatatcatacacaaaccgctggcccctggcacctggggaagctcgagctggacttcaactactgcgagggaaccacagtcgtgattaccgaaaattgtggcacgcgcggcccttctctgcggacaaccacagtttccgggaaacttatccacgagtggtgctgtagaagctgcaccctgcccccgctgcgctatatgggagaagatggctgttggtacgggatggagattcggcctatcaacgaaaaggaggagaatatggtgaagtctctggtctccgccggaagcggcaaagtggacaactttacaatgggggttctctgcctggccattcttttcgaagaggtgatgagaggaaagttcggcaaaaagcatatgatcgctggcgtcctgtttattttcgtgctcctgctgtctgggcagatcacctggcgggatatggcccgcacgcttatcatgattggaagcaatgcgtccgacagaatgggcatgggggttacctatctggctctcatcgccacatttaaaattcagcccttcctggccctcggatttttcctgcggaaacttaccagcagagaaaacctgctcctgggcgtggggctggctatggccacaacccttcaactgcccgaggatatcgaacagatggctaatggaattgccctcggcctgatggcgctcaagctgatcacgcagtttgagacataccagctttggaccgccctggtctctctcacatgttccaacaccatcttcaccctgacagtggcttggcgcacggccaccctgattcttgctggcatcagcctgctccctgtgtgccaatcctctagcatgcggaaaacagactggctgccgatgaccgtcgccgccatgggggttccccctagccccctctttattttctctctgaaggatacacttaaaagacgcagctggcctctgaatgagggagtgatggctgtgggcctggtctccatcctcgcgtctagcctgcttagaaacgacgtgcccatggccgggcctctggttgctggaggcctcctgattgcctgttatgtgatcaccgggacgtccgccgatctcacagtcgaaaaggctgccgacgtgacctgggaggaagaggcggaacagaccggagttagccacaacctgatgatcacagtggacgatgacggcaccatgcggattaaagatgacgagacagagaatatccttacggtcctgctgaagaccgctctcctgattgtgtctggcatctttccctactccattccggccacacttctggtctggcatacctggcagaaacagacacaacgcagcggggtgctctgggatgttccttctccccctgaaacccagaaggccgagctggaagagggagtgtacagaatcaagcagcggggcattttcgggaaaacgcaggtcggagtgggcgttcaaaaggagggggtgtttcacaccatgtggcatgtcacacgcggagctgtgctcacctataacggcaaaagactggaacccaattgggcctccgtgaagaaagaccttatcagctacggcgggggatggcggctgtctgcgcagtggcagaagggcgaggaagttcaagtcatcgctgtggagccggggaagaaccctaaaaatttccagacaatgcccggaattttccagaccacaacgggcgaaatcggggccattgccctggattttaagcctggaacctccggcagccccatcattaaccgcgagggcaaagtggtcgggctctatggaaatggcgtggttacaaagaacgggggatacgtgtccggcatcgctcagaccaatgccgagcccgacgggcctaccccggaactggaggaagagatgttcaaaaagagaaaccttacaatcatggatctgcaccccggcagcggaaagacgcggaaatatctccctgctattgtccgcgaagccatcaagagacggctgagaaccctcattctggcgcccacacgcgtggttgccgctgagatggaggaagcccttaaaggcctgcctatccggtaccaaaccacagctaccaagtctgagcacacggggaaagaaattgtggacctgatgtgccatgccacatttaccatgagactcctgagccccgtccgcgtgcctaattataaccttatcatcatggatgaggcccacttcaccgacccggcttccattgcggcccggggatacatctctacaagagttggcatgggggaagctgccgccatttttatgaccgctacaccccctggaaccgccgatgcgttcccccagagcaatgctcctatccaggacgaggagcgcgacattcccgaacggtcctggaactctggcaatgattggatcacggactttgccgggaagacagtgtggttcgtcccgagcattaaggccggcaacgatatcgctaactgtctgcgcaagaatggaaagaaagtgatccagctctcccgcaagacctttgacacagagtaccagaagaccaagctgaacgattgggacttcgtggtcacgaccgatatttctgaaatgggcgccaattttaaggcggaccgggttatcgatcctagacggtgcctgaaacccgtgattctcacagacgggcccgagcgcgtgatccttgccggacctatgcccgtcaccgtggctagcgccgctcagagacggggccgcgttgggagaaaccctcagaaggagaatgatcagtatattttcacaggacaaccgctgaacaatgacgaagaccatgcccactggaccgaggctaaaatgctgctcgataacatcaatacacccgaaggcatcattcctgccctgttcgagcccgaacgggagaagtccgcggccatcgacggggagtacagacttaaaggcgaaagccgcaagacctttgtggagctgatgcggagaggagatctccctgtctggctggctcataaagtggcctctgaaggcattaagtatacggaccgcaagtggtgcttcgatggggagcggaacaatcagatcctggaagagaacatggacgttgagatttggacaaaagaaggagagaagaaaaagctcagaccccgctggcttgatgctcggacctactccgacccgctggccctgaaagaatttaaggatttcgccgctggcagaaagagcatcgcgctcgacctggtgaccgagatcgggcgcgtcccttctcaccttgcccacagaacacggaatgctctggataacctcgtgatgctgcatacctccgaacacggaggccgcgcctatagacatgccgtcgaggagctgcccgaaacaatggagacgctccttctgctgggcctcatgattctgcttaccgggggagctatgctgtttctcatcagcggcaaaggggtgggaaagacatccattggcctgatctgtgttgtggcctctagcgggatgctgtggatggcggacattcctctccagtggatcgcctccgctattgtgcttgagttctttatgatggtcctgctgatccccgagcctgagaaacagcggacaccccaggataatcagctcgcctacgttgtgatcgggattctcacacttgctgccatcgtggcggccaacgaaatgggcctgctcgagaccacgaagcgcgacctgggcatgagcaaagaaccgggggtcgtgtctcctacctcctatctggacgttgatctccaccccgctagcgcctggacactttacgctgtggccaccacagtcattacccccatgctgagacacacgatcgaaaattctacagctaacgtgagcctggccgcgattgccaaccaggctgtcgtgctcatgggactggacaagggctggcctatctccaagatggatcttggggttccgctgctcgccctgggatgctactctcaagtgaatcccctgaccctcacagctgccgtccttctgctggtgacccattatgccatcattggccctgggctccaggcgaaagctacccgggaagcccagaagagaacagctgccggaatcatgaaaaaccccacggttgacggcattatgaccatcgatctggaccctgtgatttacgatagcaagttcgagaaacagcttggccaagtcatgctgctcgtgctgtgtgccgtgcagctgctccttatgcgcacatcctgggctttttgcgaggccctgaccctggcgacagggcccatcaccacgctctgggaaggatctcctggcaagttctggaatacaaccatcgccgttagcatggctaacatttttcgggggtcctatctggccggagctggccttgccttcagcatcatgaagtctgtcgggaccggaaaaagaggcacaggctcccagggggagaccctgggagaaaagtggaaaaagaaactcaatcagctgagccgcaaggagtttgacctgtacaaaaagtccggcattacagaagtggatcggacggaggcgaaggaggggctcaaaagaggagaaatcacccaccatgccgtgtctcggggcagcgctaaacttcaatggttcgtcgagcgcaacatggttattccggaagggagagtgatcgacctgggatgtggccggggcgggtggtcctattactgcgccggactgaaaaaggtgacagaggtccgcggctataccaaagggggacccggccacgaagaacctgtgcccatgtctacatacgggtggaatattgttaagctcatgagcggaaaggatgtgttctacctgcctcccgagaaatgtgacacccttctgtgcgatatcggcgaatccagcccgtctcctacggtcgaggaatccagaaccatccgggtgctcaagatggttgagccctggctgaaaaacaatcagttttgtattaaggtgctgaacccctatatgcctacagtcatcgagcatctcgaacgccttcagagaaaacacggcgggatgctggtgcggaatcccctgagccgcaactctacccacgagatgtactggatttccaatggaacaggcaacatcgtgagctctgtcaatatggttagcagactcctgcttaaccggttcaccatgacatatagacgccctaccattgaaaaggacgtggacctgggggctggaacgcggcatgtgaacgccgagccggaaacacccaatatggatgtcatcggcgagagaatccgccggattaaggaggaacactcctctacctggcattacgacgatgagaacccttataaaacctgggcttaccacgggagctatgaagtgaaggccacaggatccgcgagctccatgatcaatggcgttgtgaaactcctgacgaagccctgggacgtcgtgcctaccgttacacagatggccatgaccgatacaaccccctttggccaacagagagtgttcaaagagaaggtcgacacacgcaccccgaagcctatgcccgggacgcggaaagtgatggaaattaccgctgagtggctgtggagaacactcggacgcaacaagcggcctagactgtgcacccgcgaggaatttaccaaaaaggttcggaccaatgccgctatgggcgccgtgttcacggaggaaaaccagtgggattctgccagagcggctgtcgaggacgaagagttttggaaacttgtggatcgcgagagagaactgcacaagctcgggaaatgtggaagctgcgtctacaatatgatgggcaagcgggagaagaaactgggggagttcggcaaggccaaaggatcccgcgccatctggtacatgtggcttggcgctagatatctggagtttgaggccctcgggttcctgaacgaagaccattggttttctcgggagaatagctactccggagtggaaggcgaggggctgcacaagctcggatatattctgagagatatctctaaaatccccggcggggctatgtacgccgacgacacagcgggctgggatacccggattacagaagacgatcttcataacgaggagaagatcacccaacagatggaccctgaacaccgccagctggccaatgctattttcaagctcacgtatcagaacaaagttgtgaaggtccaaagacccaccccgaaaggaacagtgatggatatcattagccggaaggaccagcgcggctccggacaggtgggaacctacggcctgaatacatttaccaacatggaggcccagcttatcagacaaatggaaggggagggagttctgagcaaaacagatctcgaaaatcctcatctgctggagaagaagatcacccagtggctcgagacgaaaggcgtggaacggctgaagcgcatggctatttctggggacgattgcgtcgtgaaacccatcgacgatagattcgccaacgcgcttctggccctcaacgacatgggcaaggttcggaaagatattccccagtggcagccttccaagggatggcacgactggcaacaggtgccgttctgtagccaccattttcacgagctgatcatgaaggacggccgcaaacttgtcgtgccctgcagacctcaggatgaactgattgggcgggctcgcatctctcagggagccggctggtccctcaaggagacagcttgtctggggaaagcctatgctcaaatgtgggccctgatgtacttccatagacgggacctccgcctggcgagcaatgccatttgctctgctgtccccgtgcactgggttcctacctccagaaccacatggagcatccacgcccatcaccagtggatgaccacagaagatatgcttacggtgtggaaccgggtctggatcgaggacaatccctggatggaggataagacccctgtgacaacctgggaagacgttccctacctgggaaaaagagaggatcagtggtgtggctccctcattgggctgacaagccgcgccacctgggctcaaaacatccttacggccattcaacaggtgcggtctctgatcggcaatgaagagtttctcgactatatgccgagcatgaagagattccgcaaggaggaagagtccgaaggagcgatttggtga

SEQ ID NO: 20933 - RNA, 9873 nt, synthetic construct
  misc_feature 1..9873: note = derived and/or modified CDS sequence (opt5) from DENV-3__JN368477__SS-prME
  source 1..9873: mol_type = other RNA
accagcctgtgcctcatgatgatgctgcccgccacacttgctttccacctgacgtccagagacggcgagcctcggatgatcgtggggaagaacgaacgcggaaaatctctcctgtttaagaccgccagcggcattaatatgtgtacacttatcgcgatggatctgggggagatgtgcgacgataccgtcacatacaaatgtccgctcattgctgaagttgagcccgaagacatcgattgctggtgtaacctgacctccacatgggtgacctatggaacgtgcaatcaggccggcgagcatagacgggacaagcgctctgtggccctggctcctcacgtcgggatgggactcgataccagaacacaaacctggatgagcgccgagggcgcttggcggcaggtggaaaaagttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagtccaaacccacgctcgacatcgagctgcagaagaccgaagctacacaacttgccaccctgcgcaaactctgtattgagggaaagatcacaaatattaccacggatagcagatgccctacacagggcgaagcgaccctgccggaggaacaggaccagaactatgtgtgtaaacacacctacgtggatcggggctgggggaatggatgcggccttttcgggaagggatctctggtcacatgcgccaagtttcaatgtctcgagcccatcgagggcaaagtggttcagtatgaaaacctgaagtacaccgtgattatcacagtccacacgggggaccagcatcaggtgggaaatgacacccaaggcgttacagtggagatcacccctcaggcttccacagtcgaagccgtgctgcccgagtatggcaccctcgggctggaatgcagccctcgcacgggacttgatttcaacgagatgattctgctcaccatgaaaaataaggcttggatggtccacagacagtggtttttcgacctgccccttccgtggacatctggcgccaccacagagacccctacgtggaaccggaaagaactgctcgtgacatttaagaatgcccatgctaaaaagcaagaggttgtggtcctggggtcccaggaaggagcgatgcacaccgccctgacaggcgctaccgagatccagaacagcgggggcacctctattttcgccggacacctcaagtgtcgcctgaaaatggataagcttgaactgaaaggcatgtcctacgccatgtgcctcaatacatttgtgctgaagaaagaggttagcgagacgcagcatgggaccatcctgattaaggtggaatacaagggagaggacgctccctgtaaaatccctttctccacagaagatggccaagggaaggcccacaacggaagacttatcaccgcgaaccccgtcgtgacaaaaaaggaggagcccgtgaatattgaagctgagcctccgttcggcgaatctaacatcgttattgggatcggcgacaaagccctcaagattaattggtataagaaaggaagctccatcggcaagatgtttgaggccaccgctcggggggccagacgcatggctatcctgggagatacggcctgggacttcggcagcgtcgggggagtgctgaactctctcggcaaaatggtgcatcagatttttgggtccgcgtacacagccctgttcagcggcgtctcttggatcatgaagattggaatcggcgtgcttctgacctggattgggctcaatagcaaaaacacctccatgtcttttagctgcatcgttattggaatcatcacactgtatctgggcgctgtggtccaggccgatatggggtgtgtgattaattggaagggaaaggaacttaaatgcggcaacgggatcttcgttaccaatgaggtgcacacatggacggagcagtacaagtttcaagctgactcccccaaacggctcgccaccgcgattgccggcgcttgggaaaacggagtctgtggcatcagaagcacaacccgcatggagaatctgctgtggaagcagattgccaacgaactcaattatatcctgtgggagaacaatatcaaacttacagtggttgtgggggatattatcggagtcctggaacagggcaagcggaccctcacgcctcagcccatggagctgaaatactcttggaagacctgggggaaggctaaaattgtgacagccgagacccaaaactccagcttcatcattgacggacctaacacacccgaatgcccgtctgcctccagagcttggaatgtgtgggaggtcgaagactatggctttggcgttttcaccacaaacatctggctgaagcttcgcgaggtgtacacccagagctgtgatcatcggctcatgtccgcggccatcaaagacgaaagagctgtgcacgccgatatggggtactggattgagtctcagaagaatggaagctggaaactggagaaggcctcctttatcgaagtcaagacgtgcacatggcctaaatctcacaccctgtggagcaacggcgtgctcgagtccgacatgattatccccaagagcctggctgggcctatttctcagcataatcaccgccccggatatcatacccaaacagccggcccttggcaccttgggaaactggaactcgatttcaactactgcgagggaaccacggttgtgatcgcggagaattgtggcacacggggcccctccctgagaaccacaaccgtcagcgggaagctgatccacgaatggtgctgtcgctcttgcacacttccgcctctccggtatatgggagaggacggctgttggtacgggatggaaattagacccatcaacgagaaagaagagaatatggtgaagtccctggttagcgctggatctggcaaggtggataactttaccatgggggtcctgtgcctcgccattctgttcgaggaagtgatgcggggaaaattcggcaagaaacatatgatcgccggcgttctttttacgttcgtgctgctcctgagcgggcagattacctggcgcgacatggctcacacactgatcatgattggatccaatgccagcgatagaatgggcatgggggtcacccatcttgcgctgatcgctacatttaagatccagcccttcctcgccctgggatttttcctccggaaactgacctctagagagaaccttctgctcggcgtggggctggccatggctacgacactgcaacttcctgaagacattgagcagatggccaatggaatcgctctgggcctcatgaccctgaagctcattacacagtttgaaacctatcagctgtggaccgcccttgtgtccctgacatgtagcaacacgatcttcaccctcacagtcgcgtggcgcaccgccacactgattctggctggcgtttcccttctgccgctctgccaatctagctccatgcggaagaccgattggctgcccatgacggtggccgctatgggggtgcctcccctccctctgtttatcttctctcttaaagacacacccaagagacgcagctggcctctgaatgagggagtcatggccgtgggcctggtttccatcctcgcctctagcctgcttagaaacgatgtgcccatggctgggccgctggtcgcgggaggcctcctgattgcctgttacgtgatcaccgggacctccgctgacctcacagttgagaaagccgccgacgtgacctgggaagaggaagctgagcagacaggagtcagccacaacctgatgattacggtggatgacgatggcaccatgcggatcaaggacgatgaaacagagaatattcttaccgtcctgctgaaaacagccctcctgatcgtgtctggcatctttccttattccattcccgcgacccttctggtttggcatacgtggcagaagcagacccaacgcagcggggtgctctgggacgtcccttctcccccggagacacagaaagctgaactggaggaaggagtgtacagaatcaagcagcagggcattttcgggaagacccaagttggagtgggcgtccagaaagagggggtgtttcacacaatgtggcacgtgacccggggagccgttctcacacataacggcaagcgcctggagcctaattgggcctccgtcaaaaaggatcttatcagctacggcgggggatggagactgtctgctcagtggcaaaaaggcgaagaggtgcaggtgattgccgtcgaacccgggaagaaccctaagaatttccagacgatgcccggaatcttccagaccacaaccggcgagattggggcgatcgctctggactttaaacccggaacctccggcagccctatcattaaccgggaaggcaaggtggttgggctctatggaaatggcgtggtcacaaaaaacgggggatacgtgtccggcatcgcccaaacgaatgccgagccggatgggcccacccctgagctggaagaggaaatgttcaagaaacgcaaccttacaattatggacctgcaccccggcagcggaaagaccagaaagtatctccctgctatcgttcgggaggccattaaacgcagactgcggacactcatcctggctcccaccagagtggtcgccgcggaaatggaggaggcccttaagggcctgcctatccgctaccagacgacagctaccaaatctgaacataccgggcgggagattgtggatctgatgtgccacgccacatttaccatgagactcctgagcccggttcgcgtgcccaattataaccttgtcatcatggacgaagctcatttcacagatcctgcctccattgccgctcggggatacatctctaccagagtgggcatgggggaggcggccgctatttttatgacggccacaccccctggaaccgccgaagctttcccccagagcaatgccccgatccaggacgaggagcgcgacatccctgaacggtcctggaactctggcaatgagtggattacagattttgtggggaagaccgtctggttcgttcccagcatcaaagcgggcaacgacattgctaactgtctgagaaagaatggaaagaaagtgatccaactctcccgcaagacgtttgataccgaatatcagaaaacacggctgaacgactgggatttcgtggtcaccacagacatttctgagatgggcgccaattttaaggccgatagagtgatcgacccccggcgctgcctgaaacctgttattctcaccgatgggcccgagagagtgatccttgctggacctatgccggtcacagccgcgagcgccgctcagcggcgcggcagagtggggcggaacccccagaaggaaaatgaccaatacatcttcaccggacagcctctgaacaatgatgaggaccacgcccactggacggaagctaagatgctgctcgacaacattaatacacccgagggcatcattcctgccctgttcgaacccgagagagagaaatccgctgccatcgatggggaataccgccttaagggcgagagccggaaaacctttgttgaactgatgagacgcggagacctcccggtgtggctggcgcataaggtcgcctctgagggcattaaatataccgatcggaagtggtgcttcgacggggaaagaaacaatcagatcctggaggagaacatggatgtggaaatctggacaaaagagggagaacgcaagaagctccggcctagatggcttgacgctcgcacctactccgatcccctggccctgaaagagtttaaggacttcgctgccggcagaaaaagcattgccctcgatctggtcacagaaatcgggcgggtgccttctcaccttgctcatcgcacgagaaatgcgctggacaacctcgttatgctgcacacctccgagcacggaggccgggcctatcgccatgctgtggaggaactgcccgagacaatggaaaccctccttctgctgggcctcatgattctgcttacagggggagccatgctgtttctcatcagcggcaaggggattggaaaaacctccatcggcctgatctgtgtgattgtctctagcgggatgctgtggatggccgatgttcctctccagtggatcgcttccgccattgtgcttgagttctttatgatggtgctgctgatccccgagccggaaaagcaaagaacgcctcaggacaatcagctcgcgtacgtcgtgattggaatcctgacccttgccgctattgttgccgctaacgagatgggcctgctcgaaacaaccaagcgggatctgggcatgagcaaagagcccggggtggtctctcccacatcctatctggacgtggacctccaccctgccagcgcgtggaccctttacgccgtcgctacgacagtgatcaccccgatgctgagacatacaatcgaaaattctaccgccaacgttagcctggctgccattgctaaccaagccgtggtcctcatgggactggataagggctggcccatctccaaaatggaccttggggtgcctctgctcgcgctgggatgctattctcaggttaatcccctgaccctcacagccgctgtgcttctgctggtcacgcactacgccattatcggccctgggctccaggctaaggccacccgcgaggcccagaaacggacagcggctggaattatgaagaaccccaccgtggatggcatcatgacaatcgacctggatcctgtgatttacgacagcaagttcgagaaacaacttggccaggttatgctgctcgtcctgtgtgccgtgcagctgctccttatgagaacctcctgggctctgtgcgaagccctgacgctcgccacagggccgatcaccaccctgtgggagggatctcccggcaagttttggaatacaaccattgctgtgagcatggccaacatcttccgcgggtcctatcttgcgggagccggcctggcttttagcattatgaaatctgtcgggacaggacggagaggcacgggctcccagggggaaaccctcggagagaagtggaaaaagaagctgaatcaactgagccggaaagaattcgatctctacaagaaatccggcatcacagaggttgaccgcaccgaggccaaggaagggcttaaaagaggagagacaacccatcacgctgtgtctcggggcagcgccaagctgcagtggtttgtggaacgcaacatggtcatccctgaggggagagtgattgatctgggatgtggccggggcgggtggtcctattactgcgcgggactcaaaaaggttacggaagtgcgcggctataccaaggggggacccggccacgaggagcctgtccccatgtctacatacgggtggaatatcgtgaaactgatgagcggaaaggacgttttctatcttccgcctgaaaaatgtgataccctgctctgcgacattggcgagtccagcccctctcccacagtggaagagtccagaaccatccgggtcctgaagatggtggagccttggctgcgcaacaatcagttctgtattaaagtgctcaacccctacatgcctacagtcatcgaacatcttgagagactgcagcggaagtacggcgggatgctggttagaaatccgctcagccgcaactctacccacgaaatgtattggatttccaatggaacgggcaacatcgtgagctctgtgaatatggtcagccggctgcttctgaacagatttacaatgacccatcgccggcccaccatcgagaaggatgtggacctcggggccggaacaagacacgttaacgctgaacctgagacgcccaatatggacgtgattggcgagcgcatcaaacggattaaggaagagcactcctctacctggcattacgatgacgaaaacccttataaaacatgggcctaccacgggagctatgaggtcaaggctaccggatccgccagctccatgatcaatggcgtggttaaactgctgacaaagccctgggatgtggtcccgatggtgacccaaatggctatgacagacaccacgcctttcggccagcagagagtttttaaggaaaaagtggatacccgcacaccccggcctatgcccgggaccagaaaggtcatggagattacagccgagtggctctggcgcaccctgggacggaacaaaaagcctagactttgcacgcgcgaagagttcacaaaaaaggtgagaaccaatgcggccatgggcgctgtctttacagaagagaaccaatgggactctgcccgggctgccgtggaagatgaggagttctggaagctggttgacaaagaacgcgagctccataagctggggaaatgtggaagctgcgtgtacaatatgatgggcaagagagaaaaaaagcttggggagtttggcaaagccaagggatcccgggcgatctggtatatgtggctgggcgctagatacctcgagttcgaagccctggggtttctgaacgaggatcactggttctctcgggaaaatagctactccggagtcgagggcgaagggctccataagctgggatatatccttcgcgacatttctaaaatccccggcggggccatgtacgctgatgacaccgccggctgggacacgagaattaccgaggatgacctgcacaacgaggaaaagatcacacagcagatggatccgggacaccggcagctcgctaatgccatttttaaactgacctatcaaaacaaggtggtgaaagttcagcgccctacacccaagggcaccgtgatggacatcatcagcagaaaggatcagcgggggtccggacaggtcggcacatacgggcttaataccttcacgaacatggaggcgcaactggtgcgccagatggaaggagagggcgttctcagcaaagccgacctggaaaatccccatctgctcgagaagaaaattacacagtggctggagaccaagggggtggaaagacttaaacggatggctatctctggcgatgactgcgtcgtgaagcctattgatgaccgctttgccaacgctctgctcgccctgaacgatatgggaaaggtcagaaaagacatcccgcagtggcaaccctccaagggctggcacgattggcagcaggtgcctttctgtagccatcacttccacgagcttattatgaaagacgggcggaagctggttgtgccctgccgccctcaggacgaactcatcggaagagcgcggatctctcaaggcgccgggtggtccctgaaagagaccgcttgtctgggaaaggcctatgctcagatgtggagcctcatgtactttcatcgcagagatctgcggcttgcctctaatgctatttgctccgccgtccccgtgcactggatccctacaagcagaaccacatggtccattcatgcgcaccatcagtggatgacgaccgaagacatgctgacagtttggaaccgcgtgtggatcgaggataatccctggatggaggacaagaccccggtcacaacctgggaagatgtgccttatctcggcaaacgggaggaccaatggtgtgggagcctgattggccttacgtctagagccacctgggctcagaacatcctgacagccattcagcaggtgcgcagcctcatcggagatgaagagttcctggactacatgccctccatgaagcggtttagaaaagaggaagagaccgaaggcgccatctggtga

SEQ ID NO: 20934 - RNA, 9873 nt, synthetic construct
  misc_feature 1..9873: note = derived and/or modified CDS sequence (opt5) from DENV-3__EF643017__SS-prME
  source 1..9873: mol_type = other RNA
accagcctgtgcctcatgatgatcctgcccgccgctcttgccttccacctgacatccagagacggagaacctcggatgattgtggggaagaacgaacgcggaaaatctctcctgtttaagacggcgagcggaatcaatatgtgtacccttattgctatggatctgggggaaatgtgcgacgatacagtgacctacaaatgtccgcatatcacagaagttgaacccgaagacattgattgctggtgtaacctcacctccacatgggtgacctatggaacgtgcaatcaggccggagagagacggcgcgacaagagatctgtggccctggctcctcacgtcgggatgggactggatacccggacacaaacctggatgagcgccgagggcgcttggcgccaggtggaaaaagttgagacatgggccctcagacatcccggcttcaccatcctggcgctttttctggcccactacatcgggacgtccctcacacagaaggtggtcattttcatcctgcttatgctggtgaccccttctatgacaatgcggtgtgttggagtgggcaaccgcgactttgtcgaagggctcagcggagctacctgggtggatgtggtcctggagcatggcgggtgcgttaccacaatggccaagaataaacccacgctggacattgagctccagaagaccgaagctacacaactggccacccttagaaaactgtgtatcgagggaaagattacaaacatcaccacggattcccggtgccctacacagggcgaagcggtgctcccggaggaacaggaccagaattatgtgtgtaaacacacctacgtcgatcgcggctgggggaacggatgcggcctgttcgggaagggaagccttgtgacctgcgccaagtttcaatgtctggagcccattgagggcaaagttgtgcagtatgaaaatctcaagtacacagtcatcatcaccgtgcacacaggggaccagcatcaggttggaaacgagacgcaaggcgtgaccgctgaaattacacctcaggcctctaccacagaggctatcctgcccgaatatggcaccctggggctcgagtgctcccctagaacgggactggacttcaatgagatgattcttctgaccatgaaaaacaaggcctggatggtccaccggcagtggtttttcgatctccccctgccgtggacaagcggcgccaccacagaaacccctacgtggaatcgcaaagagcttctggtgacatttaagaacgctcatgcgaaaaagcaagaagtcgtggttctcgggtctcaggagggagccatgcacaccgctctgacaggcgccaccgaaatccaaaatagcgggggcaccagcattttctctggacacctgaagtgtagactcaaaatggacaagctggagcttaaaggcatgtcctacgccatgtgcacaaacacgtttgtgctgaagaaagaggtcagcgaaacccagcatgggacaatcctcatcaaggtggagtaccggggagaagatgctccctgtaagattcctttctccaccgaggacggccaagggaaagcccacaacggaagactgatcacagcgaatcccgttgtgaccaagaaagaggaacccgtcaacattgaggctgaacctccgttcggcgagtctaatatcgtgattgggatcggcgataacgccctgaagatcaattggtataaaaagggaagctccattggcaagatgtttgaagccacggctcgcggggcccggagaatggctatccttggagacacagcctgggatttcggcagcgtcgggggagttctcaactctctgggcaaaatggtccatcagatttttgggtccgcgtacaccgccctgttcagcggcgtgtcttgggtgatgaagatcggaattggcgtcctcctgacctggatcgggcttaatagcaaaaacacatccatgtcttttagctgcattgctatcggaatcattaccctgtatctcggcgccgtggttcaggctgacatggggtgtgtgatcaattggaagggaaaagagctgaagtgcggctccgggattttcgtcacaaacgaggtgcacacgtggaccgaacagtacaagtttcaagccgatagccccaaacgcctggcgacagccatcgctggcgcctgggagaatggagtttgtggcattcggtctaccacaagaatggaaaaccttctctggaagcagatcgctaatgagctgaactatatcctgtgggaaaataacattaaactcaccgtggtcgtgggggacatcattggagttctggagcagggcaagcgcacgcttacccctcagcccatggagctgaaatactcctggaagacatgggggaaagccaagatcgtgaccgccgaaacacaaaacagctctttcattatcgatggacctaatacccccgagtgcccgtccgctagccgggcgtggaacgtctgggaagtggaggactatggctttggcgtgttcacaaccaatatctggctcaagctgagagaagtctacacgcagctgtgtgaccatcgccttatgtccgccgctgttaaagatgagcgggccgtgcacgccgacatggggtactggattgagtctcagaagaacggaagctggaaactcgaaaaggcttccctgatcgaggtgaaaacatgcacctggcctaagtctcacaccctgtggagcaatggcgtcctcgaatccgatatgattacacccaagagcctggccgggcctatctctcagcataaccacagacccggatatcatacccaaacggcgggcccttggcaccttgggaaactggagctcgactttaattactgcgagggaacaaccgtggttattacagaaaactgtggcacccgcggcccctccctgcggacaaccacggtgagcgggaagctgatccacgagtggtgctgtagatcttgcacccttccgcctctccggtatatgggagaagatggctgttggtacgggatggagatccgccccatttccgaaaaagaggagaatatggtcaagagcctggtgtctgctggaagcggcaaagttgacaacttcacaatgggggtgctgtgcctcgccatcctgtttgaagaggtcatgagaggaaagttcggcaagaaacatatgattgccggcgtgttctttaccttcgttcttctgctctccgggcagatcacatggcgggatatgacccacacgctgattatgatcggaagcaatgcttctgacagaatgggcatgggggtgacatatctggcccttattgcgacctttaagatccagcccttcctggctctcggatttttcctgcgcaaactcacatcccgggaaaacctgcttctgggcgtcgggctcgccatggccaccaccctgcaactgcctgaggatatcgaacagatggctaatggaattgcccttggcctgatggctctcaagctgatcacacagtttgagacgtaccagctctggaccgccctgattagccttacatgttccaacaccatgttcacactgaccgtggcgtggagaacggccacactcatcctggctggcgtgtctctgcttccggtctgccaaagctcctctatgcgcaaaaccgactggctgcccatggccgttgctgccatgggggtgagccctctccccctgtttattttctccctcaaggataccctgaagagacggtcttggcctcttaatgagggagtgatggccgtcggcctggtgagcatcctggcttccagcctcctgcgcaacgacgttcccatggcggggcctcttgtggccggaggcctgctcatcgcttgttatgtcattacagggacctctgccgatctgacagtggaaaaagccgctgacatcacgagagaggaagaggccgaacagaccggagtttcccataacctcatgacaaccgtggacgatgacggcacaatgcggattaaggatgacgagaccgagaatatcctgacggtccttctgaaaaccgcgctgctcattgtgagcggcgtctttccctactctatcccggctacactgcttgtgtggcacacctggcagaagcagacacaacgctccggggttctgtgggatgtgccttctccccctgaaacccagaaagccgagctcgaagagggagtctacagaatcaagcagcagggcattttcgggaaaacacaagtgggagttggcgtgcagaaggagggggtctttcatacgatgtggcacgtgacccggggagccgtgctgacatataacggcaagcgcctcgaacccaattgggcttccgttaaaaaggacctgatctcctacggcgggggatggagacttagcgcccagtggcaaaaaggcgaggaagtccaggtgattgcggtggagccggggaagaaccctaaaaatttccagaccatgcccggaaccttccagacaacgaccggcgaaatcggggctattgccctggattttaagcctggaacatccggcagccccatcattaaccgggagggcaaggtcgtggggctgtatggaaatggcgttgtgaccaaaaacgggggatacgtctctggcatcgcccaaacaaatgctgagcccgacgggcctaccccggaactcgaggaagagatgttcaagaaacgcaacctgacgatcatggatcttcaccccggcagcggaaagacaagaaaatatctgcctgccattgtgcgggaagctatcaagagacgcctccggaccctgattctcgcccccaccagagttgtggcggccgagatggaggaagctctgaagggccttcctatccgctaccagacaaccgccacaaaatccgagcataccgggcgggaaattgtcgacctgatgtgccacgctacgtttacaatgagactgctctctcccgtgcgcgttcctaattataacctgatcatcatggatgaggcccatttcaccgacccggccagcattgctgcgcggggatacatctccacaagagtgggcatgggggaagccgctgccatttttatgaccgccacgccccctggaaccgctgatgccttcccccagtctaatgcgcctatccaggacgaggagcgcgacattcccgaacggagctggaactccggcaatgagtggatcacagattttgctgggaagaccgtctggttcgtgccgtctatcaaagccggcaacgacattgccaactgtcttagaaagaatggcaagaaagtgatccaactgagccggaaaacatttgataccgaataccagaaaacaaagctcaacgactgggatttcgtcgttaccacggacatttccgagatgggcgctaattttaaagccgatcgcgtgatcgaccctagacggtgcctgaagcccgtgattctgacagatgggcccgagcgcgtcatcctcgcgggacctatgcccgtgaccgccgctagcgccgctcagagacggggcagagttgggcgcaaccctcagaaagaaaatgaccaatatattttcaccggacagccgcttaacaatgatgaggaccacgcccattggacagaagctaagatgctgctggacaacatcaatacccccgagggcatcattcctgccctcttcgaacccgagcgggagaagtctgcggccatcgatggggaatacagactgaaaggcgagtcccgcaagacatttgtggaacttatgcggagaggagacctgcctgtctggctcgctcacaaagtggccagcgagggcattaagtatacggatcgcaaatggtgcttcgacgggcagcggaacaatcagatcctggaagagaacatggatgttgagatttggaccaaggaaggagagaaaaagaagctgagaccccgctggctcgacgctagaacatactctgatccgcttgccctgaaagaatttaaggacttcgccgctggccggaaatccatcgcgctggatctcgtgaccgagatcgggcgcgtccctagccacctggcccatagaacacggaatgctcttgacaacctggtgatgctccacacctccgaacatggaggccgcgcctatagacacgccgtcgaggagctgcccgaaacgatggagaccctgctccttctgggcctgatgattctcctgacagggggagctatgctttttctgatctctggcaaggggattggaaaaaccagcatcggcctcatttgtgtgatcgcctccagcgggatgtcttggatggcggaaatccctctgcaatggattgcctccgctatcgttctggagttctttatgatggtgctccttattcccgagcctgaaaagcagcggacaccccaggataatcaactggcctacgtggtcatcggcattctgaccctcgctgccatcattgcggccaacgagatgggcctgcttgaaacgacaaagagagacctgggcatgagcaaagagccgggggttgtgtctcctaccagctatctcgatgtggacctgcaccccgcttccgcctggacactgtacgctgtcgccaccaccgtgatcacacccatgctccgccatacgatcgaaaattctaccgctaacgttagccttgccgcgattgccaaccaggctgtggtcctgatgggactggacaagggctggcctatctccaaaatggatctcggggtgccgctgcttgccctgggatgctactctcaggtcaatcccctcacactgaccgctgccgtgctgctccttattacacactatgccatcattggccctgggctgcaggcgaaggctacccgggaggcccagaaaagaacggctgccggaatcatgaagaaccccacagttgacggcatcatgaccattgatctggaccctgtgatctacgatagcaagttcgagaaacagctcggccaggtcatgctgcttgtgctgtgtgccgttcagctcctgctgatgcgcacctcctgggctctctgcgaagcccttacactggcgaccgggcccattacaacgctgtgggagggaagccctggcaagttttggaataccacaatcgccgtgtctatggctaacattttccgggggtcctatctcgccggagtcggcctggcttttagcatcatgaaatccgtggggaccggaaagagaggcacaggctctcaaggggaaacccttggagagaaatggaagaagaaactgaatcagctcagccggaaggagttcgacctgtacaaaaagtccggcatcacggaggtggatcgcaccgaggccaaagaagggctgaagagaggagagattacacatcacgcggtttctcggggcagcgccaaactccagtggtttgtcgaacgcaacatggtgatcccggaggggagagtgattgaccttggatgtggccggggcgggtggtcctattactgcgctggactgaagaaggtcaccgaagttcgcggctatacaaaagggggacccggccatgaggagcctgtgcccatgagcacctacgggtggaatatcgtgaagctgatgtctggaaaagatgtcttctacctccctcccgaaaagtgtgacacactgctttgcgatattggcgagtccagcccgtctcctaccgtggaagagtccagaacgatccgggttctgaaaatggtggagccctggctcaagaacaatcagttctgtattaaggtcctgaacccctatatgcctacagtgatcgaacacctggagcgcctccaaagaaaacacggcgggatgcttgttcggaatcccctgagcagaaactctacccatgaaatgtactggatcagcaatggaaccggcaacattgtggcctccgtcaatatggtgtctcgcctgctcctgaaccggtttacaatgacgcacagacgccctaccatcgagaaggacgtggatcttggggctggaacacggcatgtcaacgccgaaccggagacccccaatatggacgttattggcgagagaatcaaacgcattaaggaagaacacaacagcacatggcactatgacgatgaaaatccttacaaaacctgggcttatcatgggtcctacgaggtgaaggccacaggaagcgcgtcctctatgatcaacggcgtggtcaagctgctcaccaaaccctgggacgtggttcctatggtgacgcagatggccatgaccgatacaacccccttcggccagcaacgggtctttaaggaaaaagtggacacaagaaccccgcgcagcatgcctgggacgcggagagttatgggaatcacagctgagtggctgtggcgcaccctgggccggaataagaaacccagactctgcacacgcgaggagttcaccaagaaggtgagaacgaacgccgctatgggggccgtctttaccgaggaaaatcagtgggattccgccaaagcggctgtggaggacgaagatttctggaagctggttgaccgggagcgcgagcttcacaaactgggaaagtgtggctcttgcgtgtataacatgatggggaaaagagaaaagaaactcggcgagtttggaaaggccaagggcagccgggccatttggtacatgtggctgggggctagataccttgagttcgaggccctgggatttctcaatgaggatcattggttctcccgggaaaactcttatagcggcgtcgagggggaaggactgcacaaactgggctacatcctccgcgacatttccaagatccctgggggcgctatgtatgccgatgacacagcgggatgggacaccagaattacagaggatgacctgcataatgaagagaaaatcacccagcagatggatcccgagcaccggcaacttgccaacgctatctttaagctgacataccagaataaagtggtcaaggtgcagcgccctacccccacgggcacagttatggacattatcagcagaaaggatcagcgggggtctggacaagtgggcacctatgggctcaacaccttcacaaatatggaagcccagctgattcgccagatggagggagaaggcgtcctttccaaagctgacctggagaacccgcacctccctgaaaagaaaatcacccagtggctggagacaaagggggtggagagactgaaacggatggccattagcggcgatgactgcgtggttaagcccatcgatgaccgctttgcgaacgccctcctggctcttaatgatacgggaaaggtgagaaaagacatcccccaatggcagccttctaagggctggcatgattggcagcaggtcccgttctgttcccaccatttccacgaactgattatgaaagacgggcggaagctcgtggttccctgccgccctcaagacgagctgatcggcagagcccggattagccagggcgctgggtggtctcttcgcgaaaccgcctgtctgggaaaggcttacgcccagatgtggtccctcatgtattttcacagacgggatctgagactggcgagcaacgccatctgctccgctgtgcccgtccattgggtgcctacaagccgcaccacatggtctattcacgcccatcaccaatggatgaccacggaggacatgctcaccgtctggaatcgggtgtggatcgaagataacccctggatggaggacaagacacctgttaccacatgggagaatgtgccctacctgggcaagagagaagatcagtggtgtgggagccttattggcctgacctcccgcgccacgtgggctcagaacatcccgacagccatccagcaagtccggtctctcattggaaatgaggagttcctggactacatgcctagcatgaaaagatttcgcaaggaggaggaatccgagggcgcgatctggtga

SEQ ID NO: 20935 - RNA, 9873 nt, synthetic construct
  misc_feature 1..9873: note = derived and/or modified CDS sequence (opt5) from DENV-3__DQ675519__SS-prME
  source 1..9873: mol_type = other RNA
accagcatctgcctgatgatgatgctccccgccacactggctttccaccttacgagccgggacggcgaacctcggatgattgtggggaagaacgaacgcgggaaatctctgctctttaagaccgccagcggcatcaatatgtgtacactgattgcgatggatcttggggagatgtgcgacgataccgtcacatacaaatgtccgctgatcaccgaagttgagcccgaagacattgattgctggtgtaacctcacatccacctgggtgacgtatggaacctgcaatcaggctggcgagcatcggcgggacaagcgctctgtggccctggcccctcacgtcgggatgggactggatacaagaacccagacatggatgagcgctgagggcgcctggcggcaggtcgaaaaagttgagacctgggctttccgccatcccggctttacgatcctcgccctgttccttgcgcactacatcgggacatccctgacccagaaggtggtcatttttatcctcctgatgcttgtgacaccttctatgaccatgagatgtgttggagtgggcaaccgggacttcgtcgaagggctgagcggagccacctgggtggatgtggtcctcgagcatggcgggtgcgttacaacgatggctaagaataaacccaccctggacattgagctgcagaagacagaagccacccagctcgctacactgcgcaaactttgtatcgagggaaagattaccaacgtgacgacagattccagatgccctacccagggcgaagccatcctgccggaggaacaggaccagaattatgtgtgtaaacacacctacgtcgatcggggctgggggaacggatgcggcctctttgggaagggaagcctggtgacatgcgcgaagttccaatgtcttgagtctattgagggcaaagttgtgcagcacgaaaatctgaagtataccgtcatcatcacagtgcatacgggggaccagcaccaggttggaaacgagacccaaggcgtgacagccgaaattacaccccaggcttccacagtcgaggccatcctccctgaatacggcaccctggggctggagtgcagcccccgcacgggactcgactttaatgagatgattctgcttaccatgaaaaacaaggcttggatggtgcatagacagtggttctttgatctgcctctcccctggacatctggcgccaccacagaaaccccgacgtggaataaaaaggagctgcttgtcacattcaaaaacgcccacgctaagaagcaagaagtggttgtgctggggtcccaggagggagcgatgcacaccgccctcacaggcgctaccgaaatccagaccagcgggggcacatctatttttgccggacatctgaaatgtcggctgaagatggacaaactcgagctgaagggcatgtcctatgccatgtgccttaatgctttcgtcctgaaaaaggaggtgagcgaaacgcagcacgggaccatcctcatcaaggttgagtacaaaggagaagatgccccttgtcgcattcccttctccacagaggacggccaagggaaggcgcataacggaagactgatcaccgctaaccctgtggtcaccaagaaggaggaacccgtgaatattgaggccgaacccccttttggcgagtctaacatcgtgattgggatcggcgataaagccctgaagatcaattggtacaagaaaggaagctccattggcaagatgttcgaagctaccgccagaggggctagacgcatggccatccttggagacacggcgtgggattttggcagcgttgggggagtcctcaactctctgggcaaaatggtgcaccagattttcgggtccgcctatacagctctgtttagcggcgtgtcttggatcatgaagattggaatcggcgtcctcctgacctggattgggcttaatagcaaaaacacctccatgtctttcagctgcatcgtgatcggaattatcacactgtacctcggcgccgttgtgcaggctgacatggggtgtgtcattaattggaagggaaaggagctgaaatgcggcaacgggatctttgtgaccaatgaggttcatacatggacggaacagtataagttccaagccgattccccgaaacggctggcgaccgccattgctggcgcctgggagaacggagtgtgtggcatcagaagcacaacccgcatggaaaatcttctctggaagcagatcgctaacgagctgaattacattctgtgggaaaacaatatcaaactcacagtcgtggttggggacattatcggagtgctggagcagggcaagcggacccttacgccccagcctatggagctgaaatattcttggaagacctgggggaaggccaaaattgtcacagccgaaacccaaaactccagctttatcatcgatggacccaacacacctgagtgcccctctgcttccagagcgtggaatgtgtgggaagtggaggactacggcttcggcgtctttaccacaaacatttggctcaagctgcgcgaagtttatacccagctgtgtgaccaccggcttatgagcgccgctgtgaaagatgagagagccgtgcacgccgacatggggtactggatcgagtcccagaagaatggatcttggaaactcgaaaaggctagcctgattgaggtcaagacgtgcacatggccgaaatcccataccctgtggtctaacggcgtgctcgaaagcgatatgatcattcctaagtccctggccgggcccatcagccagcacaatcatcgccctggataccacacccaaacagcgggcccctggcaccttgggaaactggagctcgacttcaactattgcgagggaaccacggttgtgatcacagaaaattgtggcacccggggcccttctctgagaacaaccacagtctccgggaagctgattcatgagtggtgctgtcgcagctgcacccttcccccgctccggtacatgggagaagatggctgttggtatgggatggagatcagacctattaacgaaaaagaggagaatatggtgaagtctctggtttccgctggaagcggcaaggtggacaactttacgatgggggtcctgtgcctcgccatcctgttcgaagaggtgatgcggggaaaattcggcaagaaacacatgattgccggcgttctttttaccttcgtgctgctcctgtctgggcagatcacatggcgcgatatggctcataccctgattatgatcggaagcaatgcctccgacagaatgggcatgggggtcacataccttgcgctgatcgctacctttaagattcagcccttcctcgccctgggatttttcctccggaaactgacgagcagagaaaaccttctgctcggcgtggggctggccatggctacaaccctgcaacttcccgaggatatcgaacagatggccaatggagtggctctgggcctcatggccctgaagctcattacacagtttgagacctatcagctgtggaccgcgcttgtctctctgatgtgttccaacacaatcttcacgctcaccgttgcctggcgcacagctaccctgattctggccggcatcagccttctgcctgtgtgccaatcctctagcatgcggaagacagactggctcccgatgaccgtggctgccatgggggtgccccctctgcccctctttatcttctccctgaaagatacgcttaagagacgctcttggcctctgaatgagggagtgatggccattggcctggttagcatcctcgcttcctctctgcttagaaacgacgtgcccatggcggggcctctggtcgccggaggcctcctgattgcttgttacgtgatcacagggaccagcgccgatctcaccgttgaaaaagccgctgacgtgacatgggaggaagaggccgaacagaccggagtctcccacaacctgatgattacagtggacgatgacggcacgatgcggatcaaggatgacgagaccgagaatatccttacagtcctgctgaaaaccgcgctcctgattgtgagcggcatctttccctattctattccggctacacttctggtttggcatacctggcagaagcagacgcaacgctccggggtgctctgggatgtcccttctccccctgaaacccagaaagccgagctggaagagggagtgtacagaatcaagcagcagggcattttcgggaagacacaagttggagtgggcatccagaaagagggggtctttcacaccatgtggcacgtgacacggggagccgtgctcacccataacggcaagcgcctggaacccaattgggcttccgttaaaaaggaccttatttcctacggcgggggatggagactgagcgcccagtggcaaaaaggcgaggaagtccaggtgatcgcggtggagccggggaagaaccctaagaatttccagacaatgcccggaatcttccagacgaccacaggcgaaattggggctatcgccctggattttaaacctggaacctctggctcccccattatcaaccgggagggcaaggtcgtggggctctatggaaatggcgttgtgaccaaaaacgggggatacgtcagcggcattgcccaaacaaatgctgagcccgacgggcctacgccggaactggaggaagagatgttcaagaaacgcaaccttaccatcatggatctgcaccccggctccggaaagacaagaaagtatctccctaccatcgtgcgggaagccattaaacgcagactgcggacactcatcctggctcccaccagagttgtggccgcggagatggaggaagcccttaagggcctgcctattcgctaccagacgacagctaccaaaagcgagcataccgggaaggaaatcgtcgacctgatgtgccacgccacatttaccatgcggctcctgtctcccgtgagagttcctaattataaccttattatcatggatgaggctcatttcacagacccggccagcatcgccgctcgcggatacatttccacccgggtgggcatgggggaagcggccgctatctttatgacggccacaccccctggaaccgccgatgctttcccccagtctaatgcccctattcaggacgaggagagagacatccccgaacgcagctggaactccggcaatgagtggattacagattttgtcgggaaaaccgtgtggttcgtgccgtctatcaaggcgggcaacgacattgctaactgtctgcggaagaatggcaaaaaggtcatccaactcagcagaaaaacgtttgataccgaatatcagaagacaaaactgaacgactgggatttcgttgtgaccacagacatctccgagatgggagccaattttaaggccgatcgcgtgattgaccctcggagatgcctgaagcccgtcatcctcaccgatgggcccgagcgggtgattcttgctggacctatgcccgttacagtggcctctgcggcccagcgcagaggccgggtcgggcgcaaccctcagaaagaaaatgaccaatacatcttcaccggacagccgctgaacaatgatgaggaccacgctcactggacggaagccaagatgctgctcgacaacattaatacacccgagggcatcatccctgctctgttcgaacccgagagagagaaaagcgccgctattgatggggaataccggcttaagggcgagtccagaaaaacctttgtggaactgatgcgccggggagacctccctgtttggctggcccataaggtggcgagcgagggcatcaaatataccgatagaaagtggtgcttcgacggggaacgcaacaatcagattctggaggagaacatggatgtcgaaatctggacaaaggagggagagaagaagaaactccggcccagatggcttgacgcccgcacctactctgatccgctggctctgaaggagtttaaagacttcgccgctggccggaagtccattgccctcgatctggtgacagaaatcgggagagtccctagccaccttgcctatcgcacgagatctgctctggacaatctcgtgatgctgcatacctccgagcacggaggccgggcgtaccgccacgccgttgaggaactgcccgagacaatggaaaccctccttctgctgggcctcatgatcctgcttacagggggagctatgctgtttctcattagcggcaaggggatcggaaaaacctccattggcctgatctgtgtggtggcctctagcgggatgctgtggatggccgatgtccctctccagtggattgcttccgccatcgttcttgagttctttatgatggtgctgctgattcccgagcctgaaaagcaaagaacgccccaggacaaccagctcgcgtatgtggtcatcggaatcctgacccttgccgctattgtggccgctaatgagatgggcctgctcgaaacaaccaaacgggatctgggcatgagcaaggagccgggggttgtgtctcctacatcctacctggacgtcgacctccatcccgccagcgcgtggaccctttatgccgtggctacgacagtcatcacccccatgctgcgccacacaattgaaaactctaccgccaatgtgagcctggctgccatcgctaaccaagccgttgtgctcatgggactggataaaggctggcctatttccaagatggaccttggggtcccgctgctcgcgctgggatgctactctcaggtgaaccccctgaccctcacagccgctgttcttctgctggtgacgcattacgccatcatcggccctgggctccaggctaaggccaccagagaggcccagaaacggacagcggctggaattatgaagaatcccaccgtcgatggcatcatgacaattgacctggatcctgtgatctatgacagcaaattcgagaagcaacttggccaggtgatgctgctcgttctgtgtgccgtccagctgctccttatgagaacctcctgggctttttgcgaagccctgacgctggccacagggcccattaccaccctctgggagggatctcctggcaaattctggaacacaaccatcgctgtgagcatggccaatatctttcgcgggtcctacctggcgggagccggccttgctttcagcattatgaagtctgtggggacaggaaagcggggcacgggctcccagggggaaaccctgggagagaaatggaagaaaaagctcaaccaactgagcagaaaagaatttgatctgtataagaaatccggcatcacagaggtcgaccgcaccaaggccaaggaggggctcaaacggggagaaacaacccaccatgctgtttctagaggcagcgccaaacttcagtggttcgtggagcggaatatggtgattccggaagggcgcgtcatcgatctgggatgtggcagaggcgggtggtcctactattgcgcgggactgaaaaaggtgacggaggttcggggctacaccaaagggggacccggccacgaagaacctgtgcccatgtctacatatgggtggaacattgtcaagctcatgagcggaaaggacgtgttctacctgcctcccgagaaatgtgatacccttctgtgcgacatcggcgaatccagcccgtctcctacagttgaggaatcccgcaccattagagtgctcaagatggtcgagccctggctgaaaaataaccagttttgtatcaaggtgctgaatccctacatgcctacagtgatcgagcacctcgaacggcttcagcgcaaacatggcgggatgctggtcagaaaccccctgagcagaaattctacccacgagatgtattggatttccaacggaacgggcaatatcgttagctctgtgaacatggtgagccgcctcctgcttaatagattcacaatgacccatcggagacctaccattgaaaaggatgtcgacctgggggccggaacacgccacgtgaacgctgagccggaaacgcccaacatggacgttatcggcgagcggattagacgcatcaaggaggaacactcctctacctggcattacgatgacgagaatccttataaaacatgggcctaccacgggagctatgaagtgaaggctaccggatccgccagctccatgatcaacggcgtcgtgaaactcctgacaaagccctgggatgttgtgcctaccgtcacacaaatggctatgaccgacacgaccccctttggccagcagcgggtgttcaaagagaaggttgatacaagaaccccgcgccctatgcccgggacacggaaggtgatggaaattaccgccgagtggctgtggagaacgctcggacgcaataaacggcctagactgtgcacacgcgaggaatttaccaagaaagtccggacaaacgcggccatgggcgctgtgttcaccgaggaaaatcaatgggactctgccagagctgccgtcgaggatgaagagttttggaaacttgtggaccgcgagagagaactgcataaactcgggaagtgtggaagctgcgtttacaacatgatgggcaaacgggagaagaagctgggggagttcggcaaagccaagggatcccgcgcgatctggtatatgtggcttggcgctagatacctggagtttgaggccctcgggttcctgaatgaagatcactggttttctcgggagaacagctactccggagtggaaggcgaggggctgcataaactcggatatattctgagagacatctctaagacgcccggcggggccatgtacgctgatgacaccgccggctgggacacacggattaccgaagatgaccttcacaatgaggagaaaatcacacagcagatggatcctgaacaccgccagctggctaacgccatcttcaagctcacctatcaaaataaggtcgtgaaagtgcagagacccacaccgaagggaaccgttatggacattatcagccggaaagatcagcgcggctccggacaggtgggaacgtacggcctgaacacatttaccaatatggaggcgcaacttattagacagatggaaggggagggagtcctgagcaaggccgacctcgaaaaccctcatctgcccgagaaaaagatcacccagtggctggagacaaagggcgtggaacggctcaaacgcatggctatttctggggatgactgcgttgtgaagcccatcgatgacagattcgccaatgctctgcttgccctgaacgatatgggcaaagtccggaaggacatccctcagtggcaaccgtccaaaggatggcacgattggcaacaggtgcccttctgtagccatcactttcacgagctcattatgaaggacggccgcaagctggtcgtgccttgcagaccccaggacgaacttatcgggcgggcgcgcatttctcaaggagccggctggtccctgaaagagaccgcttgtctcgggaaggcctatgctcagatgtggagcctgatgtacttccatagacgggatctgcgcctcgcctctaacgctatctgctccgccgttcctgtgcactgggtccccacaagcagaacgacctggtccattcatgcgcaccatcagtggatgacaaccgaagacatgctgacagtgtggaatcgggtttggatcgaggataacccttggatggaggacaaaacccccgtgacgacctgggaagatgtcccgtatcttggaaagagagaggaccaatggtgtggcagcctgattgggctcacatctcgcgccacctgggctcagaatatcctgacagccatccaacaggtgcggagccttattggcaacgaagagtttctggattacatgccttccatgaaaagattccgcaaggaggaagagtctgaaggagccatctggtga

SEQ ID NO: 20936 - RNA, 9873 nt, synthetic construct
  misc_feature 1..9873: note = derived and/or modified CDS sequence (opt5) from DENV-3__DQ675521__SS-prME
  source 1..9873: mol_type = other RNA
accagcttctgcctgatgatgatgctccccgccaccctggcttttcaccttacgtcccgggacggcgagcctcggatgatcgtggggaagaacgaacgcggaaagtctctcctgttcaagaccgccagcggcattaatatgtgtacactgatcgcgatggatcttggggagatgtgcgacgataccgtgacatacaaatgtccgctgattgctgaagttgagcccgaagacatcgattgctggtgtaacctcacctccacatgggtgacctatggaacgtgcaatcaggccggcgagcaccggcgggacaagcgctctgtggccctggctcctcacgtcgggatgggactggataccagaacacagacctggatgagcgccgagggcgcttggcggcaggtcgaaaaagttgagacatgggccctccgccatcccggctttaccattctggcgcttttcctggcccactacatcgggacgtccctcacacagaaggtggtcatctttattctgcttatgctggtgaccccttctatgacaatgagatgtgttggagtgggcaaccgggacttcgtcgaagggctcagcggagctacctgggtggatgtggtcctggagcatggcgggtgcgttaccacaatggccaagaataaacccacgctggacatcgagctccagaagaccgaagctacacagctggccacccttcgcaaactgtgtattgagggaaagatcacaaacattaccacggattccagatgccctacacagggcgaagcgatcctcccggaggaacaggaccagaattatgtgtgtaaacacacctacgtggatcggggctgggggaacggatgcggcctgtttgggaagggaagccttgtgacctgcgccaagttccaatgtctggagcccattgagggcaaagtggttcagtatgaaaatctcaagtacacagtgatcatcaccgtccacacaggggaccagcatcaggtgggaaacgacacgcaaggcgttaccgtggagattacacctcaggcttctaccgtcgaagccgtgctgcccgagtatggcacactggggctcgaatgctcccctcgcaccggactggattttaatgagatgatccttctgacgatgaaaaacaaggcttggatggtccacagacagtggttctttgacctccccctgccgtggaccagcggcgccacaaccgagacacctacctggaatcggaaagaacttctggtgacgttcaagaacgcccatgctaaaaagcaagaggttgtggtcctcgggtctcaggaaggagcgatgcacacagccctgaccggcgctacagagattcaaaattccgggggcaccagcatctttgccggacacctgaagtgtcgcctcaaaatggataagctggaacttaaaggcatgtcttacgccatgtgcctgaacaccttcgtgctcaagaaagaggtttccgagacacagcatgggacgattctgatcaaggtggaatacaagggagaggacgctccctgtaaaatccctttcagcaccgaagatggccaagggaaggcccacaacggaagactgattacagcgaatcccgtcgtgaccaaaaaggaggagcccgtgaacatcgaagctgagcctccgtttggcgaatccaatattgttatcgggattggcgacaaagcccttaagatcaactggtataagaaaggatctagcatcggcaagatgttcgaggccacagctagaggggctagacgcatggctattctcggagataccgcctgggactttggctccgtcgggggagtgctgaatagcctgggcaaaatggtgcatcagatcttcgggtctgcgtacacggccctcttttccggcgtcagctggattatgaagatcggaattggcgtgctgcttacatggatcgggctgaactctaaaaataccagcatgtccttctcttgcattgttatcggaatcattaccctctatctgggcgctgtggtccaggccgatatggggtgtgtgatcaactggaagggaaaggaactgaaatgcggcagcgggatttttgttacaaatgaggtgcacacctggacagagcagtacaagttccaagctgactcccccaaacggcttgccacggcgatcgccggcgcttgggaaaacggagtctgtggcattagaagcaccacacgcatggagaatctcctgtggaagcagatcgccaacgaactgaattatatcctctgggagaacaatattaaactgaccgtggttgtgggggatatcattggagtccttgaacagggcaagcggacactgacccctcagcccatggagctcaaatactcttggaagacgtgggggaaggctaaaatcgtgaccgccgagattcaaaactccagctttatcatcgacggacctaacacacccgaatgcccgtctgcctccagagcttggaatgtgtgggaggtcgaagactatggcttcggcgtttttaccacaaacatttggctgaagctgcgcgagatgtacacccagagctgtgatcatcggcttatgtccgcggccatcaaagacgaaagagctgtgcacgccgatatggggtactggattgagtctcagaagaatggaagctggaaactcgagaaggcctccttcatcgaagtgaagacatgcacctggcctaaatctcacacgctgtggagcaacggcgtcctggagtccgacatgattatccccaagagcctcgctgggcctatctctcagcataatcaccgccccggatatcatacacaaaccgccggcccttggcacctggggaaacttgaactggattttaactactgcgagggaaccacagtggttattaccgagaattgtggcacgcggggcccctccctcagaacaaccacagtgagcgggaagctgatccacgaatggtgctgtcgctcttgcaccctgccgcctcttcggtatatgggagaggacggctgttggtacgggatggaaattagacccatcaacgagaaagaagagaatatggtcaagtccctcgtgagcgcgggatctggcaaggttgataacttcacaatgggggtgctgtgcctggctattctcttcgaggaagtcatgcggggaaaatttggcaagaaacatatgatcgtgggcgttctgttcacctttgtgcttctgctcagcgggcagattacgtggcgcgacatggcccacaccctgatcatgatcggatccaatgccagcgatagaatgggcatgggggtcacatatctggctcttattgccaccttcaagatccagccctttctggcgctcggattctttctgcggaaactcacatctagagagaacctgcttctgggcgtggggctcgctatggccaccacgctgcaactgcctgaagacattgagcagatggccaatggaatcgctcttggcctgatgacactcaagctgattacccagttcgaaacataccagctctggaccgccctggtgtcccttacctgtagcaacacaatctttacgctgaccgtcgcttggcgcacagccaccctcatcctggcgggcgtttccctgcttccgctgtgccaatctagctccatgcggaagacagattggctccccatgaccgtggccgctatgggggtgcctcccctgcctctcttcatcttttctctgaaagacacgcccaagagacgcagctggcctcttaatgagggagtcatggccgtgggcctggtttccatcctggcttctagcctcctgagaaacgatgtgcccatggccgggccgcttgtcgccggaggcctgctcattgcttgttatgtgatcacagggacctccgcggacctgaccgttgagaaagccgctgacgtgacatgggaagaggaagccgagcagaccggagtcagccataacctcatgattacagtggatgacgatggcacgatgcggatcaaggacgatgaaaccgagaatatcctgacagtccttctgaaaaccgccctgctcattgtgtctggcatcttcccttactccattcccgctacactgcttgtttggcacacctggcagaagcagacgcaacgcagcggggtgctgtgggacgtcccttctcccccggagacccagaaagccgaactcgaggaaggagtgtacagaatcaagcagcagggcatttttgggaagacacaagttggagtgggcgtccagaaagagggggtgttccataccatgtggcacgtgacacggggagcggttctgacccacaacggcaagcgcctcgagcctaattgggcttccgtcaaaaaggatctgatcagctatggcgggggatggagactttctgcccagtggcaaaaaggcgaagaggtccaggtgattgccgtcgaacccgggaagaaccctaagaatttccagacaatgcccggaatctttcagacgaccacaggcgagatcggggctattgccctggacttcaaacccggaacctccggcagccctatcattaaccgggaaggcaaggtggttgggctgtacggaaatggcgtggtcaccaaaaacgggggatatgtgtccggcatcgcgcaaacaaatgctgagccggatgggcccacgcctgagctcgaagaggaaatgtttaagaaacgcaacctgaccattatggaccttcatcccggcagcggaaagacaagaaagtacctgcctgccatcgttcgggaggccatcaaacgcagactccggaccctgattctcgctcccacaagagtggtcgccgctgaaatggaggaggccctgaagggccttcctatccgctatcagaccacggcgacaaaatctgaacacaccgggcgggagattgtggatctgatgtgccatgccaccttcacaatgagactgctcagcccggttcgcgtgcccaattacaacctgatcattatggacgaagctcactttaccgatcctgcctccatcgctgcccggggatatatctctacaagagtcggcatgggggaggccgctgcgattttcatgaccgccacgccccctggaacagctgaagcctttccccagagcaatgccccgatccaggacgaggagcgcgacattcctgaacggtcctggaactctggcaatgagtggatcaccgatttcgtggggaagacagtgtggtttgtccccagcattaaagctggcaacgacatcgccaactgtcttagaaagaatggaaagaaagttattcaactgtcccgcaagaccttcgatacggaataccagaaaacccggctcaacgactgggattttgtggtgacaaccgacatctctgagatgggcgcgaatttcagagctgatcgggtcatcgacccccgcagatgcctgaagcctgtgattctgacagatgggcccgagcgggttatcctcgccggacctatgccggtgaccgccgctagcgccgcgcagcgcagaggccgggtcgggagaaacccccagaaagaaaatgaccaatacattttcacaggacagcctcttaacaatgatgaggaccatgcccactggaccgaagctaagatgctgctggacaacatcaatacgcccgagggcattatccctgccctctttgaacccgagcgcgagaagtccgctgccatcgatggggaatatcggctgaaaggcgagagcagaaagacattcgtggaacttatgcgccggggagacctgccggtttggctcgctcacaaagtggcctctgagggcattaagtacaccgatagaaaatggtgctttgacggggaacgcaacaatcagatcctggaggagaacatggatgtcgaaatttggaccaaggagggagaacggaaaaagctgagacctcgctggctcgacgcgagaacatattccgatccccttgccctgaaggagttcaaagactttgctgccggcagaaagagcatcgctctggatctcgtgaccgaaattgggcgcgtcccttctcatctggcccacagaacacggaatgcccttgacaacctggtgatgctccatacgtccgagcacggaggccgcgcttacagacacgcggttgaggaactgcccgagaccatggaaacactgctccttctgggcctgatgatcctcctgaccgggggagccatgcttttcctgatcagcggcaaagggattggaaagacatccatcggcctcatttgtgtgatcgtgtctagcgggatgctgtggatggctgatgtccctctgcagtggattgcctccgccatcgttctcgagtttttcatgatggtgcttctgattcccgagccggaaaaacaacggacccctcaggacaatcagctggcttatgtggtcatcggaatcctcacgctggccgcgattgtggccgctaacgagatgggccttctggaaaccacaaagagagatctcggcatgagcaaggagcccggggttgtgtctcccacctcctacctggacgtcgacctgcatcctgccagcgcttggacactctatgccgtggcgaccacggtcatcacaccgatgcttcgccacaccattgaaaattctacagccaacgtgagcctggctgccatcgctaaccaagccgttgtgctgatgggactcgataaaggctggcccatttccaagatggacctgggggtccctcttctggctctcggatgctactctcaggtgaatcccctgaccctgaccgccgcggttctccttctggtgacacattacgccatcatcggccctgggctgcaggctaaagccacgcgggaggctcagaagagaaccgccgccggaattatgaaaaaccccacagtcgatggcatcatgaccattgacctcgatcctgtgatctatgacagcaagtttgagaagcaactgggccaggtgatgcttctggttctctgtgcggtccagctgctgctcatgcgcacatcctgggctctttgcgaagccctgaccctggctacggggccgattacaaccctctgggagggatctcccggcaaattctggaataccacaatcgccgtgagcatggccaacatctttcgggggtcctacctggctggagccggccttgcgttcagcattatgaagtctgtggggaccggaagacggggcacaggctcccagggggaaacgctgggagagaaatggaagaaaaagctcaatcaactgagccgcaaggaatttgatctgtataaaaagtccggcatcaccgaggtcgacagaacagaggccaaagaagggctcaagcggggagagaccacacaccatgctgtttctcgcggcagcgccaaacttcagtggttcgtggaaagaaacatggtgattcctgaggggcgggtcatcgatctgggatgtggccgcggcgggtggtcctactattgcgctggactgaagaaagtgaccgaagttagaggctacacgaaaggcgggcccgggcacgaggagcctgtgcccatgtctacctatgggtggaatattgtcaagctcatgagcggaaaagacgtgttctacctgccgcctgaaaagtgtgatacacttctgtgcgacatcggcgagtccagcccctctcccaccgttgaagagtcccggacaattcgcgtgctcaaaatggtcgagccttggctgaagaacaatcagttttgtatcaaagtgctgaacccctacatgcctaccgtgatcgaacacctcgagagacttcagcggaagtatggcgggatgctggtcagaaatccgctgagccgcaactctacacatgaaatgtactggatttccaatggaaccggcaacatcgttagctctgtgaatatggtgagccggctcctgcttaacagattcacgatgacacaccgccggcccaccattgagaaggatgtcgacctgggggccggaaccagacatgtgaacgcggaacctgagacacccaatatggacgttatcggcgagcgcattaaacggatcaaggaagaacactcctctacgtggcactatgatgacgaaaacccttacaaaacctgggcctatcatgggagctacgaggtgaaggctacaggatccgccagctccatgatcaatggcgtcgtgaaactcctgaccaagccctgggatgttgtgccgatggtcacacaaatggctatgaccgacacaaccccttttggccagcagagagtgttcaaggaaaaagttgatacgcgcacaccccggcctatgcccgggacaagaaaggtgatggagattaccgccgagtggctgtggcgcacactcggacggaacaaaaagcctagactgtgcacccgcgaagagtttacgaaaaaggtcagaacaaatgctgccatgggcgcggtgttcaccgaagagaaccaatgggactctgcccgggctgccgtcgaagatgaggagttttggaaacttgtggaccgcgaaagagagctgcacaaactcgggaagtgtggaagctgcgtttataatatgatgggcaaacgggaaaagaaactgggggagttcggcaaggctaaaggatccagagccatctggtacatgtggcttggcgcccggtacctggagtttgaagcgctcgggttcctgaacgaggatcattggttttctcgcgaaaatagctattccggagtggagggcgaagggctgcacaagctcggatacattctgagagacatctctaagattcccggcggggctatgtatgccgatgacacagccggctgggacacccggatcacggaggatgaccttcataacgaggagaagattacccagcagatggatccggagcaccgccagctggctagcgccattttcaagctcacataccaaaataaagtcgtgaaggtgcagagacctacccccaaaggaacagttatggacatcatttcccggaaggatcagcgcggcagcggacaggtgggaacctatggcctgaacacatttaccaatatggaagctcaacttgtcagacagatggagggggaaggagtgctgtctaaggccgacctcgagaacccccatctgctggagaaaaagatcacgcagtggctcgaaacaaaaggcgttgagcggctgaagcgcatggcgatttccggggatgactgcgtggtcaaacctatcgatgacagattcgccaatgcccttctggccctcaacgatatgggcaaggtgcggaaggacatcccgcagtggcaacccagcaaaggatggcatgattggcagcaggtccctttctgttctcaccattttcacgaactgattatgaaggacggccgcaaacttgtggttccctgcagacctcaggacgagctgatcgggcgggctcgcatttcccaaggagccggctggagcctcaaggaaaccgcgtgtctggggaaagcctacgctcagatgtggtctctgatgtatttccacagacgggatctcagactggcctccaacgctatctgcagcgccgtgcccgtccattgggtgcctacctcccgcacaacctggagcattcacgctcatcaccagtggatgacaacggaggacatgcttaccgtttggaatcgggtgtggatcgaggataacccctggatggaagacaagacaccggtcaccacatgggaggatgtgccttacctgggaaagagagaagaccaatggtgtggctctctcattgggctgaccagccgcgccacgtgggcgcagaatatccttaccgccatccaacaggtgcggtccctgattggcgatgaggagtttctcgactacatgccctctatgaaaagattccgcaaggaagaggaaagcgagggagctatctggtga

SEQ ID NO: 20937 - RNA, 9873 nt, synthetic construct
  misc_feature 1..9873: note = derived and/or modified CDS sequence (opt5) from DENV-3__DQ675522__SS-prME
  source 1..9873: mol_type = other RNA
accagcttctgcctgatgatgatgctccccgccaccctggcttttcaccttacgtcccgggacggcgaacctcggatgattgtggggaagaacgaacgcggaaagtctctcctgttcaagaccgccagcggcattaatatgtgtacactgatcgcgatggatcttggggagatgtgcgacgataccgtgacatacaagtgtccgctgattgctgaagttgagcccgaagacatcgattgctggtgtaacctcacctccacatgggtgacctatggaacgtgcaatcaggccggcgagcacagacgggacaagcgctctgtggccctggctcctcacgtcgggatgggactggataccagaacacagacctggatgagcgccgagggcgcttggcggcaggtcgaaaaagttgagacatgggccctccgccatcccggctttaccattctggcgcttttcctggcccactacatcgggacgtccctcacacagaaggtggtcatctttattctgcttatgctggtgaccccttctatgacaatgagatgtgttggagtgggcaaccgggacttcgtcgaagggctcagcggagctacctgggtggatgtggtcctggagcatggcgggtgcgttaccacaatggccaagaataaacccacgctggacatcgagctccagaagaccgaagctacacagctggccacccttcgcaaactgtgtattgagggaaagatcacaaacattaccacggattccagatgccctacacagggcgaagcgatcctcccggaggaacaggaccagaattatgtgtgtaaacacacctacgtggatcggggctgggggaacggatgcggcctgtttgggaagggaagccttgtgacctgcgccaagttccaatgtctggagcccattgagggcaaagtggttcagtatgaaaatctcaagtacacagtgatcatcaccgtccacacaggggaccagcatcaggtgggaaacgacacgcaaggcgttaccgtggagattacacctcaggcttctaccgtcgaagccgtgctgcccgagtatggcacactggggctcgaatgctcccctcgcaccggactggattttaatgagatgatccttctgacgatgaaaaacaaggcttggatggtccacagacagtggttctttgacctccccctgccgtggaccagcggcgccacaaccgagacacctacctggaatcggaaagaacttctggtgacgttcaagaacgcccatgctaaaaagcaagaggttgtggtcctcgggtctcaggaaggagcgatgcacacagccctgaccggcgctacagagattcaaaattccgggggcaccagcatctttgccggacacctgaagtgtcgcctcaaaatggataagctggaacttaaaggcatgtcttacgccatgtgcctgaacaccttcgtgctcaagaaagaggtttccgagacacagcatgggacgattctgatcaaggtggaatacaagggagaggacgctccctgtaaaatccctttcagcaccgaagatggccaagggaaggcccacaacggaagactgattacagcgaatcccgtcgtgaccaaaaaggaggagcccgtgaacatcgaagctgagcctccgtttggcgaatccaatattgttatcgggattggcgacaaagcccttaagatcaactggtataagaaaggatctagcatcggcaagatgttcgaggccacagctagaggggctagacgcatggctattctcggagataccgcctgggactttggctccgtcgggggagtgctgaatagcctgggcaaaatggtgcatcagatcttcgggtctgcgtacacggccctcttttccggcgtcagctggattatgaagatcggaattggcgtgctgcttacatggatcgggctgaactctaaaaataccagcatgtccttctcttgcattgttatcggaatcattaccctctatctgggcgctgtggtccaggccgatatggggtgtgtgatcaactggaagggaaaggaactgaaatgcggcagcgggatttttgttacaaatgaggtgcacacctggacagagcagtacaagttccaagctgactcccccaaacggcttgccacggcgatcgccggcgcttgggaaaacggagtctgtggcattagaagcaccacacgcatggagaatctcctgtggaagcagatcgccaacgaactgaattatatcctctgggagaacaatattaaactgaccgtggttgtgggggatatcattggagtccttgaacagggcaagcggacactgacccctcagcccatggagctcaaatactcttggaagacgtgggggaaggctaaaatcgtgaccgccgagattcaaaactccagctttatcatcgacggacctaacacacccgaatgcccgtctgcctccagagcttggaatgtgtgggaggtcgaagactatggcttcggcgtttttaccacaaacatttggctgaagctgcgcgagatgtacacccagagctgtgatcatcggcttatgtccgcggccatcaaagacgaaagagctgtgcacgccgatatggggtactggattgagtctcagaagaatggaagctggaaactcgagaaggcctccttcatcgaagtgaagacatgcacctggcctaaatctcacacgctgtggagcaacggcgtcctggagtccgacatgattatccccaagagcctcgctgggcctatctctcagcataatcaccgccccggatatcatacacaaaccgccggcccttggcacctggggaaacttgaactggattttaactactgcgagggaaccacagtggttattaccgagaattgtggcacgcggggcccctccctcagaacaaccacagtgagcgggaagctgatccacgaatggtgctgtcgctcttgcaccctgccgcctcttcggtatatgggagaggacggctgttggtacgggatggaaattagacccatcaacgagaaagaagagaatatggtcaagtccctcgtgagcgcgggatctggcaaggttgataacttcacaatgggggtgctgtgcctggctattctcttcgaggaagtcatgcggggaaaatttggcaagaaacatatgatcgtgggcgttctgttcacctttgtgcttctgctcagcgggcagattacgtggcgcgacatggcccacaccctgatcatgatcggatccaatgccagcgatagaatgggcatgggggtcacatatctggctcttattgccaccttcaagatccagccctttctggcgctcggattctttctgcggaaactcacatctagagagaacctgcttctgggcgtggggctcgctatggccaccacgctgcaactgcctgaagacattgagcagatggccaatggaatcgctcttggcctgatgacactcaagctgattacccagttcgaaacataccagctctggaccgccctggtgtcccttacctgtagcaacacaatctttacgctgaccgtcgcttggcgcacagccaccctcatcctggcgggcgtttccctgcttccgctgtgccaatctagctccatgcggaagacagattggctccccatgaccgtggccgctatgggggtgcctcccctgcctctcttcatcttttctctgaaagacacgcccaagagacgcagctggcctcttaatgagggagtcatggccgtgggcctggtttccatcctggcttctagcctcctgagaaacgatgtgcccatggccgggccgcttgtcgccggaggcctgctcattgcttgttatgtgatcacagggacctccgcggacctgaccgttgagaaagccgctgacgtgacatgggaagaggaagccgagcagaccggagtcagccataacctcatgattacagtggatgacgatggcacgatgcggatcaaggacgatgaaaccgagaatatcctgacagtccttctgaaaaccgccctgctcattgtgtctggcatcttcccttactccattcccgctacactgcttgtttggcacacctggcagaagcagacgcaacgcagcggggtgctgtgggacgtcccttctcccccggagacccagaaagccgaactcgaggaaggagtgtacagaatcaagcagcagggcatttttgggaagacacaagttggagtgggcgtccagaaagagggggtgttccataccatgtggcacgtgacacggggagcggttctgacccacaacggcaagcgcctcgagcctaattgggcttccgtcaaaaaggatctgatcagctatggcgggggatggagactttctgcccagtggcaaaaaggcgaagaggtccaggtgattgccgtcgaacccgggaagaaccctaagaatttccagacaatgcccggaatctttcagacgaccacaggcgagatcggggctattgccctggacttcaaacccggaacctccggcagccctatcattaaccgggaaggcaaggtggttgggctgtacggaaatggcgtggtcaccaaaaacgggggatatgtgtccggcatcgcgcaaacaaatgctgagccggatgggcccacgcctgagctcgaagaggaaatgtttaagaaacgcaacctgaccattatggaccttcatcccggcagcggaaagacaagaaagtacctgcctgccatcgttcgggaggccatcaaacgcagactccggaccctgattctcgctcccacaagagtggtcgccgctgaaatggaggaggccctgaagggccttcctatccgctatcagaccacggcgacaaaatctgaacacaccgggcgggagattgtggatctgatgtgccatgccaccttcacaatgagactgctcagcccggttcgcgtgcccaattacaacctgatcattatggacgaagctcactttaccgatcctgcctccatcgctgcccggggatatatctctacaagagtcggcatgggggaggccgctgcgattttcatgaccgccacgccccctggaacagctgaagcctttccccagagcaatgccccgatccaggacgaggagcgcgacattcctgaacggtcctggaactctggcaatgagtggatcaccgatttcgtggggaagacagtgtggtttgtccccagcattaaagctggcaacgacatcgccaactgtcttagaaagaatggaaagaaagttattcaactgtcccgcaagaccttcgatacggaataccagaaaacccggctcaacgactgggattttgtggtgacaaccgacatctctgagatgggcgcgaatttcaaggctgatagagtcatcgacccccggcgctgcctgaaacctgtgattctgacagatgggcccgagagagttatcctcgccggacctatgccggtgaccgccgctagcgccgcgcagcggcgcggcagagtcgggcggaacccccagaaggaaaatgaccaatacattttcacaggacagcctcttaacaatgatgaggaccatgcccactggaccgaagctaagatgctgctggacaacatcaatacgcccgagggcattatccctgccctctttgaacccgagagagagaaatccgctgccatcgatggggaatatcgcctgaagggcgagagccggaaaacattcgtggaacttatgagacgcggagacctgccggtttggctcgctcacaaggtggcctctgagggcattaaatacaccgatcggaagtggtgctttgacggggaaagaaacaatcagatcctggaggagaacatggatgtcgaaatttggaccaaagagggagaacgcaagaagctgcggcctagatggctcgacgcgcgcacatattccgatccccttgccctgaaagagttcaaggactttgctgccggcagaaaaagcatcgctctggatctcgtgaccgaaattgggcgggtcccttctcatctggcccaccgcacaagaaatgcccttgacaacctggtgatgctccatacgtccgagcacggaggccgggcttaccgccacgcggttgaggaactgcccgagaccatggaaacactgctccttctgggcctgatgatcctcctgaccgggggagccatgcttttcctgatcagcggcaaggggattggaaaaacatccatcggcctcatttgtgtgatcgtgtctagcgggatgctgtggatggctgatgtccctctgcagtggattgcctccgccatcgttctcgagtttttcatgatggtgcttctgattcccgagccggaaaagcaaagaacccctcaggacaatcagctggcttatgtggtcatcggaatcctcacgctggccgcgattgtggccgctaacgagatgggccttctggaaaccacaaagcgggatctcggcatgagcaaagagcccggggttgtgtctcccacctcctacctggacgtcgacctgcatcctgccagcgcttggacactctatgccgtggcgaccacggtcatcacaccgatgcttagacacaccattgaaaattctacagccaacgtgagcctggctgccatcgctaaccaagccgttgtgctgatgggactcgataagggctggcccatttccaaaatggacctgggggtccctcttctggctctcggatgctactctcaggtgaatcccctgaccctgaccgccgcggttctccttctggtgacacattacgccatcatcggccctgggctgcaggctaaggccacgcgcgaggctcagaaacggaccgccgccggaattatgaagaaccccacagtcgatggcatcatgaccattgacctcgatcctgtgatctatgacagcaagtttgagaaacaactgggccaggtgatgcttctggttctctgtgcggtccagctgctgctcatgagaacatcctgggctctttgcgaagccctgaccctggctacggggccgattacaaccctctgggagggatctcccggcaagttctggaataccacaatcgccgtgagcatggccaacatctttcgcgggtcctacctggctggagccggccttgcgttcagcattatgaaatctgtggggaccggacggagaggcacaggctcccagggggaaacgctgggagagaagtggaaaaagaagctcaatcaactgagccggaaagaatttgatctgtataagaaatccggcatcaccgaggtcgaccgcacagaggccaaggaagggctcaaaagaggagagaccacacaccatgctgtttctcggggcagcgccaaacttcagtggttcgtggaacgcaacatggtgattcctgaggggagagtcatcgatctgggatgtggccggggcgggtggtcctactattgcgctggactgaaaaaggtgaccgaagttcgcggctacacgaaaggcgggcccgggcacgaggagcctgtgcccatgtctacctatgggtggaatattgtcaaactcatgagcggaaaggacgtgttctacctgccgcctgaaaaatgtgatacacttctgtgcgacatcggcgagtccagcccctctcccaccgttgaagagtccagaacaattcgggtgctcaagatggtcgagccttggctgaaaaacaatcagttttgtatcaaggtgctgaacccctacatgcctaccgtgatcgaacacctcgagcgccttcagagaaagtatggcgggatgctggtccggaatccgctgagcagaaactctacacatgaaatgtactggatttccaatggaaccggcaacatcgttagctctgtgaatatggtgagccgcctcctgcttaaccggttcacgatgacacacagacgccccaccattgagaaagatgtcgacctgggggccggaacccggcatgtgaacgcggaacctgagacacccaatatggacgttatcggcgagagaattaagcgcatcaaagaggaacactcctctacgtggcactatgatgacgaaaacccttacaagacctgggcctatcatgggagctacgaggtgaaagctacaggatccgccagctccatgatcaatggcgtcgtgaagctcctgaccaagccctgggatgttgtgccgatggtcacacaaatggctatgaccgacacaaccccttttggccagcagcgggtgttcaaagaaaaggttgatacgagaacaccccgccctatgcccgggacacggaaagtgatggagattaccgccgagtggctgtggagaacactcggacgcaacaagaaacctcggctgtgcaccagagaagagtttacgaagaaggtccgcacaaatgctgccatgggcgcggtgttcaccgaagagaaccaatgggactctgccagagctgccgtcgaagatgaggagttttggaaacttgtggaccgggaacgcgagctgcacaagctcgggaaatgtggaagctgcgtttataatatgatgggcaagagagagaagaagctgggggagttcggcaaagctaagggatcccgggccatctggtacatgtggcttggcgccagatacctggagtttgaagcgctcgggttcctgaacgaggatcattggttttctcgggaaaatagctattccggagtggagggcgaagggctgcacaagctcggatacattctgcgcgacatctctaaaattcccggcggggctatgtatgccgatgacacagccggctgggacaccagaatcacggaggatgaccttcataacgaggaaaagatcacccagcagatggatccggagcaccggcagctggctagcgccattttcaaactcacataccaaaataaggtcgtgaaagtgcagcgccctacccccaagggaacagttatggacatcatttccagaaaggatcagcggggcagcggacaggtgggaacctatggcctgaacacatttaccaatatggaagctcaacttgtccgccagatggagggggaaggagtgctgtctaaagccgacctcgagaacccccatctgctggagaagaaaatcacgcagtggctcgaaacaaagggcgttgagagactgaaacggatggcgatttccggggatgactgcgtggtcaagcctatcgatgaccgcttcgccaatgcccttctggccctcaacgatatgggcaaggtgagaaaagacatcccgcagtggcaacccagcaagggatggcatgattggcagcaggtccctttctgttctcaccattttcacgaactgattatgaaagacggccggaaacttgtggttccctgccgccctcaggacgagctgatcgggagagctcggatttcccaaggagccggctggagcctcaaagaaaccgcgtgtctggggaaggcctacgctcagatgtggtctctgatgtatttccaccgcagagatctccggctggcctccaacgctatctgcagcgccgtgcccgtccattgggtgcctacctccagaacaacctggagcattcacgctcatcaccagtggatgacaacggaggacatgcttaccgtttggaatcgcgtgtggatcgaggataacccctggatggaagacaagacaccggtcaccacatgggaggatgtgccttacctgggaaaacgggaagaccaatggtgtggctctctcattgggctgaccagcagagccacgtgggcgcagaatatccttaccgccatccaacaggtgcgctccctgattggcgatgaggagtttctcgactacatgccctctatgaagcggttcagaaaagaagaggaaagcgagggagctatctggtga

SEQ ID NO: 20938 - RNA, 9873 nt, synthetic construct
  misc_feature 1..9873: note = derived and/or modified CDS sequence (opt5) from DENV-3__DQ675527__SS-prME
  source 1..9873: mol_type = other RNA
accagcttctgcctgatgatgatgctccccgccaccctggcttttcaccttacgtcccgggacggagagcctcggatgattgtggggaagaacgaacgcggaaagtctctcctgttcaagaccgccagcggcattaatatgtgtacactgatcgcgatggatcttggggagatgtgcgacgataccgtgacatacaaatgtccgctgattgctgaagttgagcccgaagacatcgattgctggtgtaacctcacctccacatgggtgacctatggaacgtgcaatcaggccggcgagcacagacgggacaagcgctctgtggccctggctcctcacgtcgggatgggactggataccagaacacagacctggatgagcgccgagggcgcttggcggcaggtcgaaaaagttgagacatgggccctccgccatcccggctttaccattctggcgcttttcctggcccactacatcgggacgtccctcacacagaaggtggtcatctttattctgcttatgctggtgaccccttctatgacaatgagatgtgttggagtgggcaaccgggacttcgtcgaagggctcagcggagctacctgggtggatgtggtcctggagcatggcgggtgcgttaccacaatggccaagaataaacccacgctggacatcgagctccagaagaccgaagctacacagctggccacccttcgcaaactgtgtattgagggaaagatcacaaacattaccacggattccagatgccctacacagggcgaagcgatcctcccggaggaacaggaccagaattatgtgtgtaaacacacctacgtggatcggggctgggggaacggatgcggcctgtttgggaagggaagccttgtgacctgcgccaagttccaatgtctggagcccattgagggcaaagtggttcagtatgaaaatctcaagtacacagtgatcatcaccgtccacacaggggaccagcatcaggtgggaaacgacacgcaaggcgttaccgtggagattacacctcaggcttctaccgtcgaagccgtgctgcccgagtatggcacactggggctcgaatgctcccctcgcaccggactggattttaatgagatgatccttctgacgatgaaaaacaaggcttggatggtccacagacagtggttctttgacctccccctgccgtggaccagcggcgccacaaccgagacacctacctggaatcggaaagaacttctggtgacgttcaagaacgcccatgctaaaaagcaagaggttgtggtcctcgggtctcaggaaggagcgatgcacacagccctgaccggcgctacagagattcaaaattccgggggcaccagcatctttgccggacacctgaagtgtcgcctcaaaatggataagctggaacttaaaggcatgtcttacgccatgtgcctgaacaccttcgtgctcaagaaagaggtttccgagacacagcatgggacgattctgatcaaggtggaatacaagggagaggacgctccctgtaaaatccctttcagcaccgaagatggccaagggaaggcccacaacggaagactgattacagcgaatcccgtcgtgaccaaaaaggaggagcccgtgaacatcgaagctgagcctccgtttggcgaatccaatattgttatcgggattggcgacaaagcccttaagatcaactggtataagaaaggatctagcatcggcaagatgttcgaggccacagctagaggggctagacgcatggctattctcggagataccgcctgggactttggctccgtcgggggagtgctgaatagcctgggcaaaatggtgcatcagatcttcgggtctgcgtacacggccctcttttccggcgtcagctggattatgaagatcggaattggcgtgctgcttacatggatcgggctgaactctaaaaataccagcatgtccttctcttgcattgttatcggaatcattaccctctatctgggcgctgtggtccaggccgatatggggtgtgtgatcaactggaagggaaaggaactgaaatgcggcagcgggatttttgttacaaatgaggtgcacacctggacagagcagtacaagttccaagctgactcccccaaacggcttgccacggcgatcgccggcgcttgggaaaacggagtctgtggcattagaagcaccacacgcatggagaatctcctgtggaagcagatcgccaacgaactgaattatatcctctgggagaacaatattaaactgaccgtggttgtgggggatatcattggagtccttgaacagggcaagcggacactgacccctcagcccatggagctcaaatactcttggaagacgtgggggaaggctaaaatcgtgaccgccgagattcaaaactccagctttatcatcgacggacctaacacacccgaatgcccgtctgcctccagagcttggaatgtgtgggaggtcgaagactatggcttcggcgtttttaccacaaacatttggctgaagctgcgcgagatgtacacccagagctgtgatcatcggcttatgtccgcggccatcaaagacgaaagagctgtgcacgccgatatggggtactggattgagtctcagaagaatggaagctggaaactcgagaaggcctccttcatcgaagtgaagacatgcacctggcctaaatctcacacgctgtggagcaacggcgtcctggagtccgacatgattatccccaagagcctcgctgggcctatctctcagcataatcaccgccccggatatcatacacaaaccgccggcccttggcacctggggaaacttgaactggattttaactactgcgagggaaccacagtggttattaccgagaattgtggcacgcggggcccctccctcagaacaaccacagtgagcgggaagctgatccacgaatggtgctgtcgctcttgcaccctgccgcctcttcggtatatgggagaggacggctgttggtacgggatggaaattagacccatcaacgagaaagaagagaatatggtcaagtccctcgtgagcgcgggatctggcaaggttgataacttcacaatgggggtgctgtgcctggctattctcttcgaggaagtcatgcggggaaaatttggcaagaaacatatgatcgtgggcgttctgttcacctttgtgcttctgctcagcgggcagattacgtggcgcgacatggcccacaccctgatcatgatcggatccaatgccagcgatagaatgggcatgggggtcacatatctggctcttattgccaccttcaagatccagccctttctggcgctcggattctttctgcggaaactcacatctagagagaacctgcttctgggcgtggggctcgctatggccaccacgctgcaactgcctgaagacattgagcagatggccaatggaatcgctcttggcctgatgacactcaagctgattacccagttcgaaacataccagctctggaccgccctggtgtcccttacctgtagcaacacaatctttacgctgaccgtcgcttggcgcacagccaccctcatcctggcgggcgtttccctgcttccgctgtgccaatctagctccatgcggaagacagattggctccccatgaccgtggccgctatgggggtgcctcccctgcctctcttcatcttttctctgaaagacacgcccaagagacgcagctggcctcttaatgagggagtcatggccgtgggcctggtttccatcctggcttctagcctcctgagaaacgatgtgcccatggccgggccgcttgtcgccggaggcctgctcattgcttgttatgtgatcacagggacctccgcggacctgaccgttgagaaagccgctgacgtgacatgggaagaggaagccgagcagaccggagtcagccataacctcatgattacagtggatgacgatggcacgatgcggatcaaggacgatgaaaccgagaatatcctgacagtccttctgaaaaccgccctgctcattgtgtctggcatcttcccttactccattcccgctacactgcttgtttggcacacctggcagaagcagacgcaacgcagcggggtgctgtgggacgtcccttctcccccggagacccagaaagccgaactcgaggaaggagtgtacagaatcaagcagcagggcatttttgggaagacacaagttggagtgggcgtccagaaagagggggtgttccataccatgtggcacgtgacacggggagcggttctgacccacaacggcaagcgcctcgagcctaattgggcttccgtcaaaaaggatctgatcagctatggcgggggatggagactttctgcccagtggcaaaaaggcgaagaggtccaggtgattgccgtcgaacccgggaagaaccctaagaatttccagacaatgcccggaatctttcagacgaccacaggcgagatcggggctattgccctggacttcaaacccggaacctccggcagccctatcattaaccgggaaggcaaggtggttgggctgtacggaaatggcgtggtcaccaaaaacgggggatatgtgtccggcatcgcgcaaacaaatgctgagccggatgggcccacgcctgagctcgaagaggaaatgtttaagaaacgcaacctgaccattatggaccttcatcccggcagcggaaagacaagaaagtacctgcctgccatcgttcgggaggccatcaaacgcagactccggaccctgattctcgctcccacaagagtggtcgccgctgaaatggaggaggccctgaagggccttcctatccgctatcagaccacggcgacaaaatctgaacacaccgggcgggagattgtggatctgatgtgccatgccaccttcacaatgagactgctcagcccggttcgcgtgcccaattacaacctgatcattatggacgaagctcactttaccgatcctgcctccatcgctgcccggggatatatctctacaagagtcggcatgggggaggccgctgcgattttcatgaccgccacgccccctggaacagctgaagcctttccccagagcaatgccccgatccaggacgaggagcgcgacattcctgaacggtcctggaactctggcaatgagtggatcaccgatttcgtggggaagacagtgtggtttgtccccagcattaaagctggcaacgacatcgccaactgtcttagaaagaatggaaagaaagttattcaactgtcccgcaagaccttcgatacggaataccagaaaacccggctcaacgactgggattttgtggtgacaaccgacatctctgagatgggcgcgaatttcaaggctgatagagtcatcgacccccggcgctgcctgaaacctgtgattctgacagatgggcccgagagagttatcctcgccggacctatgccggtgaccgccgctagcgccgcgcagcggcgcggcagagtcgggcggaacccccagaaggaaaatgaccaatacattttcacaggacagcctcttaacaatgatgaggaccatgcccactggaccgaagctaagatgctgctggacaacatcaatacgcccgagggcattatccctgccctctttgaacccgagagagagaaatccgctgccatcgatggggaatatcgcctgaagggcgagagccggaaaacattcgtggaacttatgagacgcggagacctgccggtttggctcgctcacaaggtggcctctgagggcattaaatacaccgatcggaagtggtgctttgacggggaaagaatcaaccagattctggaggagaatatggatgtcgaaatctggaccaaagagggagaacgcaagaacctgcggcctagatggctcgacgcgcgcacatattccgatccccttgccctgaaggagttcaaagactttgctgccggcagaaagagcattgctctggatctcgtgaccgaaatcgggcgggtcccttctcatctggcccaccgcacaagaaatgcccttgacaacctggtgatgctccatacgtccgagcacggaggccgggcttaccgccacgcggttgaggaactgcccgagaccatggaaacactgctccttctgggcctgatgatcctcctgaccgggggagccatgcttttcctgattagcggcaaagggatcggaaagacatccattggcctcatctgtgtgattgtgtctagcgggatgctgtggatggctgatgtccctctgcagtggatcgcctccgccattgttctcgagtttttcatgatggtgcttctgatccccgagccggaaaaacaaagaacccctcaggacaatcagctggcttatgtggtcatcggcattctcacgctggccgcgatcgtggccgctaacgagatgggccttctggaaaccacaaagcgggatctcggcatgagcaaggagcccggggttgtgtctcccacctcctacctggacgtcgacctgcatcctgccagcgcttggacactctatgccgtggcgaccacggtcattacaccgatgcttagacacaccatcgaaaattctacagccaacgtgagcctggctgccattgctaaccaagccgttgtgctgatgggactcgataaaggctggcccatctccaagatggacctgggggtccctcttctggctctcggatgctactctcaggtgaatcccctgaccctgaccgccgcggttctccttctggtgacacattacgccatcattggccctgggctgcaggctaaagccacgcgcgaggctcagaagcggaccgccgccggaatcatgaaaaaccccacagtcgatggcattatgaccatcgacctcgatcctgtgatttatgacagcaagtttgagaagcaactgggccaggtgatgcttctggttctctgtgcggtccagctgctgctcatgagaacatcctgggctctttgcgaagccctgaccctggctacggggccgatcacaaccctctgggagggatctcccggcaaattctggaataccacaatcgccgtgagcatggccaacatttttcgcgggtcctacctggctggagccggccttgcgttcagcatcatgaagtctgtggggaccggacggagaggcacaggctcccagggggaaacgctgggagagaaatggaagaaaaagctcaatcaactgagccggaaggaatttgatctgtataaaaagtccggcattaccgaggtcgaccgcacagaggccaaagaagggctcaagagaggagagaccacacaccatgctgtttctcggggcagcgccaaacttcagtggttcgtggaacgcaacatggtgatccctgaggggagagtcattgatctgggatgtggccggggcgggtggtcctactattgcgctggactgaagaaagtgaccgaagttcgcggctacacgaaaggcgggcccgggcacgaggagcctgtgcccatgtctacctatgggtggaatatcgtcaagctcatgagcggaaaagacgtgttctacctgccgcctgaaaagtgtgatacacttctgtgcgacattggcgagtccagcccctctcccaccgttgaagagtccagaacaatccgggtgctcaaaatggtcgagccttggctgaagaacaatcagttttgtatcaaagtgctgaacccctacatgcctaccgtgattgaacacctcgagcgccttcagagaaagtatggcgggatgctggtccggaatccgctgagcagaaactctacacatgaaatgtactggatctccaatggaaccggcaacattgttagctctgtgaatatggtgagccgcctcctgcttaaccggttcacgatgacacacagacgccccaccatcgagaaggatgtcgacctgggggccggaacccggcatgtgaacgcggaacctgagacacccaatatggacgttattggcgagagaatcaaacgcatcaaggaagaacactcctctacgtggcactatgatgacgaaaacccttacaaaacctgggcctatcatgggagctacgaggtgaaggctacaggatccgccagctccatgattaatggcgtcgtgaaactcctgaccaagccctgggatgttgtgccgatggtcacacaaatggctatgaccgacacaaccccttttggccagcagcgggtgttcaaggaaaaagttgatacgagaacaccccgccctatgcccgggacacggaaggtgatggagatcaccgccgagtggctgtggagaacactcggacgcaacaaaaagcctcggctgtgcaccagagaagagtttacgaaaaaggtccgcacaaatgctgccatgggcgcggtgttcaccgaagagaaccaatgggactctgccagagctgccgtcgaagatgaggagttttggaaacttgtggaccgggaacgcgagctgcacaaactcgggaagtgtggaagctgcgtttataatatgatgggcaaaagagaaaagaaactgggggagttcggcaaggctaaaggatcccgggccatttggtacatgtggcttggcgccagatacctggagtttgaagcgctcgggttcctgaacgaggatcattggttttctcgggaaaatagctattccggagtggagggcgaagggctgcacaagctcggatacatcctgcgcgacatttctaagatccccggcggggctatgtatgccgatgacacagccggctgggacaccagaatcacggaggatgaccttcataacgaggagaagattacccagcagatggatccggagcaccggcagctggctagcgccatcttcaagctcacataccaaaataaagtcgtgaaggtgcagcgccctacccccaaaggaacagttatggacattatctccagaaaggatcagcggggcagcggacaggtgggaacctatggcctgaacacatttaccaatatggaagctcaacttgtccgccagatggagggggaaggagtgctgtctaaggccgacctcgagaacccccatctgctggagaaaaagattacgcagtggctcgaaacaaaaggcgttgagagactgaagcggatggcgatctccggggatgactgcgtggtcaaacctatcgatgaccgcttcgccaatgcccttctggccctcaacgatatgggcaaggtgagaaaggacattccgcagtggcaacccagcaaaggatggcatgattggcagcaggtccctttctgttctcaccattttcacgaactgatcatgaaggacggccggaaacttgtggttccctgccgccctcaggacgagctgattgggagagctcggatctcccaaggagccggctggagcctcaaggaaaccgcgtgtctggggaaagcctacgctcagatgtggtctctgatgtatttccaccgcagagatctccggctggcctccaacgctatttgcagcgccgtgcccgtccattgggtgcctacctccagaacaacctggagcatccacgctcatcaccagtggatgacaacggaggacatgcttaccgtttggaatcgcgtgtggattgaggataacccctggatggaagacaagacaccggtcaccacatgggaggatgtgccttacctgggaaagcgggaagaccaatggtgtggctctctcatcgggctgaccagcagagccacgtgggcgcagaatatccttaccgccattcaacaggtgcgctccctgatcggcgatgaggagtttctcgactacatgccctctatgaaacggttcagaaaggaagaggaaagcgagggagctatttggtga

SEQ ID NO: 20939 - RNA, 9873 nt, synthetic construct
  misc_feature 1..9873: note = derived and/or modified CDS sequence (opt5) from DENV-3__DQ675528__SS-prME
  source 1..9873: mol_type = other RNA
accagcttctgcctgatgatgatgctccccgccacactggcttttcaccttacgtccagagacggcgagcctcggatgatcgtggggaagaacgaacgcggaaaatctctgctcttcaagaccgccagcggcattaatatgtgtacactgatcgcgatggatcttggggagatgtgcgacgataccgtcacatacaaatgtccgctgattgctgaagttgagcccgaagacatcgattgctggtgtaacctcacctccacatgggtgacctatggaacgtgcaatcaggccggcgagcatagacgggacaagcgctctgtggccctggctcctcacgtcgggatgggactggataccagaacacaaacctggatgagcgccgagggcgcttggcggcaggtggaaaaagttgagacatgggccctccgccatcccggctttaccattctggcgcttttcctggcccactacatcgggacgtccctcacacagaaggtggtcatctttattctgcttatgctggtgaccccttctatgacaatgagatgtgttggagtgggcaaccgggacttcgtcgaagggctcagcggagctacctgggtggatgtggtcctggagcatggcgggtgcgttaccacaatggccaagaataaacccacgctggacatcgagctccagaagaccgaagctacacaactggccacccttcgcaaactgtgtattgagggaaagatcacaaacattaccacggattccagatgccctacacagggcgaagcgatcctcccggaggaacaggaccagaattatgtgtgtaaacacacctacgtggatcggggctgggggaacggatgcggcctgtttgggaagggaagccttgtcacctgcgccaagttccaatgtctggagcccattgagggcaaagtggttcagtatgaaaatctcaagtacacagtgatcatcaccgtccacacaggggaccagcatcaggtgggaaacgacacgcaaggcgttaccgtggagattacacctcaggcttctaccgtcgaagccgtgctgcccgagtatggcacactggggctcgaatgctcccctcgcaccggactggattttaatgagatgatccttctgacgatgaaaaacaaggcttggatggtccacagacagtggttctttgacctccccctgccgtggaccagcggcgccacaaccgagacacctacctggaatcggaaagaacttctggtgacgttcaagaacgcccatgctaaaaagcaagaggttgtggtcctcgggtctcaggaaggagcgatgcacacagtgctgaccggcgccacagagattcagaattccgggggcaccagcatctttgctggacacctgaagtgtcgcctcaaaatggataagctggaacttaaaggcatgtcttacgccatgtgcctgaacaccttcgttctcaagaaagaggtgtccgagacacagcatgggacgattctgatcaaggtcgaatacaagggagaggacgccccctgtaaaatccctttcagcaccgaagatggccaagggaaggctcacaacggaagactgattacagccaatcccgtggtgaccaaaaaggaggagcccgttaacatcgaagcggagcctccgtttggcgaatccaatattgtcatcgggattggcgacaaagctcttaagatcaactggtataagaaaggatctagcatcggcaagatgttcgaggccacagcccggggggctagacgcatggccattctcggagataccgcttgggactttggctccgtggggggagtgctgaatagcctgggcaaaatggtccatcagatcttcgggtctgcctacacggcgctcttttccggcgtgagctggattatgaagatcggaattggcgttctgcttacatggatcgggctgaactctaaaaataccagcatgtccttctcttgcattgtgatcggaatcattaccctctatctgggcgccgtcgtgcaggctgatatggggtgtgttatcaactggaagggaaaggaactgaaatgcggcagcgggatttttgtgacaaatgaggtccacacctggacagagcagtacaagttccaagccgactcccccaaacggcttgctacggccatcgcgggcgcctgggaaaacggagtgtgtggcattagaagcaccacacgcatggagaatctcctgtggaagcagatcgctaacgaactgaattatatcctctgggagaacaatattaaactgaccgttgtggtcggggatatcattggagtgcttgaacagggcaagcggacactgacccctcagcccatggagctcaaatactcttggaagacgtgggggaaggccaaaatcgtgaccgctgagattcaaaactccagctttatcatcgacggacctaacacacccgaatgcccgtctgcctccagagcctggaatgtctgggaggttgaagactatggcttcggcgtgtttaccacaaacatttggctgaagctgcgcgagatgtacacccagagctgtgatcatcggcttatgtccgctgcgatcaaagacgaaagagccgtgcacgctgatatggggtactggattgagtctcagaagaatggaagctggaaactcgagaaggcctccttcatcgaagtcaagacatgcacctggcctaaatctcacacgctgtggagcaacggcgtgctggagtccgacatgattatccccaagagcctcgccgggcctatctctcagcataatcaccgccccggatatcatacacaaaccgctggcccttggcacctggggaaacttgaactggattttaactactgcgagggaaccacagttgtgattaccgagaattgtggcacgcggggcccctccctcagaacaaccacagtcagcgggaagctgatccacgaatggtgctgtcgctcttgcaccctgccgcctcttcggtatatgggagaggacggctgttggtacgggatggaaattagacccatcaacgagaaagaagagaatatggtgaagtccctcgttagcgccggatctggcaaggtggataacttcacaatgggggtcctgtgcctggcgattctcttcgaggaagtgatgcggggaaaatttggcaagaaacatatgatcgttggcgtgctgttcacctttgtccttctgctcagcgggcagattacgtggcgcgacatggctcacaccctgatcatgatcggatccaatgccagcgatagaatgggcatgggggtgacatatctggcccttattgctaccttcaagatccagccctttctggccctcggattctttctgcggaaactcacatctagagagaacctgcttctgggcgtggggctcgcgatggctaccacgctgcaactgcctgaagacattgagcagatggccaatggaatcgcccttggcctgatgacactcaagctgattacccagttcgaaacataccagctctggaccgctctggtctcccttacctgtagcaacacaatctttacgctgaccgttgcctggcgcacagctaccctcatcctggccggcgtgtccctgcttccgctgtgccaatctagctccatgcggaagacagattggctccccatgaccgtggcggccatgggggtccctcccctgcctctcttcattttttctctgaaagacacgcccaagagacgcagctggcctcttaatgagggagtgatggctgttggcctggtgtccatcctggcctctagcctcctgagaaacgatgtccccatggctgggccgcttgtggccggaggcctgctcattgcctgttatgttatcacagggacctccgctgacctgaccgtggagaaagcggccgacgtcacatgggaagaggaagctgagcagaccggagtgagccataacctcatgattacagtcgatgacgatggcacgatgcggatcaaggacgatgaaaccgagaatatcctgacagtgcttctgaaaaccgccctgctcattgtttctggcatcttcccttactccattcccgccacactgcttgtgtggcacacctggcagaagcagacgcaacgcagcggggtcctgtgggacgtgccttctcccccggagacccagaaagctgaactcgaggaaggagtttacagaatcaagcagcagggcatttttgggaagacacaagtgggagtcggcgtgcagaaagagggggtgttccataccatgtggcacgttacacggggagccgtcctgacccacaacggcaagcgcctcgagcctaattgggcgtccgtgaaaaaggatctgatcagctatggcgggggatggagactttctgctcagtggcaaaaaggcgaagaggtgcaggtcattgccgtggaacccgggaagaaccctaagaatttccagacaatgcccggaatctttcagacgaccacaggcgagatcggggccattgctctggacttcaaacccggaacctccggcagccctatcattaaccgggaaggcaaggttgtggggctgtacggaaatggcgtcgtgaccaaaaacgggggatatgtttccggcatcgcccaaacaaatgcggagccggatgggcccacgcctgagctcgaagaggaaatgtttaagaaacgcaacctgaccattatggaccttcatcccggcagcggaaagacaagaaagtacctgcctgctatcgtgcgggaggccatcaaacgcagactccggaccctgattctcgcccccacaagagtcgtggctgccgaaatggaggaggctctgaagggccttcctatccgctatcagaccacggccacaaaatctgaacacaccgggcgggagattgttgatctgatgtgccatgcgaccttcacaatgagactgctcagcccggtgcgcgtccccaattacaacctgatcattatggacgaagcccactttaccgatcctgcttccatcgccgctcggggatatatctctacaagagtgggcatgggggaggccgccgctattttcatgaccgcgacgccccctggaacagccgaagcttttccccagagcaatgccccgatccaggacgaggagcgcgacattcctgaacggtcctggaactctggcaatgagtggatcaccgatttcgtggggaagacagtctggtttgttcccagcattaaagccggcaacgacatcgctaactgtcttagaaagaatggaaagaaagtgattcaactgtcccgcaagaccttcgatacggaataccagaaaacccggctcaacgactgggattttgtggtcacaaccgacatctctgagatgggcgccaatttcaaggcggatagagtgatcgacccccggcgctgcctgaaacctgttattctgacagatgggcccgagagagtgatcctcgctggacctatgccggtcaccgccgccagcgctgcccagcggcgcggcagagtggggcggaacccccagaaggaaaatgaccaatacattttcacaggacagcctcttaacaatgatgaggaccatgcgcactggaccgaagccaagatgctgctggacaacatcaatacgcccgagggcattatccctgctctctttgaacccgagagagagaaatccgccgctatcgatggggaatatcgcctgaagggcgagagccggaaaacattcgttgaacttatgagacgcggagacctgccggtgtggctcgcccacaaggtcgcttctgagggcattaaatacaccgatcggaagtggtgctttgacggggaaagaaacaatcagatcctggaggagaacatggatgtggaaatttggaccaaagagggagaacgcaagaagctgcggcctagatggctcgacgcccgcacatattccgatccccttgcgctgaaagagttcaaggactttgccgctggcagaaaaagcatcgccctggatctcgtcaccgaaattgggcgggtgccttctcatctggctcaccgcacaagaaatgcccttgacaacctggttatgctccatacgtccgagcacggaggccgggcctaccgccacgctgtggaggaactgcccgagaccatggaaacactgctccttctgggcctgatgatcctcctgaccgggggagcgatgcttttcctgatcagcggcaaggggattggaaaaacatccatcggcctcatttgtgtgatcgtctctagcgggatgctgtggatggccgatgttcctctgcagtggattgcttccgccatcgtgctcgagtttttcatgatggtgcttctgattcccgagccggaaaagcaaagaacccctcaggacaatcagctggcctatgtcgtgatcggaatcctcacgctggctgccattgttgcggccaacgagatgggccttctggaaaccacaaagcgggatctcggcatgagcaaagagcccggggtggtctctcccacctcctacctggacgtggacctgcatcctgctagcgcctggacactctatgctgtcgccaccacggtgatcacaccgatgcttagacacaccattgaaaattctacagcgaacgttagcctggccgctatcgccaaccaagctgtggtcctgatgggactcgataagggctggcccatttccaaaatggacctgggggtgcctcttctggccctcggatgctactctcaggttaatcccctgaccctgaccgctgccgtgctccttctggtcacacattacgcgatcatcggccctgggctgcaggccaaggctacgcgcgaggcccagaaacggaccgctgccggaattatgaagaaccccacagtggatggcatcatgaccattgacctcgatcctgtgatctatgacagcaagtttgagaaacaactgggccaggttatgcttctggtcctctgtgccgtgcagctgctgctcatgagaacatcctgggcgctttgcgaagctctgaccctggccacggggccgattacaaccctctgggagggatctcccggcaagttctggaataccacaatcgctgtgagcatggccaacatctttcgcgggtcctacctggccggagctggccttgccttcagcattatgaaatctgtcgggaccggacggagaggcacaggctcccagggggaaacgctgggagagaagtggaaaaagaagctcaatcaactgagccggaaagaatttgatctgtataagaaatccggcatcaccgaggttgaccgcacagaggcgaaggaagggctcaaaagaggagagaccacacaccatgccgtgtctcggggcagcgctaagcttcagtggttcgtggaacgcaacatggtcattcctgaggggagagtgatcgatctgggatgtggccggggcgggtggtcctactattgcgccggactgaaaaaggttaccgaagtgcgcggctacacgaaggggggacccggccacgaggagcctgtccccatgtctacctatgggtggaatattgtgaaactcatgagcggaaaggacgttttctacctgccgcctgaaaaatgtgatacacttctgtgcgacatcggcgagtccagcccctctcccaccgtggaagagtccagaacaattcgggtcctcaagatggtggagccttggctgaaaaacaatcagttttgtatcaaggtgctgaacccctacatgcctaccgtcatcgaacacctcgagcgccttcagagaaagtatggcgggatgctggttcggaatccgctgagcagaaactctacacatgaaatgtactggatttccaatggaaccggcaacatcgtgagctctgtgaatatggtcagccgcctcctgcttaaccggttcacgatgacacacagacgccccaccattgagaaagatgtggacctgggggctggaacccggcatgttaacgccgaacctgagacacccaatatggacgtgatcggcgagagaattaagcgcatcaaagaagagcactcctctacgtggcactatgatgacgaaaacccttacaagacctgggcgtatcatgggagctacgaggtcaaagccacaggatccgctagctccatgatcaatggcgtggttaagctcctgaccaagccctgggatgtggtcccgatggtgacacaaatggccatgaccgacacaaccccttttggccagcagcgggttttcaaagaaaaggtggatacgagaaccccccgccctatgcccgggacacggaaagtcatggagattaccgctgagtggctgtggagaacactcggacgcaacaagaaacctcggctgtgcaccagagaagagtttacgaagaaggtgcgcacaaatgccgctatgggcgccgtcttcaccgaagagaaccaatgggactctgcgagagccgctgtggaagatgaggagttttggaaacttgttgaccgggaacgcgagctgcacaagctcgggaaatgtggaagctgcgtgtataatatgatgggcaagagagaaaaaaagctgggggagttcggcaaagccaagggatcccgggctatctggtacatgtggcttggcgccagatacctggagtttgaagccctcgggttcctgaacgaggatcattggttttctcgggaaaatagctattccggagtcgagggcgaagggctgcacaagctcggatacattctgcgcgacatctctaaaattcccggcggggcgatgtatgctgatgacacagccggctgggacaccagaatcacggaggatgaccttcataacgaggaaaagatcacccagcagatggatccggagcaccggcagctggccagcgctattttcaaactcacataccaaaataaggtggtgaaagttcagcgccctacccccaagggaacagtgatggacatcatttccagaaaggatcagcggggcagcgggcaggtcggaacctatggcctgaacacatttaccaatatggaagcccaacttgtgcgccagatggagggggaaggagttctgtctaaagctgacctcgagaacccccacctgctggagaagaaaatcacgcagtggctcgaaacaaagggcgtggagagactgaaacggatggccatttccggggatgactgcgtcgtgaagcctatcgatgaccgcttcgcgaatgcccttctggctctcaacgatatgggcaaggtcagaaaagacatcccgcagtggcaacccagcaagggatggcatgattggcagcaggtgcctttctgttctcaccattttcacgaactgattatgaaagacggccggaagcttgttgtgccctgccgccctcaggacgagctgatcgggagagcccggatttcccaaggagctggctggagcctcaaagaaaccgcctgtctggggaaggcgtacgcccagatgtggtctctgatgtatttccaccgcagagatctccggctggcttccaacgccatctgcagcgctgtccccgtgcattgggttcctacctccagaacaacctggagcattcacgcccatcaccagtggatgacaacggaggacatgcttaccgtgtggaatcgcgtctggatcgaggataacccctggatggaagacaagacaccggtgaccacatgggaggatgtgccttacctgggaaaacgggaagaccaatggtgtggctctctcattgggctgaccagcagagctacgtgggcccagaatatccttaccgcgatccagcaggttcgctccctgattggcgatgaggagtttctcgactacatgccctctatgaagcggttcagaaaagaagaggaaagcgagggagccatctggtga

SEQ ID NO: 20940 - RNA, 9873 nt, synthetic construct
  misc_feature 1..9873: note = derived and/or modified CDS sequence (opt5) from DENV-3__DQ675530__SS-prME
  source 1..9873: mol_type = other RNA
acctccttctgcctgatgatgatgctccccgccaccctggcttttcaccttacgtcccgggacggcgaacctcggatgattgtggggaagaacgaacgcggaaaatctctcctgttcaagaccgccagcggcattaatatgtgtaccctgatcgcgatggatcttggggagatgtgcgacgataccgtgacatacaaatgtccgctgattgctgaagttgagcccgaagacatcgattgctggtgtaacctcacctccacatgggtgacctatggaacgtgcaatcaggccggcgagcatagacgggacaagcgctctgtggccctggctcctcacgtcgggatgggactggataccagaacacagacctggatgagcgccgagggcgcttggcggcaggtcgaaaaagttgagacatgggccctccgccatcccggctttaccattctggcgcttttcctggcccactacatcgggacgtcccctacacagaaggtggtcatctttattctcctgatgcttgtgaccccctctatgacaatgagatgtgttggagtgggcaaccgggacttcgtcgaagggctgagcggagctacctgggtggatgtggtcctcgagcatggcgggtgcgttaccacaatggccaagaataaacctacgctggacatcgagctgcagaagaccgaagctacacagctcgccaccctgcgcaaactttgtattgagggaaagatcacaaacattaccacggattccagatgcccgacacagggcgaagcgatcctgcccgaggaacaggaccagaattatgtgtgtaaacacacctacgtggatcggggctgggggaacggatgcggcctctttgggaagggaagcctggtgacctgcgccaagttccaatgtcttgagcctattgagggcaaagtggttcagtatgaaaatctgaagtacacagtgatcatcaccgtccacacaggggaccagcatcaggtgggaaacgacacgcaaggcgttaccgtggagattacaccccaggcttctaccgtcgaagccgtgctccctgagtatggcacactggggctggaatgcagcccccgcaccggactcgattttaatgagatgatcctgcttacgatgaaaaacaaggcttggatggtccacagacagtggttctttgacctgccgctcccttggaccagcggcgccacaaccgagacacccacctggaatcggaaagaactgcttgtgacgttcaagaacgcccatgctaaaaagcaagaggttgtggtcctggggtctcaggaaggagcgatgcacacagccctcaccggcgctacagagattcaaaattccgggggcaccagcatctttgccggacacctgaagtgtcgcctgaaaatggataagctcgaactgaaaggcatgtcttacgccatgtgccttaacaccttcgtgctgaagaaagaggtttccgagacacagcatgggacgattctcatcaaggtggaatacaagggagaggacgctccttgtaaaatccccttcagcaccgaagatggccaagggaaggcccacaacggaagactgattacagcgaatcccgtcgtgaccaaaaaggaggagcctgtgaacatcgaagctgagccgccctttggcgaatccaatattgttatcgggattggcgacaaagccctgaagatcaactggtataagaaaggatctagcatcggcaagatgttcgaggccacagctagaggggccagacgcatggctattcttggagataccgcctgggactttggctccgtcgggggagtgctcaatagcctgggcaaaatggtgcatcagatcttcgggtctgcgtacacggccctgttttccggcgtcagctggattatgaagatcggaattggcgtgctcctgacatggatcgggcttaactctaaaaataccagcatgtccttctcttgcattgttatcggaatcattaccctgtatctcggcgctgtggtccaggccgatatggggtgtgtgatcaactggaagggaaaggaactgaaatgcggcagcgggatttttgttacaaatgaggtgcacacctggacagagcagtacaagttccaagctgactcccctaaacggctggccacggcgatcgccggcgcttgggaaaacggagtctgtggcattagaagcaccacacgcatggagaatcttctctggaagcagatcgccaacgaactgaattatatcctgtgggagaacaatattaaactcaccgtggttgtgggggatatcattggagtcctggaacagggcaagcggacacttacaccccagcctatggagctgaaatactcttggaagacgtgggggaaggctaaaatcgtgaccgccgagattcaaaactccagctttatcatcgacggacccaacacaccggaatgcccttctgcctccagagcttggaatgtgtgggaggtcgaagactatggcttcggcgtttttaccacaaacatttggctcaagctgcgcgagatgtacacccagagctgtgatcatcggctgatgtccgcggccatcaaagacgaaagagctgtgcacgccgatatggggtactggattgagtctcagaagaatggaagctggaaacttgagaaggcctccttcatcgaagtgaagacatgcacctggcccaaatctcacacgctctggagcaacggcgtcctggagtccgacatgattatccctaagagcctggctgggcccatctctcagcataatcaccgccctggatatcatacacaaaccgccggcccctggcacctcgggaaactggaacttgattttaactactgcgagggaaccacagtggttattaccgagaattgtggcacgcggggcccgtccctgagaacaaccacagtgagcgggaagctcatccacgaatggtgctgtcgctcttgcaccctgcctcccctgcggtatatgggagaggacggctgttggtacgggatggaaattagacccatcaacgagaaagaagagaatatggtcaagtcccttgtgagcgcgggatctggcaaggttgataacttcacaatgggggtgctctgcctggctattctgttcgaggaagtcatgcggggaaaatttggcaagaaacatatgatcgtgggcgttctcttcacctttgtgctgcttctgagcgggcagattacgtggcgcgacatggcccacaccctcatcatgatcggatccaatgccagcgatagaatgggcatgggggtcacatatctggctctgattgccaccttcaagatccagccttttcttgcgctgggattctttctccggaaactgacatctagagagaacctcctgcttggcgtggggctggctatggccaccacgctccaactgccggaagacattgagcagatggccaatggaatcgctctgggccttatgacactgaagctcattacccagttcgaaacataccagctgtggaccgccctcgtgtccctgacctgtagcaacacaatctttacgcttaccgtcgcttggcgcacagccaccctgatcctcgcgggcgtttccctgctgcccctttgccaatctagctccatgcggaagacagattggctgcctatgaccgtggccgctatgggggtgccccctctccccctgttcatcttttctctcaaagacacgcctaagagacgcagctggcccctgaatgagggagtcatggccgtgggccttgtttccatcctggcttctagcctgctcagaaacgatgtgccgatggccgggcctctggtcgccggaggccttctgattgcttgttatgtgatcacagggacctccgcggacctcaccgttgagaaagccgctgacgtgacatgggaagaggaagccgagcagaccggagtcagccataacctgatgattacagtggatgacgatggcacgatgcggatcaaggacgatgaaaccgagaatatcctcacagtcctgcttaaaaccgccctgctgattgtgtctggcatcttcccctactccattcctgctacactcctggtttggcacacctggcagaagcagacgcaacgcagcggggtgctttgggacgtcccctctccgcctgagacccagaaagccgaactggaggaaggagtgtacagaatcaagcagcagggcatttttgggaagacacaagttggagtgggcgtccagaaagagggggtgttccataccatgtggcacgtgacacggggagcggttctcacccacaacggcaagcgcctggagcccaattgggcttccgtcaaaaaggatctcatcagctatggcgggggatggagactgtctgcccagtggcaaaaaggcgaagaggtccaggtgattgccgtcgaacctgggaagaaccccaagaatttccagacaatgcccggaatctttcagacgaccacaggcgagatcggggctattgcccttgacttcaaacctggaacctccggcagcccgatcattaaccgggaaggcaaggtggttgggctgtacggaaatggcgtggtcaccaaaaacgggggatatgtgtccggcatcgcgcaaacaaatgctgagcccgatgggcctacgcccgagctggaagaggaaatgtttaagaaacgcaacctcaccattatggacctgcatcctggcagcggaaagacaagaaagtaccttcccgccatcgttcgggaggccatcaaacgcagactgcggaccctcattctggctcctacaagagtggtcgccgctgaaatggaggaggccctcaagggcctgccgatccgctatcagaccacggcgacaaaatctgaacacaccgggcgggagattgtggatcttatgtgccatgccaccttcacaatgagactgctgagccccgttcgcgtgcctaattacaacctcatcattatggacgaagctcactttaccgatcccgcctccatcgctgcccggggatatatctctacaagagtcggcatgggggaggccgctgcgattttcatgaccgccacgcctcccggaacagctgaagcctttccgcagagcaatgcccctatccaggacgaggagcgcgacattcccgaacggtcctggaactctggcaatgagtggatcaccgatttcgtggggaagacagtgtggtttgtccccagcattaaagctggcaacgacatcgccaactgtctgagaaagaatggaaagaaagttattcaactttcccgcaagaccttcgatacggaataccagaaaacccggctgaacgactgggattttgtggtgacaaccgacatctctgagatgggcgcgaatttcaaggctgatagagtcatcgaccctcggcgctgcctcaaacccgtgattctgacagatgggcctgagagagttatcctggccggaccgatgcccgtgaccgccgctagcgccgcgcagcggcgcggcagagtcgggcggaaccctcagaaggaaaatgaccaatacattttcacaggacagcccctcaacaatgatgaggaccatgcccactggaccgaagctaagatgcttctggacaacatcaatacgcctgagggcattatccccgccctgtttgaaccggagagagagaaatccgctgccatcgatggggaatatcgcctcaagggcgagagccggaaaacattcgtggaactgatgagacgcggagaccttcctgtttggctggctcacaaggtggcctctgagggcattaaatacaccgatcggaagtggtgctttgacggggaaagaaacaatcagatcctcgaggagaacatggatgtcgaaatttggaccaaagagggagaacgcaagaagctgcggcccagatggctggacgcgcgcacatattccgatcctctcgcccttaaagagttcaaggactttgctgccggcagaaaaagcatcgctctggatctggtgaccgaaattgggcgggtcccctctcatctcgcccaccgcacaagaaatgccctggacaaccttgtgatgctgcatacgtccgagcacggaggccgggcttaccgccacgcggttgaggaactccctgagaccatggaaacactgctgctccttggcctgatgatcctgctcaccgggggagccatgctgttccttatcagcggcaaggggattggaaaaacatccatcggcctgatttgtgtgatcgtgtctagcgggatgctctggatggctgatgtccccctgcagtggattgcctccgccatcgttctggagtttttcatgatggtgctccttattccggagcctgaaaagcaaagaacaccccaggacaatcagctggcttatgtggtcatcggaatcctgacgctcgccgcgattgtggccgctaacgagatgggcctgcttgaaaccacaaagcgggatctgggcatgagcaaagagcccggggttgtgtctcctacctcctacctcgacgtcgacctgcatccggccagcgcttggacactgtatgccgtggcgaccacggtcatcacacccatgctcagacacaccattgaaaattctacagccaacgtgagccttgctgccatcgctaaccaagccgttgtgctgatgggactggataagggctggcctatttccaaaatggacctcggggtccccctgcttgctctgggatgctactctcaggtgaatcctctcaccctgaccgccgcggttctgctccttgtgacacattacgccatcatcggccccgggctgcaggctaaggccacgcgcgaggctcagaaacggaccgccgccggaattatgaagaaccctacagtcgatggcatcatgaccattgacctggatccggtgatctatgacagcaagtttgagaaacaactcggccaggtgatgctgcttgttctgtgtgcggtccagctcctgctgatgagaacatcctgggctctctgcgaagcccttaccctggctacggggcccattacaaccctgtgggagggatctcctggcaagttctggaataccacaatcgccgtgagcatggccaacatctttcgcgggtcctacctcgctggagccggcctggcgttcagcattatgaaatctgtggggaccggacggagaggcacaggctcccagggggaaacgcttggagagaagtggaaaaagaagctgaatcaactcagccggaaagaatttgatctgtataagaaatccggcatcaccgaggtcgaccgcacagaggccaaggaagggctgaaaagaggagagaccacacaccatgctgtttctcggggcagcgccaagctccagtggttcgtggaacgcaacatggtgattcccgaggggagagtcatcgatcttggatgtggccggggcgggtggtcctactattgcgctggactgaaaaaggtgaccgaagttcgcggctacacgaaaggcgggcctgggcacgaggagcccgtgccgatgtctacctatgggtggaatattgtcaaactgatgagcggaaaggacgtgttctacctccctcccgaaaaatgtgatacactgctttgcgacatcggcgagtccagcccctctcctaccgttgaagagtccagaacaattcgggtgctgaagatggtcgagccctggctcaaaaacaatcagttttgtatcaaggtgctgaacccttacatgccgaccgtgatcgaacacctggagcgcctccagagaaagtatggcgggatgcttgtccggaatcccctgagcagaaactctacacatgaaatgtactggatttccaatggaaccggcaacatcgttagctctgtgaatatggtgagccgcctgctcctgaaccggttcacgatgacacacagacgccctaccattgagaaagatgtcgaccttggggccggaacccggcatgtgaacgcggaacccgagacacctaatatggacgttatcggcgagagaattaagcgcatcaaagaggaacactcctctacgtggcactatgatgacgaaaacccctacaagacctgggcctatcatgggagctacgaggtgaaagctacaggatccgccagctccatgatcaatggcgtcgtgaagctgctcaccaagccgtgggatgttgtgcctatggtcacacaaatggctatgaccgacacaaccccctttggccagcagcgggtgttcaaagaaaaggttgatacgagaacccctcgccccatgcctgggacacggaaagtgatggagattaccgccgagtggctgtggagaacactgggacgcaacaagaaaccccggctctgcaccagagaagagtttacgaagaaggtccgcacaaatgctgccatgggcgcggtgttcaccgaagagaaccaatgggactctgccagagctgccgtcgaagatgaggagttttggaaactggtggaccgggaacgcgagcttcacaagctggggaaatgtggaagctgcgtttataatatgatgggcaagagagagaagaagctcggggagttcggcaaagctaagggatcccgggccatctggtacatgtggctgggcgccagataccttgagtttgaagcgctggggttcctcaacgaggatcattggttttctcgggaaaatagctattccggagtggagggcgaagggctgcacaagctgggatacattctccgcgacatctctaaaattccgggcggggctatgtatgccgatgacacagccggctgggacaccagaatcacggaggatgacctgcataacgaggaaaagatcacccagcagatggatcctgagcaccggcagcttgctagcgccattttcaaactgacataccaaaataaggtcgtgaaagtgcagcgccccacccccaagggaacagttatggacatcatttccagaaaggatcagcggggcagcggacaggtgggaacctatggcctcaacacatttaccaatatggaagctcaactggtccgccagatggagggggaaggagtgctttctaaagccgacctggagaaccctcacctcctggagaagaaaatcacgcagtggctggaaacaaagggcgttgagagactcaaacggatggcgatttccggggatgactgcgtggtcaagccgatcgatgaccgcttcgccaatgctctgcttgccctgaacgatatgggcaaggtgagaaaagacatcccccagtggcaacctagcaagggatggcatgattggcagcaggtccccttctgttctcaccattttcacgaactcattatgaaagacggccggaagctggtggttccttgccgcccccaggacgagcttatcgggagagctcggatttcccaaggagccggctggagcctgaaagaaaccgcgtgtctcgggaaggcctacgctcagatgtggtctctgatgtatttccaccgcagagatctgcggctcgcctccaacgctatctgcagcgccgtgcctgtccattgggtgcccacctccagaacaacctggagcattcacgctcatcaccagtggatgacaacggaggacatgctgaccgtttggaatcgcgtgtggatcgaggataacccgtggatggaagacaagacacctgtcaccacatgggaggatgtgccctaccttggaaaacgggaagaccaatggtgtggctctctgattgggctcaccagcagagccacgtgggcgcagaatatcctgaccgccatccaacaggtgcgctcccttattggcgatgaggagtttctggactacatgccttctatgaagcggttcagaaaagaagaggaaagcgagggagctatctggtga

SEQ ID NO: 20941 - RNA, 9873 nt, synthetic construct
  misc_feature 1..9873: note = derived and/or modified CDS sequence (opt5) from DENV-3__DQ675533__SS-prME
  source 1..9873: mol_type = other RNA
accagcctgtgcctcatgatgatcctgcccgccgctcttgccttccacctgacatcccgggacggcgagcctcggatgattgtggggaagaacgaacgcggaaagtctctcctgtttaagacggcgagcggcatcaatatgtgtacccttattgctatggatctgggggagatgtgcgacgatacagtgacctacaagtgtccgcatatcacagaagttgagcccgaagacattgattgctggtgtaacctcacctccacatgggtgacctatggaacgtgcaatcaggccggcgagcaccggcgggacaagcgctctgtggccctggctcctcatgttgggatgggactggataccagaacacagacctggatgagcgccgagggcgcttggagacaggtggaaaaagttgagacatgggccctccgccaccccggcttcaccatcctggcgctttttctggcccattacatcgggacgtccctcacacagaaggtggtgattttcatcctgcttatgctggtgaccccttctatgacaatgagatgtgttggagtgggcaaccgggactttgtcgaagggctcagcggagctacctgggtggatgtggtcctggagcacggcgggtgcgttaccacaatggccaagaataaacccacgctggacattgagctccagaagaccgaagctacacagctggccacccttcgcaaactgtgtatcgagggaaagattacaaacatcaccacggattccagatgccctacacagggcgaagcggtgctcccggaggaacaggaccagaattatgtgtgtaaacacacctacgtcgatcggggctgggggaacggatgcggcctgttcgggaagggaagccttgtgacctgcgccaagtttcagtgtctggagcccattgagggcaaagttgtgcagtatgaaaatctcaagtacacagtcatcatcaccgtgcatacaggggaccagcaccaggttggaaacgagacgcaaggcgtgaccgctgaaattacacctcaggcctctacccatgaggctctgctgcccgaatatggcacactcgggctggagtgctcccctcgcaccggacttgacttcaatgagatgatcctgctcacgatgaaaaacaaggcctggatggtccacagacagtggtttttcgatctgccccttccgtgggccagcggcgctaccacagaaacccctacatggaatcggaaagagctgctcgtgacctttaagaacgcgcacgccaaaaagcaagaagtcgtggttctggggtctcaggagggagctatgcatacggccctgacaggcgccaccgaaattcaaaattccgggggcacaagcatcttcgctggacacctcaagtgtcgcctgaaaatggacaaacttgagctgaaaggcatgtcttacgccatgtgcaccaacacctttgtgctcaagaaagaggtctccgaaacacagcatgggacgattctgatcaaggtggagtacaagggagaagatgcgccctgtaaaatccctttcagcaccgaggacggccaagggaaggctcacaacggaagactgattacagccaatcccgttgtgaccaaaaaggaggaacccgtcaacatcgaggccgaacctccgttcggcgagtccaatattgtgatcgggattggcgataacgctcttaaaatcaattggtataagaagggatctagcatcggcaaaatgtttgaagccacagctagaggggccagacgcatggcgattctcggagacaccgcctgggatttcggctccgtcggaggggttctgaacagcctgggcaagatggtccatcagatctttgggtctgcttacacggccctcttctccggcgtgagctgggtgatgaaaattggaatcggcgtcctgcttacatggattgggctcaattctaagaacaccagcatgtccttttcttgcatcgctattggaatcatcaccctctatctgggcgccgtggttcaggcggacatggggtgtgtgattaattggaaaggaaaggagctgaagtgcggcagcgggatcttcgtcacaaacgaggtgcacacctggacagaacagtacaaatttcaagccgattcccccaagcggcttgctacggccattgctggcgcctgggagaatggagtttgtggcatcagaagcaccacacgcatggaaaacctcctgtggaaacagattgccaatgagctgaactatatcctctgggaaaataacatcaagctgaccgtggtcgtgggggacacacttggagttctggagcagggcaaacggaccctcacgcctcagcccatggagctgaagtactcttggaaaacctgggggaaggctaagattgtgacagcggaaacccaaaactccagcttcatcattgatggacctaatacacccgagtgcccgtctgcctccagagcttggaacgtctgggaagtggaggactatggctttggcgtgttcaccacaaatatctggctgaaacttcgcgaagtctacacccagctctgtgaccaccggctgatgagcgccgccgttaaggatgagagagctgtgcatgccgacatggggtactggattgagtcccagaaaaacggatcttggaagctggaaaaagcgagcctcatcgaggtgaagacgtgcacatggcctaagtcccacaccctgtggtctaatggcgtccttgaaagcgatatgatcattcccaaatccctggctgggcctatcagccagcataactatcgccccggataccacacccaaacagccggcccttggcacctcgggaagctggagctggactttaattattgcgagggaaccacggtggttattacagaatcttgtggcacccggggcccctcccttagaacaaccacagtgagcgggaaactcatccatgagtggtgctgtcgctcttgcaccctgccgcctctgcggtacatgggagaagatggctgttggtatgggatggagattagacccatctccgaaaaggaggagaacatggtcaaaagcctcgtgtctgccggaagcggcaaggttgacaatttcacgatgggggtgctgtgccttgctatcctgtttgaagaggtcctccggggaaagttcggcaaaaagcacatgattgccggcgtgttctttaccttcgttctgctgctttccgggcagatcacatggcgcgatatggcgcataccctgattatgatcggaagcaacgcttctgacagaatgggcatgggggtgacatacctcgccctgattgccacctttaaaatccagcccttcctcgctctgggatttttccttcggaagctgacgtccagagaaaatctcctgctgggcgtcgggcttgccatggctacaaccctgcaactccctgaggatattgaacagatggccaacggaatcgcgctgggcctcatggccctgaaacttatcacacagtttgagacctatcagctgtggaccgctctcgtgagcctgacatgttccaatacgattttcaccctgacagtggcctggcgcaccgctacacttatcctggccggcgtctctctcctgccggtttgccaaagctcctctatgcggaagaccgactggctccccatgacggtggccgctatgggggtgcctcccctgcctcttctgatttttagcctgaaggatacactcaaaagacgctcctggcccctgaacgagggagtcatggcggtgggccttgtttctatcctggccagctccctcctgagaaatgacgtgcctatggctgggcccctcgtcgccggaggcctgcttattgcctgttacgtgatcaccgggaccagcgctgatctgacagttgaaaaggccgcggacgtgacctgggaggaagaggctgaacagacaggagtctctcacaacctgatgatcacggtggacgatgacggcaccatgcggattaaagatgacgagacagagaacatcctcaccgtcctgcttaagacagccctgctcattgtgtccggcatcttcccgtacagcattcctgccaccctgctcgtttggcatacgtggcagaaacagacccaacgctctggggtgctgtgggatgtcccctcccctcccgaaacacagaaggctgagcttgaagagggagtgtatagaatcaaacagcagggcatctttgggaagacccaagttggagtgggcgtccagaaggagggggtgttccacacaatgtggcacgtgacccggggagccgttctgacacataatggcaaacgcctggaaccgaactgggcgagcgtcaagaaagacctcatttcttacggcgggggatggagactgtccgctcagtggcaaaagggcgaggaagtccaggtgatcgccgtcgagcctgggaaaaatcccaagaactttcagacgatgcctggaaccttccagacaaccaccggcgaaattggggccatcgctcttgatttcaagcccggaacaagcggctcccccattatcaatcgggagggcaaagtggttgggctgtatggaaacggcgtggtcacgaagaatgggggatacgtgagcggcattgcccaaaccaacgctgagcctgacgggccgacacccgaactcgaggaagagatgtttaaaaagcgcaatctgaccatcatggatctccaccctggctctggaaaaacaagaaagtatctgcccgccatcgttcgggaagcgattaagcgcagacttcggaccctgatcctggcccctacgagagtggtcgctgccgagatggaggaagctctcaaaggcctgcccattcgctaccagacaaccgccaccaagagcgagcatacagggcgggaaatcgtggaccttatgtgccacgccaccttcacaatgagactgctctcccctgttcgcgtgccgaactataatctgattatcatggatgaggctcattttaccgaccccgcgtctatcgccgctcggggatacattagcacgagagtcggcatgggggaagccgccgctatcttcatgacagccacccctcccggaacagcggatgcttttcctcagtccaacgcccccattcaggacgaggagcgcgacatcccggaacggtcttggaatagcggcaacgagtggattaccgatttcgccgggaaaacggtgtggtttgtgccttccatcaaggctggcaatgacatcgccaactgtctgcgcaaaaacggaaagaaggtcattcaactctctagaaaaaccttcgatacagaataccagaagaccaaacttaatgactgggattttgttgtgacaaccgacatcagcgagatgggcgcgaacttcaaggccgatcgggtgattgaccccagacggtgcctgaaacccgtcatcctgacagatgggcctgagcgcgtgattctcgctggacccatgcctgttaccgccgcttccgccgctcagagacggggccgcgtggggagaaatccgcagaaggaaaacgaccaatatatctttacgggacagcccctgaataacgatgaggaccacgcccactggacagaagcgaagatgcttctggacaatattaacacccctgagggcatcatccccgccctcttcgaacctgagcgggagaaaagcgctgccattgatggggaatacagactgaagggcgagtctcgcaaaaccttcgtcgaactgatgcggagaggagacctccccgtgtggcttgctcataaggttgcctccgagggcatcaaatatacagatcgcaagtggtgctttgacggggaacggaataaccagattctggaggagaatatggatgtggaaatctggaccaaagagggagaaagaaagaagctgcgcccgcggtggctcgacgccagaacatacagcgatcctctggctcttaaagagttcaaggactttgcggccggccgcaaatctattgctctggatctcgtcacggaaatcgggagagtgccctcccacctggcccatcggacccgcaacgccctggacaatctcgtcatgcttcacacaagcgagcacggaggcagagcttatcggcatgccgtggaggaactgcctgagaccatggaaacactgctcctgcttggcctgatgatcctcctgaccgggggagcgatgctgttcctcatttccggcaaggggatcggaaaaacgtctattggccttatctgtgttattgccagctccgggatgctgtggatggctgaggtgcccctgcagtggatcgccagcgctatcgtgctcgagtttttcatgatggtcctgcttattcctgaacccgagaagcaacgcaccccgcaggataaccagctggcctacgttgtgatcgggattctgacactggcggccatcattgctgccaatgaaatgggcctgctcgagaccacaaagagagaccttggcatgtctaaagaacctggggtggtctcccccaccagctatctggatgtggacctgcaccccgcttctgcctggacgctctacgctgttgccacaaccgtgatcacacctatgctgcggcataccattgagaacagcaccgcgaatgtctcccttgccgctatcgccaaccaagctgtggtcctgatgggactcgacaagggctggccgatctctaaaatggatctgggggtgcccctgctcgcccttggatgctacagccaggttaaccctctgacactgacggccgcggtgctcctgcttattacccactatgctatcattggccccgggctgcaggccaaggctacaagagaggcccagaaacgcaccgccgctggaatcatgaagaatcctacagtcgacggcattatgaccatcgatctcgaccccgtgatctacgattccaagtttgaaaaacaactgggccaggttatgctgctcgtgctttgtgccgtccagctgctgctcatgcggacgtcttgggcgctgtgcgaggcccttacactggctaccgggcctattaccacactctgggaaggaagcccgggcaagttctggaacaccacaatcgccgtgtccatggctaatatttttagagggagctatctggccggagcgggcctggccttctctatcatgaaatccgtggggacgggaaagcgcggcaccggcagccagggggagacactcggagaaaaatggaagaagaaacttaaccaactgtcccggaaggagtttgacctgtacaaaaagtctggcattaccgaggttgatagaacagaagctaaagaggggctcaagcggggagaaaccacgcatcacgccgtcagccgcggctccgctaaactgcagtggttcgtggagagaaatatggtggtccccgaagggcgggttatcgaccttggatgtggccgcggcgggtggtcttattactgcgccggactgaagaaggtgaccgaggtgagaggctatacaaaagggggacctggccacgaggaacccgtccctatgagcacctacgggtggaacatcgtgaagctcatgtccggaaaagatgtcttttacctgcccccggagaagtgtgacacactgctctgcgatattggcgaaagctctccttcccccaccgtggaggagagccggacaatccgcgtccttaaaatggtggaaccctggctgaagaataaccagttctgtattaaggttctgaatccttatatgcccaccgtgatcgagcatctcgaaagactgcagcggaaacacggcgggatgcttgtccgcaaccctctgtctagaaattccacgcatgagatgtactggattagcaacggaacaggcaatatcgtgtctagcgtgaacatggtctcccggctcctgctgaatagattcaccatgacccaccgccggccgacaattgaaaaggacgttgatctcggggctggaacgagacacgtgaacgccgagcccgagacccctaacatggacgtgatcggcgaacgcatcaaacggattaaggaggaacataattctacatggcactatgacgatgagaacccctacaaaacctgggcgtatcatgggagctacgaagtcaaggccacaggatccgctagctccatgatcaatggcgtggttaagctgcttaccaaaccttgggacgtggtccccatggtgacacaaatggccatgaccgatacgaccccgtttggccagcagagagttttcaaggagaaagtggacacacgcacccctcggcccatgcctgggacaagaaaggtcatggagattaccgctgaatggctgtggcgcacgctcggacggaacaaaagaccccgcctgtgcacacgggaggaatttaccaagaaggtgagaacaaatgccgccatgggcgcggttttcaccgaggaaaaccaatgggattctgctaaagccgccgtggaggacgaggaattttggaaacttgtcgatcgcgagagagaactgcacaaactcgggaagtgtggaagctgcgtgtataatatgatgggcaaacgggagaagaaactgggggagttcggcaaggctaagggatcccgcgccatctggtacatgtggctgggcgctagatacctcgaatttgaggccctggggttccttaacgaagaccattggttttctcgggagaatagctattccggagtcgaaggcgaggggctgcacaaactcggatacattctgagagatatctctaagatccctggcggggcgatgtatgccgacgatacggctggctgggacacccggattacagaggacgatcttcacaacgaagagaaaatcattcagcagatggaccccgaacatcgccagctggccaatgctatcttcaagctcacctaccaaaacaaagtggttaaggtgcagagaccgacacctaccggaacagtcatggatattatcagccggaaggaccagcgcggctccggacaggtgggaacctatggcctgaatacgtttacaaacatggaggcccaactggtgagacagatggaaggggagggagttctcaccaaagcggatctggagaatccccaccttctggaaaagaaaatcacccagtggctcgagacaaagggcgtggaacggctgaaacgcatggccattagcggggacgattgcgtcgtgaagcccatcgacgatagattcgctaacgcccttctggctctcaacgacatgggcaaggttcggaaagatattcctcagtggcaaccgtctaagggatggcatgactggcaacaggtgcccttttgttcccaccacttccatgagctgatcatgaaagatggccgcaagctggtcgtgccttgcagaccccaggacgaactcattgggcgggcccgcatcagccaaggagctggctggtctctgagagagaccgcctgtcttgggaaagcgtacgcccagatgtggtccctgatgtatttccaccggcgcgacctcagactggctagcaatgccatctgctctgccgtccctgtgcattgggttcccacatcccggacgacctggagcattcacgctcatcaccagtggatgacaaccgaggatatgcttacagtgtggaacagagtctggatcgaagagaatccttggatggaagacaagacccccgtgacgacctgggagaacgttccgtacctgggaaagcgcgaggatcaatggtgtggctccctcattgggctgacaagccgggccacctgggcgcagaatatccctacagctattcaacaggtgagatctctgatcggcaacgaagagtttctcgactacatgcccagcatgaaacgcttccggaaggaagaggaatccgagggagccatttggtga

SEQ ID NO: 20942 - RNA, 9873 nt, synthetic construct
  misc_feature 1..9873: note = derived and/or modified CDS sequence (opt5) from DENV-3__AY744677__SS-prME
  source 1..9873: mol_type = other RNA
accagcctctgcctcatgatgatgctgcccgccacccttgctttccacctgacgtccagagacggagagcctcggatgatcgtggggaagaacgaacgcggaaagtctctcctgtttaagaccgccagcggcattaatatgtgtacccttatcgcgatggatctgggggagatgtgcgacgataccgtgacatacaagtgtccgctcattaccgaagttgagcccgaagacatcgattgctggtgtaacctgacatccacctgggtgacgtatggaacctgcaatcaggctggcgagcatagacgggacaagcgctctgtggccctggcccctcacgttgggatgggactcgatacaagaacccagacatggatgagcgctgagggcgcctggagacaggtggaaaaagttgagacctgggctttccgccatcccggctttacgattctggcccttttcctggcgcactacatcgggacatccctcacccagaaggtggtgatctttattctgcttatgctggtgacaccttctatgaccatgagatgtgttggagtgggcaaccgggacttcgtcgaagggctcagcggagccacctgggtggatgtggtcctggagcatggcgggtgcgttacaacgatggctaagaataaacccaccctggacatcgagctccagaagacagaagccacccagctggctacacttcgcaaactgtgtattgagggaaagatcaccaacgtgacgacagattccagatgccctacccagggcgaagccattctcccggaggaacaggaccagaattatgtgtgtaaacacacctacgtcgatcggggctgggggaacggatgcggcctgtttgggaagggaagccttgtgacatgcgcgaagttccaatgtctggagtctatcgagggcaaagccgttcagcacgaaaatctcaagtataccgtgattatcacagtccatacgggggaccagcaccaggtgggaaacgagacccaaggcgttacagctgaaatcacaccccaggcctccacagtggaggctattctgcctgaatacggcaccctggggctcgagtgcagcccccgcacgggactggactttaatgagatgatccttctgaccatgaaaaacaaggcctggatggtccatagacagtggttctttgatctccctctgccctggacatctggcgccaccacagaaaccccgacgtggaataaaaaggagcttctggtgacattcaaaaacgctcacgcgaagaagcaagaagtcgtggttctcgggtcccaggagggagccatgcacaccgctctgacaggcgccaccgaaattcagaccagcgggggcacatctatctttgccggacatctgaaatgtcggctcaagatggacaaactggagcttaagggcatgtcctatgctatgtgcctgaatgccttcgtgctcaaaaaggaggtcagcgaaacgcagcacgggaccattctgatcaaggtggagtacaaaggagaagatgcgccttgtaagatccccttctccacagaggacggccaagggaaagctcataacggacgcctgattaccgccaaccctatcgttacaaagaaagaggaacccgtgaatattgaggccgaacccccttttggcgagtctaacatcgtcattgggatcggcgataaggctcttaagatcaattggtacaaaaagggaagctccattggcaaaatgttcgaagccaccgctagaggggcccggagaatggcgatcctcggagacacggcctgggattttggcagcgtcgggggagtgctgaactctctgggcaagatggttcaccagattttcgggtccgcttatacagccctctttagcggcgtctcttggatcatgaaaattggaatcggcgtgctgcttacctggattgggctgaatagcaagaacacctccatgtctttcagctgcatcgtgatcggaattatcacactctacctgggcgctgtcgtgcaggccgacatggggtgtgttattaattggaagggaaaagagctgaagtgcggctccgggatctttgtgaccaacgaggtccatacatggacggaacagtataaattccaagcggatagcccgaagcgccttgccaccgctattgccggcgcttgggagaatggagtgtgtggcatccggtctacaaccagaatggaaaacctcctgtggaaacagatcgccaatgagctgaactacattctctgggaaaataacatcaagctgacaattgttgtgggggacgtcatcggagtgcttgagcagggcaaacgcaccctgacgccccagcctatggagctcaagtattcctggaagacctgggggaaagccaagattgttacagctgaaacccaaaatagctcttttatcatcgatggacccaacacacctgagtgcccctccgcgagccgggcctggaacgtgtgggaagtcgaggactacggcttcggcgtgtttaccacaaatatttggctgaaactgagagaaatgtatacccagctttgtgaccaccgcctcatgtccgctgccgtgaaggatgagcgggccgtccacgctgacatggggtactggatcgagtctcagaaaaacggaagctggaagctggaaaaggcctccctgattgaggttaaaacgtgcacatggccgaagtctcataccctctggagcaatggcgtgctggaatccgatatgatcattcctaaaagccttgcggggcccatctctcagcacaactacagacctggatatcatacccaaacagctggcccctggcacctggggaagctcgagctggacttcaattactgcgagggaaccacggtggtcatcacagaaaactgtggcacccgcggcccttccctgcggacaaccacagtgagcgggaaacttattcacgagtggtgctgtagatcttgcaccctgcccccgctgcgctatatgggagaagatggctgttggtacgggatggagatccggcctattaatgaaaaggaggagaacatggttaagtccctggtgagcgccggatctggcaaagccgacaattttacgatgggggtcctctgcctggctatccttttcgaagaggtgatgagaggaaagttcggcaaaaagcatatgattgccggcgcgctgtttaccttcgttctcctgctgagcgggcagatcacatggcgggatatggctcacacccttattatgatcggatccaacgccagcgaccgcatgggcatgggggtgacatatctggccctcatcgctacctttaaaattcagcccttcctggccctcggatttttcctgagaaaacttacgtctcgggaaaatctgctcctgggcgtcgggctggctatggccacaacccttcaactgcccgaggatatcgaacagatggcgaacggaattgccctcggcctgatggctctcaagctgatcacacagtttgagacctaccagctttggaccgccctggtgtccctcatgtgtagcaatacaattttcacgctgaccgttgcttggagaacagccaccctgatccttgccgtgatctccctgctccctgtctgccaatctagctccatgcgcaaaacagactggctgccgatgaccgtggctgcgatgggcgtgccccctctccccctgtttattttctctcttaaggatacgctgaaacggagaagctggcctctgaacgagggggtcatggccgttggactcgtgtccatcctggcttctagctttcttcgcaatgacgtgcccatggccggccctctggtcgccgggggactcctgattgcttgttatgtgatcacaggcacctccgccgatctcaccgttgaaaaggcggctgacgtgacatgggaggaagaggccgaacagaccggggtcagccataacctgatgattacagtggacgatgacggaacgatgagaatcaaagatgacgagaccgagaacatccttacagttctgctgaagaccgccctcctgattgtgtctggcatcttcccctactccattccggctacacttctggtctggcacacctggcagaaacagacgcaacggagcggcgtgctctgggatgtcccttctccccctgaaacccagaaggccgagctggaagagggggtgtaccgcatcaagcagcagggaatttttggcaaaacacaagttggggtgggagtccagaaggagggcgtgttccataccatgtggcacgttacaagaggggcggtgctcacccacaatggaaaacggctggaacccaactgggctaatgtcaagaaagaccttatctcctatggcggcgggtggaagctgagcgcccagtggcaaaagggagaggaagtccaggtgattgccgttgagccgggcaaaaaccctaagaatttccagacaatgcccgggatctttcagacgaccacaggagaaatcggcgctattgccctggatttcaaacctgggacctctggatcccccatcattaaccgcgagggcaaggtcgtgggcctctacgggaatggagtggtcaccaaaaacggcgggtatgtgagcggaatcgctcaaacaaatgccgagcccgacggccctacgccggaactggaggaagagatgtttaagaagagaaaccttaccattatggatctgcatcccgggtccggcaaaacacggaagtacctccctgcgatcgttcgcgaagccatcaaaagacggctgcgcaccctcattctggctcccacaagagtggtcgccgctgagatggaggaagcccttaagggactgcctatccggtatcagaccacggccacaaaaagcgagcacaccggcagagaaattgtggacctgatgtgccatgctaccttcacaatgcgcctcctgtctcccgttcgggtgcctaattacaaccttatcgtcatggatgaggcgcactttaccgacccggccagcattgctgccagagggtatatctccacacgcgtgggaatgggcgaagccgctgccatcttcatgaccgcgacgccccctgggacagctgatgcctttccccagtctaatgcccctattcaggacgaggagcgggacatccccgaaagaagctggaactccggaaatgagtggattaccgatttcgctggcaagacagtttggtttgtgccgtctatcaaggccgggaacgacattgcgaactgtctgcgcaaaaatggcaagaaagtcatccaactcagccggaagaccttcgatacggaataccagaaaaccaagctgaacgactgggattttgtggtgacaaccgacatttccgagatgggagccaatttcaaggctgatagagtcatcgaccctcgccggtgcctgaaacccgttatcctcacagatggccccgagagagtgattcttgccgggcctatgcccgtgaccgtcgcttctgccgctcagcggcgcggaagagtgggccggaaccctcagaaggaaaatgaccaatacatcttcacagggcagccgctgaacaatgatgaggaccatgcccactggaccgaagcgaaaatgctgctcgacaacattaatacgcccgagggaatcattcctgccctgtttgaacccgagcgcgaaaagagcgctgccatcgatggcgaatatagacttaaaggggagtcccggaagacattcgttgaactgatgagacgcggcgacctccctgtgtggctggctcacaaagtcgccagcgagggaatcaagtacaccgatcggaagtggtgctttgacggcgaaagaaacaatcagattctggaggagaacatggatgtggaaatctggaccaaagagggggaaaagaaaaagctccgcccccggtggcttgacgccagaacatattctgatccgctggctctgaaagagttcaaggactttgcggccggacgcaagtccattgctctcgatctggttaccgaaatcggccgggtgcctagccatcttgcccacagaacacgcaatgccctggacaacctcgtcatgctgcatacgtctgagcacgggggccgggcttaccggcacgccgtggaggaactgcccgagaccatggaaacactccttctgctgggcctcatgattctgcttaccggcggggcgatgctgttcctcatctccggaaaaggcatcgggaagacaagcattggactgatctgtgtcgtggcctcctctggcatgctgtggatggctgatgttcctctccagtggattgccagcgctatcgtgcttgagtttttcatgatggtgctgctgattcccgagcctgaaaaacaacgcacaccccaggacaatcagctcgcctatgtcgttatcgggattctgacgcttgcggccatcgtggctgccaacgagatgggactgctcgaaaccacaaagagagatctgggcatgtccaaagagccgggcgtggtcagccctacctcttacctggacgtggacctccatcccgcttccgcctggacactttatgctgttgccaccacggtgatcacacccatgctgcggcacaccattgaaaatagcacagcgaacgtctctctggccgctatcgccaaccaagctgtggtcctcatggggctggataagggatggcctattagcaagatggaccttggcgtgccgctgctcgccctggggtgctactcccaggttaatcccctgaccctcaccgccgcggtgcttctgctggtcacacattacgctatcattggacctggcctccaggccaaagctacgcgcgaggcccagaagagaaccgccgctgggatcatgaaaaaccccacagtggatggaatcatgaccattgacctggatcctgttatctatgactctaagtttgagaaacaacttggccaggtgatgctgctcgtcctgtgtgccgtgcagctgctccttatgcggacaagctgggcgttctgcgaagccctgaccctggctacgggccccattacaaccctctgggaggggtcccctggaaagttttggaataccacaatcgccgtgtctatggctaacattttcagaggcagctacctggccggggcgggacttgccttttccatcatgaaaagcgttggcaccgggaaacgcggaacaggctctcagggcgaaacgctgggggagaagtggaaaaagcggctcaatcaactgtccagaaaagagttcgatctgtataagaaaagcggaatcaccgaggtcgaccgcacagaggctaaggaaggcctcaagagaggggaaattacccaccatgccgtgtcccggggatctgctaaacttcagtggttcgtggaacggaacatggtcatcccggagggccgcgttattgatctggggtgtggaagaggcggctggagctactattgcgccgggctgaagaaagtgacagaagtgcggggatacaccaagggcgggcccggacacgaggagcctgtccccatgtccacgtatggctggaatatcgtgaaactcatgtctgggaaggacgtcttttacctgcctcccgaaaagtgtgatacccttctgtgcgacattggagagagctccccgagccctacagtggaagagtctcgcaccatcagagtcctcaaaatggtggagccctggctgaagaacaatcagttctgtattaaagttctgaacccctacatgcctacagtgatcgaacacctcgagcggcttcagcgcaagcatggcggcatgctggtcagaaatcccctgtcccggaacagcacccacgaaatgtattggatctctaatgggacaggaaacattgtgtccagcgtgaatatggtctctcgcctcctgcttaacagatttaccatgacgcatcggagacctacaatcgagaaagatgttgacctgggcgctgggacccgccacgtgaacgccgaaccggagacccccaatatggacgtgattggagagcggatcagacgcattaaggaggaacacagctccacatggcattacgatgacgaaaacccttataagacgtgggcgtaccacggctcttatgaggtcaaagccaccgggagcgcttccagcatgatcaatggagtggttaagctcctgacaaaaccctgggatgtggtccctatggtgacccaaatggccatgacagacaccacacccttcggccagcagcgggtttttaaggaaaaagtggataccagaacgccgcgccctatgcccggcacccggaaggtcatggagatcacagctgagtggctgtggagaaccctcgggcgcaacaagcggcctagactgtgcacacgcgaagagttcattaaaaaggtgcggaccaatgccgccatgggagcggtttttacggaagagaaccaatgggactccgctagagccgccgtggaagatgaggagttctggaaacttgtcgaccgcgaaagagagctgcataagctcggcaaatgtgggtcttgcgtgtacaatatgatgggaaagcgggagaagaagctgggcgagtttgggaaggctaaaggcagccgcgccatctggtatatgtggcttggagctagatacctggagttcgaagccctcggctttctgaacgaggatcactggttctcccgggaaaattcttacagcggggtcgagggagaaggcctgcataagctcgggtatattctgagagacatctccaaaattcccggaggcgcgatgtacgccgatgacacagctgggtgggacacccggatcacagaggatgaccttcacaacgaggaaaagatcacccagcagatggatcctgagcaccgccagctggccaatgctatttttaaactcacgtatcaaaacaaggtggttaaggtgcagagacccaccccgaaaggcacagtcatggacatcatttctcggaaggatcagcgcggaagcggccaggtggggacctacggactgaatacattcaccaacatggaagcccaacttatcagacagatggagggcgaaggggtgctgtccaaagcggacctcgagaatcctcatctgctggagaagaaagttacacagtggctcgaaaccaagggagtggagcggctgaagcgcatggccattagcggcgatgactgcgtcgtgaaacccatcgatgacagattcgctaacgcccttctggctctcaacgatatggggaaggttcggaaagacatcccccagtggcaaccttctaagggctggcacgattggcaacaggtgccgttttgttcccatcacttccacgaactgattatgaaagacggacgcaaacttgtcgtgccctgcagacctcaggacgagctgatcggccgggcccgcattagccaaggggctggatggtctctcagagaaacggcctgtctgggcaaggcgtatgcccagatgtgggctctgatgtactttcatcggcgcgatctcagactggcctccaatgccatctgcagcgctgtccccgtgcactgggttcctacatctcggaccacctggtccattcatgcccaccatcagtggatgacaaccgaggacatgcttacagtgtggaacagagtctggatcgaggataatccctggatggaagacaaaacgcctgtgaccacatgggaggatgttccctatctggggaagcgcgaagaccaatggtgtggaagcctcattggcctgacctcccgggcgacatgggctcagaacatccttaccgccatccaacaggtgagaagcctgattgggaatgaggagttcctcgattacatgccgtctatgaaacgctttcggaaggaagaggaaagcgagggcgccatctggtga

SEQ ID NO: 20943 - RNA, 9873 nt, synthetic construct
  misc_feature 1..9873: note = derived and/or modified CDS sequence (opt5) from DENV-3__AY744678__SS-prME
  source 1..9873: mol_type = other RNA
accagcctgtgcctcatgatgatgctgcccgccacacttgctttccacctgacgtccagagacggcgagcctcggatgatcgtggggaagaacgaacgcggaaaatctctcctgtttaagaccgccagcggcattaatatgtgtacacttatcgcgatggatctgggggagatgtgcgacgataccgtcacatacaaatgtccgctcattaccgaagttgagcccgaagacatcgattgctggtgtaacctgacatccacctgggtgacgtatggaacctgcaatcaggctggcgagcatagacgggacaagcgctctgtggccctggcccctcacgtcgggatgggactcgatacaagaacccaaacatggatgagcgctgagggcgcctggcggcaggtggaaaaagttgagacctgggctttccgccatcccggctttacgattctggcccttttcctggcgcactacatcgggacatccctcacccagaaggtggtcatctttattctgcttatgctggtgacaccttctatgaccatgagatgtgttggagtgggcaaccgggacttcgtcgaagggctcagcggagccacctgggtggatgtggtcctggagcatggcgggtgcgttacaacgatggctaagaataaacccaccctggacatcgagctccagaagacagaagccacccaactggctacacttcgcaaactgtgtattgagggaaagatcaccaacgtgacgacagattccagatgccctacccagggcgaagccattctcccggaggaacaggaccagaattatgtgtgtaaacacacctacgtcgatcggggctgggggaacggatgcggcctgtttgggaagggaagccttgtgacatgcgcgaagttccaatgtctggagtctatcgagggcaaagccgttcagcacgaaaatctcaagtataccgtgattatcacagtccatacgggggaccagcaccaggtgggaaacgagacccaaggcgttacagctgaaatcaccccccaggcctccacagtggaggctattctgcctgaatacggcaccctggggctcgagtgcagcccccgcacgggactggactttaatgagatgatccttctgaccatgaaaaacaaggcctggatggtccatagacagtggttctttgatctccctctgccctggacatctggcgccaccacagaaaccccgacgtggaataaaaaggagcttctggtgacattcaaaaacgctcacgcgaagaagcaagaagtcgtggttctcgggtcccaggagggagccatgcacaccgctctgacaggcgccaccgaaattcagaccagcgggggcacatctatctttgccggacatctgaaatgtcggctcaagatggacaaactggagcttaagggcatgtcctatgctatgtgcctgaatgccttcgtgctcaaaaaggaggtcagcgaaacgcagcacgggaccattctgatcaaggtggagtacaaaggagaagatgcgccttgtaagatccccttctccacagaggacggccaagggaaagctcataacggacgcctgattaccgccaaccctatcgttacaaagaaagaggaacccgtgaatattgaggccgaacccccttttggcgagtctaacatcgtcattgggatcggcgataaggctcttaagatcaattggtacaaaaagggaagctccattggcaaaatgttcgaagccaccgctagaggggcccggagaatggcgatcctcggagacacggcctgggattttggcagcgtggggggagtgctgaactctctgggcaagatggttcaccagattttcgggtccgcttatacagccctctttagcggcgtctcttggatcatgaaaattggaatcggcgtgctgcttacctggattgggctgaatagcaagaacacctccatgtctttcagctgcatcgtgatcggaattatcacactctacctgggcgctgtcgtgcaggccgacatggggtgtgttattaattggaagggaaaagagctgaagtgcggctccgggatctttgtgaccaacgaggtccatacatggacggaacagtataaattccaagcggatagcccgaagcgccttgccaccgctattgccggcgcttgggagaatggagtgtgtggcatccggtctacaaccagaatggaaaacctcctgtggaaacagatcgccaatgagctgaactacattctctgggaaaataacatcaagctgacaattgttgtgggggacgtcatcggagtgcttgagcagggcaaacgcaccctgacgccccagcctatggagctcaagtattcctggaagacctgggggaaagccaagattgttacagctgaaacccaaaatagctcttttatcatcgatggacccaacacacctgagtgcccctccgcgagccgggcctggaacgtgtgggaagtcgaggactacggcttcggcgtgtttaccacaaatatttggctgaaactgagagaaatgtatacccagctttgtgaccaccgcctcatgtccgctgccgtgaaggatgagcgggccgtccacgctgacatggggtactggatcgagtctcagaaaaacggaagctggaagctggaaaaggcctccctgattgaggttaaaacgtgcacatggccgaagtctcataccctctggagcaatggcgtgctggaatccgatatgatcattcctaaaagccttgcggggcccatctctcagcacaactacagacctggatatcatacccaaacagctggcccctggcacctggggaagctcgagctggacttcaattactgcgagggaaccacggtggtcatcacagaaaactgtggcacccgcggcccttccctgcggacaaccacagtgagcgggaaacttattcacgagtggtgctgtagatcttgcaccctccccccgctgcgctatatgggagaagatggctgttggtacgggatggagatccggcctattaatgaaaaggaggagaacatggttaagtccctggtgagcgccggatctggcaaagccgacaattttacgatgggggtcctctgcctggctatccttttcgaagaggtgatgagaggaaagttcggcaaaaagcatatgattgccggcgcgctgtttaccttcgttctcctgctgagcgggcagatcacatggcgggatatggctcacacccttattatgatcggatccaacgccagcgaccgcatgggcatgggggtgacatatctggccctcatcgctacctttaaaattcagcccttcctggccctcggatttttcctgagaaagcttacgtctcgggaaaatctgctcctgggcgtcgggctggctatggccacaacccttcaactgcccgaggatatcgaacagatggcgaacggaattgccctcggcctgatggctctcaagctgatcacacagtttgagacctaccagctttggaccgccctggtgtccctcatgtgtagcaatacaattttcacgctgaccgttgcttggagaacagccaccctgatccttgccgtgatctccctgctccctgtctgccaatctagctccatgcgcaaaacagactggctgccgatgaccgtggctgcgatgggcgtgccccctctccccctgtttattttctctcttaaggatacgctgaaacggagaagctggcctctgaacgagggggtcatggccgttggactcgtgtccatcctggcttctagctttcttcgcaatgacgtgcccatggccggccctctggtcgccgggggactcctgattgcttgttatgtgatcacaggcacctccgccgatctcaccgttgaaaaggcggctgacgtgacatgggaggaagaggccgaacagaccggggtcagccataacctgatgattacagtggacgatgacggaacgatgagaatcaaagatgacgagaccgagaacatccttacagttctgctgaagaccgccctcctgattgtgtctggcatcttcccctactccattccggctacacttctggtctggcacacctggcagaaacagacgcaacggagcggcgtgctctgggatgtcccttctccccctgaaacccagaaggccgagctggaagagggggtgtaccgcatcaagcagcagggaatttttggcaaaacacaagttggggtgggagtccagaaggagggcgtgttccataccatgtggcacgttacaagaggggcggtgctcacccacaatggaaaacggctggaacccaactgggctaatgtcaagaaagaccttatctcctatggcggcgggtggaagctgagcgcccagtggcaaaagggagaggaagtgcaggtgattgccgttgagccgggcaaaaaccctaagaatttccagacaatgcccgggatctttcagacgaccacaggagaaatcggcgctattgccctggatttcaaacctgggacctctggatcccccatcattaaccgcgagggcaaggtcgtgggcctctacgggaatggagtggtcaccaaaaacggcgggtatgtgagcggaatcgctcaaacaaatgccgagcccgacggccctacgccggaactggaggaagagatgtttaagaagagaaaccttaccattatggatctgcatcccgggtccggcaaaacacggaagtacctccctgcgatcgttcgcgaagccatcaaaagacggctgcgcaccctcattctggctcccacaagagtggtcgccgctgagatggaggaagcccttaagggactgcctatccggtatcagaccacggccacaaaaagcgagcacaccggcagagaaattgtggacctgatgtgccatgctaccttcacaatgcgcctcctgtctcccgttcgggtgcctaattacaaccttatcgtcatggatgaggcgcactttaccgacccggccagcattgctgccagagggtatatctccacacgcgtgggaatgggcgaagccgctgccatcttcatgaccgcgacgccccctgggacagctgatgcctttccccagtctaatgcccctattcaggacgaggagcgggacatccccgaaagaagctggaactccggaaatgagtggattaccgatttcgctggcaagacagtttggtttgtgccgtctatcaaggccgggaacgacattgcgaactgtctgcgcaaaaatggcaagaaagtcatccaactcagccggaagaccttcgatacggaataccagaaaaccaagctgaacgactgggattttgtggtgacaaccgacatttccgagatgggagccaatttcaaggctgatagagtcatcgaccctcgccggtgcctgaaacccgttatcctcacagatggccccgagagagtgattcttgccgggcctatgcccgtgaccgtcgcttctgccgctcagcggcgcggaagagtgggccggaaccctcagaaggaaaatgaccaatacatcttcacagggcagccgctgaacaatgatgaggaccatgcccactggaccgaagcgaaaatgctgctcgacaacattaatacgcccgagggaatcattcctgccctgtttgaacccgagcgcgagaagagcgctgccatcgatggcgaatatagacttaaaggggagtcccggaagacattcgttgaactgatgagacgcggcgacctccctgtgtggctggctcacaaagtcgccagcgagggaatcaagtacaccgatcggaagtggtgctttgacggcgaaagaaacaatcagattctggaggagaacatggatgtggaaatctggaccaaagagggggaaaagaaaaagctccgcccccggtggcttgacgccagaacatattctgatccgctggctctgaaagagttcaaggactttgcggccggacgcaagtccattgctctcgatctggttaccgaaatcggccgggtgcctagccatcttgcccacagaacacgcaatgccctggacaacctcgtcatgctgcatacgtctgagcacgggggaagagcttaccggcacgccgtggaggaactgcccgagaccatggaaacactccttctgctgggcctcatgattctgcttaccggcggggcgatgctgttcctcatctccggaaaaggcatcgggaagacaagcattggactgatctgtgtcgtggcctcctctggcatgctgtggatggctgatgttcctctccagtggattgccagcgctatcgtgcttgagtttttcatgatggtgctgctgattcccgagcctgaaaaacaacgcaccccccaggacaatcagctcgcctatgtcgttatcgggattctgacgcttgcggccatcgtggctgccaacgagatgggactgctcgaaaccacaaagagagatctgggcatgtccaaagagccgggcgtggtcagccctacctcttacctggacgtggacctccatcccgcttccgcctggacactttatgctgttgccaccacggtgatcacacccatgctgcggcacaccattgaaaatagcacagcgaacgtctctctggccgctatcgccaaccaagctgtggtcctcatggggctggataagggatggcctattagcaagatggaccttggcgtgccgctgctcgccctggggtgctactcccaggttaatcccctgaccctcaccgccgcggtgcttctgctggtcacacattacgctatcattggacctggcctccaggccaaagctacgcgcgaggcccagaagagaaccgccgctgggatcatgaaaaaccccacagtggatggaatcatgaccattgacctggatcctgttatctatgactctaagtttgagaaacaacttggccaggtgatgctgctcgtcctgtgtgccgtgcagctgctccttatgcggacaagctgggcgttctgcgaagccctgaccctggctacgggccccattacaaccctctgggaggggtcccctggaaagttttggaataccacaatcgccgtgtctatggctaacattttcagaggcagctacctggccggggcgggacttgccttttccatcatgaagagcgttggcaccgggaaacgcggaacaggctctcagggcgaaacgctgggggagaagtggaaaaagaaactcaatcaactgtcccggaaggaattcgatctgtataaaaagagcggaatcaccgaggtcgacagaacagaggctaaggaaggcctcaaacgcggggagattacccaccatgccgtgtcccggggatctgctaagcttcagtggttcgtggaaagaaacatggtcatcccggagggccgggttattgatctggggtgtggacgcggcggctggagctactattgcgccgggctgaaaaaggtgacagaagtgagaggatacaccaaaggcgggcccggacacgaggagcctgtccccatgtccacgtatggctggaatatcgtgaagctcatgtctgggaaggacgttttttacctgcctcccgaaaaatgtgatacccttctgtgcgacattggagagagctccccgagccctacagtggaagagtctcggaccatccgcgtcctcaagatggtggagccctggctgaaaaacaatcagttctgtattaaggttctgaacccctacatgcctacagtgatcgaacacctcgagagacttcagcggaaacatggcggcatgctggtccgcaatcccctgtccagaaacagcacccacgaaatgtattggatctctaatgggacaggaaacattgtgtccagcgtgaatatggtctctcggctcctgcttaaccgctttaccatgacgcatagacggcctacaatcgagaaggatgttgacctgggcgctgggaccagacacgtgaacgccgaaccggagacccccaatatggacgtgattggagagcgcatccggagaattaaggaagagcacagctccacatggcattacgatgacgaaaacccttataaaacgtgggcgtaccacggctcttatgaggtcaaggccaccgggagcgcttccagcatgatcaatggagtggttaaactcctgacaaagccctgggatgtggtccctatggtgacccaaatggccatgacagacaccacacccttcggccagcagcgcgtttttaaagaaaaggtggatacccggacgccgagacctatgcccggcacccgcaaggtcatggagatcacagctgagtggctgtggcggaccctcgggagaaacaaacgccctcggctgtgcacaagagaagagttcattaagaaagtgcgcaccaatgccgccatgggagcggtttttacggaagagaaccaatgggactccgctcgggccgccgtggaagatgaggagttctggaagcttgtcgacagagaacgcgagctgcataaactcggcaagtgtgggtcttgcgtgtacaatatgatgggaaaaagagaaaagaagctgggcgagtttgggaaagctaagggcagccgggccatctggtatatgtggcttggagctcgctacctggagttcgaagccctcggctttctgaacgaggatcactggttctccagagaaaattcttacagcggggtcgagggagaaggcctgcataaactcgggtatattctgcgggacatctccaagattcccggaggcgcgatgtacgccgatgacacagctgggtgggacaccagaatcacagaggatgaccttcacaacgaggaaaaaatcacccagcagatggatcctgagcaccggcagctggccaatgctatttttaagctcacgtatcaaaacaaggtggttaaagtgcagcgccccaccccgaagggcacagtcatggacatcatttctagaaaagatcagcggggaagcggccaggtggggacctacggactgaatacattcaccaacatggaagcccaacttatccgccagatggagggcgaaggggtgctgtccaaggcggacctcgagaatcctcatctgctggagaaaaaggttacacagtggctcgaaaccaagggagtggagagactgaaacggatggccattagcggcgatgactgcgtcgtgaagcccatcgatgaccgcttcgcttctgcccttctggctctcaacgatatggggaaagttagaaaggacatcccccagtggcaaccttccaaaggctggcacgattggcagcaggtgccgttttgtagccatcacttccacgaactgattatgaaggacggacggaagcttgtcgtgccctgccgccctcaggacgagctgatcggcagagcccggatttctcaaggggctggatggtccctccgcgaaacggcctgtctgggcaaagcgtatgcccagatgtgggctctgatgtactttcatagacgggatctccgcctggccagcaacgccatctgctctgctgtccccgtgcactgggttcctacatccagaaccacctggagcattcatgcccaccatcagtggatgacaaccgaggacatgcttacagtgtggaatcgggtctggatcgaggataacccctggatggaagacaagacgcctgtgaccacatgggaggatgttccctatctggggaaaagagaagaccaatggtgtggatccctcattggcctgaccagccgcgcgacatgggctcagaatatccttaccgccatccagcaggtgcggtctctgattgggaacgaggagttcctcgattacatgccgagcatgaagagatttcgcaaagaagaggaatccgagggcgccatctggtga

SEQ ID NO: 20944 - RNA, 9873 nt, synthetic construct
  misc_feature 1..9873: note = derived and/or modified CDS sequence (opt5) from DENV-3__AY744679__SS-prME
  source 1..9873: mol_type = other RNA
accagcctgtgcctcatgatgatgctgcccgccacccttgctttccacctgacgtccagagacggagaacctcggatgatcgtggggaagaacgaacgcggaaaatctctcctgtttaagaccgccagcggcattaatatgtgtacccttatcgcgatggatctgggggaaatgtgcgacgataccgtgacatacaaatgtccgctcattaccgaagttgagcccgaagacatcgattgctggtgtaacctgacatccacctgggtgacgtatggaacctgcaatcaggctggcgagcatagacgggacaagcgctctgtggccctggcccctcacgtcgggatgggactcgatacaagaacccaaacatggatgagcgctgagggcgcctggcggcaagtggaaaaagttgagacctgggctttccgccatcccggctttacgattctggcccttttcctggcgcactacatcgggacatccctcacccagaaggtggtcatctttattctgcttatgctggtgacaccttctatgaccatgagatgtgttggagtgggcaaccgggacttcgtcgaagggctcagcggagccacctgggtggatgtggtcctggagcatggcgggtgcgttacaacgatggctaagaataaacccaccctggacatcgagctccagaagacagaagccacccaactggctacacttcgcaaactgtgtattgagggaaagatcaccaacgtgacgacagattccagatgccctacccagggcgaagccattctcccggaggaacaggaccagaattatgtgtgtaaacacacctacgtcgatcggggctgggggaacggatgcggcctgtttgggaagggaagccttgtgacatgcgcgaagttccaatgtctggagtctatcgagggcaaagttgtgcagcacgaaaatctcaagtataccgtcattatcacagtgcatacgggggaccagcaccaggttggaaacgagacccaaggcgtgacagccgaaatcacaccccaggcttccacagtcgaggccattctgcctgaatacggcaccctggggctcgagtgcagcccccgcacgggactggactttaatgagatgatccttctgaccatgaaaaacaaggcttggatggtgcatagacagtggttctttgatctccctctgccctggacatctggcgccaccacagaaaccccgacgtggaataaaaaggagcttctggtcacattcaaaaacgcccacgctaagaagcaagaagtggttgtgctcgggtcccaggagggagcgatgcacaccgccctgacaggcgctaccgaaattcagaccagcgggggcacatctatctttgccggacatctgaaatgtcggctcaagatggacaaactggagcttaagggcatgtcctatgccatgtgcctgaatgctttcgtcctcaaaaaggaggtgagcgaaacgcagcacgggaccattctgatcaaggttgagtacaaaggagaagatgccccttgtaagatccccttctccacagaggacggccaagggaaagcgcataacggacgcctgattaccgctaaccctatcgtgacaaagaaagaggaacccgtcaatattgaggccgaacccccttttggcgagtctaacatcgtgattgggatcggcgataaggcccttaagatcaattggtacaaaaagggaagctccattggcaaaatgttcgaagctaccgccagaggggctcggagaatggccatcctcggagacacggcgtgggattttggcagcgtcgggggagttctgaactctctgggcaagatggtccaccagattttcgggtccgcctatacagctctctttagcggcgtgtcttggatcatgaaaattggaatcggcgtgctgcttacctggattgggctgaatagcaagaacacctccatgtctttcagctgcatcgtcatcggaattatcacactctacctgggcgccgtggttcaggctgacatggggtgtgtgattaattggaagggacaggagctgaaatgcggctccgggatctttgtcaccaacgaggtgcatacatggacggaacaatataagttccaggccgatagcccgaaacgccttgcgaccgccattgctggcgcctgggagaatggagtttgtggcatccggtctacaaccagaatggaaaacctcctgtggaagcagatcgctaatgagctgaactacattctctgggaaaataacatcaaactgacagtggtcgtgggggacgttattggagtgcttgagcagggcaagcgcaccctgacgccccaacctatggagctcaaatattcctggaagacctgggggaaggccaaaatcgtcacagccgaaacccagaatagctcttttattatcgatggacccaacacacctgagtgcccctccgctagccgggcgtggaacgtgtgggaagtggaggactacggcttcggcgtctttaccacaaatatctggctgaagctgagagaaatgtatacccagctttgtgaccaccgcctcatgtccgccgctgttaaagatgagcgggccgtgcacgccgacatggggtactggattgagtctcagaagaacggaagctggaaactggaaaaggcttccctgatcgaggtgaagacgtgcacatggccgaaatctcataccctctggagcaatggcgtcctggaatccgatatgattatccctaagagccttgccgggcccatttctcaacacaactacagacctggatatcatacccagacagcgggcccctggcacctggggaaactcgagctggacttcaattactgcgagggaaccacggtggttatcacagaaaactgtggcacccgcggcccttccctgcggacaaccacagtgagcgggaaacttatccacgagtggtgctgtagatcttgcaccctgcccccgctgcgctatatgggagaagatggctgttggtacgggatggagattcggcctatcaatgaaaaagaggagaacatggtcaagtccctggtgagcgctggatctggcaaggccgacaattttacgatgggggttctctgcctggccattcttttcgaagaggtgatgagaggaaaattcggcaagaaacatatgatcgctggcgccctgtttaccttcgtcctcctgctgagcgggcagattacatggcgggatatggcgcacacccttatcatgattggatccaacgctagcgaccgcatgggcatgggggtgacatatctggccctcatcgccacctttaagatccaacccttcctggctctcggatttttcctgagaaaacttacgtctcgggaaaatctgctcctgggcgttgggctggccatggctacaacccttcagctgcccgaggatattgaacagatggccaacggaatcgcgctcggcctgatggccctcaagctgattacacagtttgagacctaccaactttggaccgctctggtgtccctcatgtgtagcaatacaatcttcacgctgaccgtcgcctggagaacagctaccctgattcttgccgtgatctccctgctccctgtgtgccagtctagctccatgcgcaagacagactggctgccgatgaccgtcgccgctatgggcgttccccctctccccctgtttatcttctctcttaaagatacgctgaagcggagaagctggcctctgaacgagggggtgatggcggtgggactcgtctccattctggcctctagctttcttcgcaatgacgtgcccatggctggccctctggttgccgggggactcctgatcgcctgttatgtgattacaggcacctccgctgatctcaccgtcgaaaaagccgcggacgtgacatgggaggaagaggctgaacagaccggggttagccataacctgatgatcacagtggacgatgacggaacgatgagaattaaggatgacgagaccgagaacatccttacagtcctgctgaaaaccgccctcctgatcgtgtctggcattttcccctactccatcccggccacacttctggtctggcacacctggcagaagcaaacgcagcggagcggcgtgctctgggatgttccttctccccctgaaacccagaaagctgagctggaagagggggtgtaccgcattaagcagcaaggaatctttggcaagacacaggtcggggtgggagttcagaaagagggcgtgttccataccatgtggcacgtcacaagaggggccgtgctcacccacaatggaaagcggctggaacccaactgggcgaatgtgaaaaaggaccttatttcctatggcggcgggtggaaactgagcgctcaatggcagaagggagaggaagttcaggtcatcgccgtggagccgggcaagaaccctaaaaatttccagacaatgcccgggatttttcaaacgaccacaggagaaatcggcgccatcgctctggatttcaagcctgggacctctggatcccccattatcaaccgcgagggcaaagtggtcggcctctacgggaatggagtggttaccaagaacggcgggtatgtgagcggaattgcccagacaaatgctgagcccgacggccctacgccggaactggaggaagagatgtttaaaaagagaaaccttaccatcatggatctgcatcccgggtccggcaagacacggaaatacctccctgccattgtccgcgaagcgatcaagagacggctgcgcaccctcatcctggcccccacaagagtggttgctgccgagatggaggaagctcttaaaggactgcctattcggtatcagaccacggccacaaagagcgagcacaccggcagagaaatcgtggacctgatgtgccatgccaccttcacaatgcgcctcctgtctcccgtccgggtgcctaattacaaccttattgttatggatgaggctcactttaccgacccggcgagcatcgccgctagagggtatatttccacacgcgtgggaatgggcgaagccgccgctatcttcatgaccgccacgccccctgggacagcggatgcttttccccagtctaatgcccctatccaagacgaggagcgggacattcccgaaagaagctggaactccggaaatgagtggatcaccgatttcgccggcaaaacagtctggtttgtgccgtctattaaggctgggaacgacatcgccaactgtctgcgcaagaatggcaaaaaggtgattcagctcagccggaaaaccttcgatacggaataccagaagaccaaactgaacgactgggattttgtcgttacaaccgacatctccgagatgggagcgaatttcaaggccgatagagtgattgaccctcgccggtgcctgaagcccgtgatcctcacagatggccccgagagagtcatccttgctgggcctatgcccgtgaccgttgcctctgctgcccagcggcgcggaagagtgggccggaaccctcaaaaagaaaatgaccagtacattttcacagggcagccgctgaacaatgatgaggaccatgctcactggaccgaagccaagatgctgctcgacaacatcaatacgcccgagggaattatccctgcgctgtttgaacccgagcgcgagaaaagcgccgctattgatggcgaatatagacttaagggggagtcccggaaaacattcgtcgaactgatgagacgcggcgacctccctgtgtggctggcccacaaggttgctagcgagggaatcaaatacaccgatcggaagtggtgctttgacggcgaaagaaacaatcagatcctggaggagaacatggatgtggaaatttggaccaaggagggggagaagaagaaactccgcccccggtggcttgacgccagaacatattctgatccgctggccctgaaggagttcaaagactttgctgcgggacgcaagtccatcgccctcgatctggtcaccgaaattggccgggtgcctagccatcttgctcacagaacacgcaatgccctggacaacctcgtcatgctgcatacgtctgagcacgggggcagagcctaccggcacgctgtggaggaactgcccgagaccatggaaacactccttctgctgggcctcatgatcctgcttaccggcggggccatgctgttcctcatttccggaaagggcatcgggaaaacaagcatcggactgatttgtgttgtggcgtcctctggcatgctgtggatggccgatgtgcctctccaatggatcgctagcgccattgtccttgagtttttcatgatggttctgctgatccccgagcctgaaaagcagcgcacaccccaggacaatcaactcgcttatgtggtgattgggatcctgacgcttgccgcgattgtcgccgctaacgagatgggactgctcgaaaccacaaaaagagatctgggcatgtccaaggagccgggcgtggttagccctacctcttacctggacgtggacctccatcccgcctccgcttggacactttatgccgtcgctaccacggtgatcacacccatgctgcggcacaccatcgaaaatagcacagccaacgtctctctggcggccattgctaaccaggccgtggttctcatggggctggataaaggatggcctatcagcaagatggaccttggcgtgccgctgctcgctctggggtgctactcccaggtcaatcccctgaccctcaccgccgccgtgcttctgctggttacacattacgcgattatcggacctggcctccaggctaaggccacgcgcgaggctcagaagagaaccgccgccgggattatgaagaaccccacagtggatggaatcatgaccatcgacctggatcctgtcatttatgactctaaatttgagaagcagcttggccaggtgatgctgctcgtgctgtgtgctgttcagctgctccttatgcggacaagctgggccttctgcgaagcgctgaccctggccacgggccccatcacaaccctctgggaggggtcccctggaaaattttggaataccacaattgctgtctctatggccaacatcttcagaggcagctacctggctggggccggacttgcgttttccattatgaaaagcgtgggcaccgggaagcgcggaacaggctctcaaggcgaaacgctgggggagaaatggaagaaaaagctcaatcagctgtcccggaaagagttcgatctgtataagaaaagcggaatcaccgaggtggacagaacagaggccaaggaaggcctcaagcgcggggagatcacccaccatgctgtctcccggggatctgccaaacttcagtggttcgttgaaagaaacatggtgattccggagggccgggtgatcgatctggggtgtggacgcggcggctggagctactattgcgctgggctgaagaaagtcacagaagtgagaggatacaccaagggcgggcccggacacgaggagcctgttcccatgtccacgtatggctggaatattgtgaaactcatgtctgggaaggacgtcttttacctgcctcccgaaaagtgtgatacccttctgtgcgacatcggagagagctccccgagccctacagtggaagagtctcggaccattcgcgttctcaaaatggtggagccctggctgaagaacaatcagttctgtatcaaagtcctgaacccctacatgcctacagtgattgaacacctcgagagacttcaacggaagcatggcggcatgctggtgcgcaatcccctgtccagaaacagcacccacgaaatgtattggatctctaatgggacaggaaacatcgtctccagcgttaatatggtgtctcggctcctgcttaaccgctttaccatgacgcatagacggcctacaattgagaaagatgtggacctgggcgccgggaccagacacgtcaacgctgaaccggagacccccaatatggacatcattggagagcgcatccggagaattaaggaagaacacagctccacatggcattacgatgacgaaaacccttataagacgtgggcctaccacggctcttatgaggtgaaagcgaccgggagcgcctccagcatgatcaatggagttgtgaagctcctgacaaaaccctgggatgtcgtgcctatggttacccagatggctatgacagacaccacacccttcggccagcaacgcgtgtttaaggaaaaagtcgatacccggacgccgagacctatgcccggcacccgcaaggtgatggagatcacagccgagtggctgtggcggaccctcgggagaaacaagcgccctcggctgtgcacaagagaagagttcatgaaaaaggttcgcaccaatgctgccatgggagccgtgtttacggaagagaaccagtgggactccgcgcgggctgccgtcgaagatgaggagttctggaaacttgtggacagagaacgcgagctgcataagctcggcaaatgtgggtcttgcgtctacaatatgatgggaaagagagagaagaagctgggcgagtttgggaaggccaaaggcagccgggctatttggtatatgtggcttggagcccgctacctggagttcgaagctctcggctttctgaacgaggatcactggttctccagagaaaattcttacagcggggtggagggagaaggcctgcataagctcgggtatatcctgcgggacatttccaaaatccccggaggcgccatgtacgcggatgacacagccgggtgggacaccagaattacagaggatgaccttcacaacgaggaaaagatcacccagcagatggatcctgagcaccggcaactggctaatgccatctttaaactcacgtatcagaacaaggttgtgaaggtccagcgccccaccccgaaaggcacagtgatggacattatctctagaaaggatcagcggggaagcggccaagtggggacctacggactgaatacattcaccaacatggaagctcagcttattcgccagatggagggcgaaggggttctgtccaaagccgacctcgagaatcctcatctgctggagaagaaagtgacacagtggctcgaaaccaagggagtcgagagactgaagcggatggcgatcagcggcgatgactgcgtggttaaacccattgatgaccgcttcgccaacgcccttctcgctctcaacgatatggggaaggtgagaaaagacatcccccaatggcagccttctaagggctggcacgattggcagcaggtcccgttttgttcccatcacttccacgaactgatcatgaaagacggacggaaacttgtggtcccctgccgccctcaagacgagctgattggcagagctcggatcagccagggggccggatggtctctccgcgaaacggcttgtctgggcaaggcctatgcgcagatgtgggccctgatgtactttcatagacgggatctccgcctggcttccaatgccatttgcagcgccgtgcccgttcactgggtgcctacatctagaaccacctggtccatccatgctcaccatcaatggatgacaaccgaggacatgcttacagtctggaaccgggtgtggattgaggataatccctggatggaagacaaaacgcctgttagcacctgggaggatgtgccctatctggggaagagagaagaccagtggtgtggatccctcatcggcctgacaagccgcgccacctgggcgcagaacattcttacagctatccagcaagtccggtctctgatcgggaatgaggagttcctcgattacatgccgagcatgaaaagatttcgcaaggaagaggaatccgagggcgccatttggtga

SEQ ID NO: 20945 - RNA, 9873 nt, synthetic construct
  misc_feature 1..9873: note = derived and/or modified CDS sequence (opt5) from DENV-3__AY744680__SS-prME
  source 1..9873: mol_type = other RNA
accagcctgtgcctcatgatgatgctgcccgccacacttgctttccacctgacgtccagagacggcgagcctcggatgatcgtggggaagaacgaacgcggaaaatctctcctgtttaagaccgccagcggcattaatatgtgtacacttatcgcgatggatctgggggagatgtgcgacgataccgtcacatacaaatgtccgctcattaccgaagttgagcccgaagacatcgattgctggtgtaacctgacatccacctgggtgacgtatggaacctgcaatcaggctggcgagcatagacgggacaagcgctctgtggccctggcccctcacgtcgggatgggactcgatacaagaacccaaacatggatgagcgctgagggcgcctggcggcaggtggaaaaagttgagacctgggctttccgccatcccggctttacgattctggcccttttcctggcgcactacatcgggacatccctcacccagaaggtggtcatctttattctgcttatgctggtgacaccttctatgaccatgagatgtgttggagtgggcaaccgggacttcgtcgaagggctcagcggagccacctgggtggatgtggtcctggagcatggcgggtgcgttacaacgatggctaagaataaacccaccctggacatcgagctccagaagacagaagccacccaactggctacacttcgcaaactgtgtattgagggaaagatcaccaacgtgacgacagattccagatgccctacccagggcgaagccattctcccggaggaacaggaccagaattatgtgtgtaaacacacctacgtcgatcggggctgggggaacggatgcggcctgtttgggaagggaagccttgtgacatgcgcgaagttccaatgtctggagtctatcgagggcaaagccgttcagcacgaaaatctcaagtataccgtgattatcacagtccatacgggggaccagcaccaggtgggaaacgagacccaaggcgttacagctgaaatcaccccccaggcctccacagtggaggctattctgcctgaatacggcaccctggggctcgagtgcagcccccgcacgggactggactttaatgagatgatccttctgaccatgaaaaacaaggcctggatggtccatagacagtggttctttgatctccctctgccctggacatctggcgccaccacagaaaccccgacgtggaataaaaaggagcttctggtgacattcaaaaacgctcacgcgaagaagcaagaagtcgtggttctcgggtcccaggagggagccatgcacaccgctctgacaggcgccaccgaaattcagaccagcgggggcacatctatctttgccggacatctgaaatgtcggctcaagatggacaaactggagcttaagggcatgtcctatgctatgtgcctgaatgccttcgtgctcaaaaaggaggtcagcgaaacgcagcacgggaccattctgatcaaggtggagtacaaaggagaagatgcgccttgtaagatccccttctccacagaggacggccaagggaaagctcataacggacgcctgattaccgccaaccctatcgttacaaagaaagaggaacccgtgaatattgaggccgaacccccttttggcgagtctaacatcgtcattgggatcggcgataaggctcttaagatcaattggtacaaaaagggaagctccattggcaaaatgttcgaagccaccgctagaggggcccggagaatggcgatcctcggagacacggcctgggattttggcagcgtggggggagtgctgaactctctgggcaagatggttcaccagattttcgggtccgcttatacagccctctttagcggcgtctcttggatcatgaaaattggaatcggcgtgctgcttacctggattgggctgaatagcaagaacacctccatgtctttcagctgcatcgtgatcggaattatcacactctacctgggcgctgtcgtgcaggccgacatggggtgtgttattaattggaagggaaaagagctgaagtgcggctccgggatctttgtgaccaacgaggtccatacatggacggaacagtataaattccaagcggatagcccgaagcgccttgccaccgctattgccggcgcttgggagaatggagtgtgtggcatccggtctacaaccagaatggaaaacctcctgtggaaacagatcgccaatgagctgaactacattctctgggaaaataacatcaagctgacaattgttgtgggggacgtcatcggagtgcttgagcagggcaaacgcaccctgacgccccagcctatggagctcaagtattcctggaagacctgggggaaagccaagattgttacagctgaaacccaaaatagctcttttatcatcgatggacccaacacacctgagtgcccctccgcgagccgggcctggaacgtgtgggaagtcgaggactacggcttcggcgtgtttaccacaaatatttggctgaaactgagagaaatgtatacccagctttgtgaccaccgcctcatgtccgctgccgtgaaggatgagcgggccgtccacgctgacatggggtactggatcgagtctcagaaaaacggaagctggaagctggaaaaggcctccctgattgaggttaaaacgtgcacatggccgaagtctcataccctctggagcaatggcgtgctggaatccgatatgatcattcctaaaagccttgcggggcccatctctcagcacaactacagacctggatatcatacccaaacagctggcccctggcacctggggaagctcgagctggacttcaattactgcgagggaaccacggtggtcatcacagaaaactgtggcacccgcggcccttccctgcggacaaccacagtgagcgggaaacttattcacgagtggtgctgtagatcttgcaccctccccccgctgcgctatatgggagaagatggctgttggtacgggatggagatccggcctattaatgaaaaggaggagaacatggttaagtccctggtgagcgccggatctggcaaagccgacaattttacgatgggggtcctctgcctggctatccttttcgaagaggtgatgagaggaaagttcggcaaaaagcatatgattgccggcgcgctgtttaccttcgttctcctgctgagcgggcagatcacatggcgggatatggctcacacccttattatgatcggatccaacgccagcgaccgcatgggcatgggggtgacatatctggccctcatcgctacctttaaaattcagcccttcctggccctcggatttttcctgagaaagcttacgtctcgggaaaatctgctcctgggcgtcgggctggctatggccacaacccttcaactgcccgaggatatcgaacagatggcgaacggaattgccctcggcctgatggctctcaagctgatcacacagtttgagacctaccagctttggaccgccctggtgtccctcatgtgtagcaatacaattttcacgctgaccgttgcttggagaacagccaccctgatccttgccgtgatctccctgctccctgtctgccaatctagctccatgcgcaaaacagactggctgccgatgaccgtggctgcgatgggcgtgccccctctccccctgtttattttctctcttaaggatacgctgaaacggagaagctggcctctgaacgagggggtcatggccgttggactcgtgtccatcctggcttctagctttcttcgcaatgacgtgcccatggccggccctctggtcgccgggggactcctgattgcttgttatgtgatcacaggcacctccgccgatctcaccgttgaaaaggcggctgacgtgacatgggaggaagaggccgaacagaccggggtcagccataacctgatgattacagtggacgatgacggaacgatgagaatcaaagatgacgagaccgagaacatccttacagttctgctgaagaccgccctcctgattgtgtctggcatcttcccctactccattccggctacacttctggtctggcacacctggcagaaacagacgcaacggagcggcgtgctctgggatgtcccttctccccctgaaacccagaaggccgagctggaagagggggtgtaccgcatcaagcagcagggaatttttggcaaaacacaagttggggtgggagtccagaaggagggcgtgttccataccatgtggcacgttacaagaggggcggtgctcacccacaatggaaaacggctggaacccaactgggctaatgtcaagaaagaccttatctcctatggcggcgggtggaagctgagcgcccagtggcaaaagggagaggaagtgcaggtgattgccgttgagccgggcaaaaaccctaagaatttccagacaatgcccgggatctttcagacgaccacaggagaaatcggcgctattgccctggatttcaaacctgggacctctggatcccccatcattaaccgcgagggcaaggtcgtgggcctctacgggaatggagtggtcaccaaaaacggcgggtatgtgagcggaatcgctcaaacaaatgccgagcccgacggccctacgccggaactggaggaagagatgtttaagaagagaaaccttaccattatggatctgcatcccgggtccggcaaaacacggaagtacctccctgcgatcgttcgcgaagccatcaaaagacggctgcgcaccctcattctggctcccacaagagtggtcgccgctgagatggaggaagcccttaagggactgcctatccggtatcagaccacggccacaaaaagcgagcacaccggcagagaaattgtggacctgatgtgccatgctaccttcacaatgcgcctcctgtctcccgttcgggtgcctaattacaaccttatcgtcatggatgaggcgcactttaccgacccggccagcattgctgccagagggtatatctccacacgcgtgggaatgggcgaagccgctgccatcttcatgaccgcgacgccccctgggacagctgatgcctttccccagtctaatgcccctattcaggacgaggagcgggacatccccgaaagaagctggaactccggaaatgagtggattaccgatttcgctggcaagacagtttggtttgtgccgtctatcaaggccgggaacgacattgcgaactgtctgcgcaaaaatggcaagaaagtcatccaactcagccggaagaccttcgatacggaataccagaaaaccaagctgaacgactgggattttgtggtgacaaccgacatttccgagatgggagccaatttcaaggctgatagagtcatcgaccctcgccggtgcctgaaacccgttatcctcacagatggccccgagagagtgattcttgccgggcctatgcccgtgaccgtcgcttctgccgctcagcggcgcggaagagtgggccggaaccctcagaaggaaaatgaccaatacatcttcacagggcagccgctgaacaatgatgaggaccatgcccactggaccgaagcgaaaatgctgctcgacaacattaatacgcccgagggaatcattcctgccctgtttgaacccgagcgcgagaagagcgctgccatcgatggcgaatatagacttaaaggggagtcccggaagacattcgttgaactgatgagacgcggcgacctccctgtgtggctggctcacaaagtcgccagcgagggaatcaagtacaccgatcggaagtggtgctttgacggcgaaagaaacaatcagattctggaggagaacatggatgtggaaatctggaccaaagagggggaaaagaaaaagctccgcccccggtggcttgacgccagaacatattctgatccgctggctctgaaagagttcaaggactttgcggccggacgcaagtccattgctctcgatctggttaccgaaatcggccgggtgcctagccatcttgcccacagaacacgcaatgccctggacaacctcgtcatgctgcatacgtctgagcacgggggaagagcttaccggcacgccgtggaggaactgcccgagaccatggaaacactccttctgctgggcctcatgattctgcttaccggcggggcgatgctgttcctcatctccggaaaaggcatcgggaagacaagcattggactgatctgtgtcgtggcctcctctggcatgctgtggatggctgatgttcctctccagtggattgccagcgctatcgtgcttgagtttttcatgatggtgctgctgattcccgagcctgaaaaacaacgcaccccccaggacaatcagctcgcctatgtcgttatcgggattctgacgcttgcggccatcgtggctgccaacgagatgggactgctcgaaaccacaaagagagatctgggcatgtccaaagagccgggcgtggtcagccctacctcttacctggacgtggacctccatcccgcttccgcctggacactttatgctgttgccaccacggtgatcacacccatgctgcggcacaccattgaaaatagcacagcgaacgtctctctggccgctatcgccaaccaagctgtggtcctcatggggctggataagggatggcctattagcaagatggaccttggcgtgccgctgctcgccctggggtgctactcccaggttaatcccctgaccctcaccgccgcggtgcttctgctggtcacacattacgctatcattggacctggcctccaggccaaagctacgcgcgaggcccagaagagaaccgccgctgggatcatgaaaaaccccacagtggatggaatcatgaccattgacctggatcctgttatctatgactctaagtttgagaaacaacttggccaggtgatgctgctcgtcctgtgtgccgtgcagctgctccttatgcggacaagctgggcgttctgcgaagccctgaccctggctacgggccccattacaaccctctgggaggggtcccctggaaagttttggaataccacaatcgccgtgtctatggctaacattttcagaggcagctacctggccggggcgggacttgccttttccatcatgaagagcgttggcaccgggaaacgcggaacaggctctcagggcgaaacgctgggggagaagtggaaaaagaaactcaatcaactgtcccggaaggaattcgatctgtataaaaagagcggaatcaccgaggtcgacagaacagaggctaaggaaggcctcaaacgcggggagattacccaccatgccgtgtcccggggatctgctaagcttcagtggttcgtggaaagaaacatggtcatcccggagggccgggttattgatctggggtgtggacgcggcggctggagctactattgcgccgggctgaaaaaggtgacagaagtgagaggatacaccaaaggcgggcccggacacgaggagcctgtccccatgtccacgtatggctggaatatcgtgaagctcatgtctgggaaggacgttttttacctgcctcccgaaaaatgtgatacccttctgtgcgacattggagagagctccccgagccctacagtggaagagtctcggaccatccgcgtcctcaagatggtggagccctggctgaaaaacaatcagttctgtattaaggttctgaacccctacatgcctacagtgatcgaacacctcgagagacttcagcggaaacatggcggcatgctggtccgcaatcccctgtccagaaacagcacccacgaaatgtattggatctctaatgggacaggaaacattgtgtccagcgtgaatatggtctctcggctcctgcttaaccgctttaccatgacgcatagacggcctacaatcgagaaggatgttgacctgggcgctgggaccagacacgtgaacgccgaaccggagacccccaatatggacgtgattggagagcgcatccggagaattaaggaagagcacagctccacatggcattacgatgacgaaaacccttataaaacgtgggcgtaccacggctcttatgaggtcaaggccaccgggagcgcttccagcatgatcaatggagtggttaaactcctgacaaagccctgggatgtggtccctatggtgacccaaatggccatgacagacaccacacccttcggccagcagcgcgtttttaaagaaaaggtggatacccggacgccgagacctatgcccggcacccgcaaggtcatggagatcacagctgagtggctgtggcggaccctcgggagaaacaaacgccctcggctgtgcacaagagaagagttcattaagaaagtgcgcaccaatgccgccatgggagcggtttttacggaagagaaccaatgggactccgctcgggccgccgtggaagatgaggagttctggaagcttgtcgacagagaacgcgagctgcataaactcggcaagtgtgggtcttgcgtgtacaatatgatgggaaaaagagaaaagaagctgggcgagtttgggaaagctaagggcagccgggccatctggtatatgtggcttggagctcgctacctggagttcgaagccctcggctttctgaacgaggatcactggttctccagagaaaattcttacagcggggtcgagggagaaggcctgcataaactcgggtatattctgcgggacatctccaagattcccggaggcgcgatgtacgccgatgacacagctgggtgggacaccagaatcacagaggatgaccttcacaacgaggaaaaaatcacccagcagatggatcctgagcaccggcagctggccaatgctatttttaagctcacgtatcaaaacaaggtggttaaagtgcagcgccccaccccgaagggcacagtcatggacatcatttctagaaaagatcagcggggaagcggccaggtggggacctacggactgaatacattcaccaacatggaagcccaacttatccgccagatggagggcgaaggggtgctgtccaaggcggacctcgagaatcctcatctgctggagaaaaaggttacacagtggctcgaaaccaagggagtggagagactgaaacggatggccattagcggcgatgactgcgtcgtgaagcccatcgatgaccgcttcgctaacgcccttctggctctcaacgatatggggaaagttagaaaggacatcccccagtggcaaccttctaaaggctggcacgattggcagcaggtgccgttttgttcccatcacttccacgaactgattatgaaggacggacggaagcttgtcgtgccctgccgccctcaggacgagctgatcggcagagcccggattagccaaggggctggatggtctctccgcgaaacggcctgtctgggcaaagcgtatgcccagatgtgggctctgatgtactttcatagacgggatctccgcctggcctccaatgccatctgcagcgctgtccccgtgcactgggttcctacatctagaaccacctggtccattcatgcccaccatcagtggatgacaaccgaggacatgcttacagtgtggaaccgggtctggatcgaggataatccctggatggaagacaagacgcctgtgaccacatgggaggatgttccctatctggggaaaagagaagaccaatggtgtggaagcctcattggcctgacctcccgcgcgacatgggctcagaacatccttaccgccatccagcaggtgcggagcctgattgggaatgaggagttcctcgattacatgccgtctatgaagagatttcgcaaagaagaggaaagcgagggcgccatctggtga

SEQ ID NO: 20946 - RNA, 9873 nt, synthetic construct
  misc_feature 1..9873: note = derived and/or modified CDS sequence (opt5) from DENV-3__AY744681__SS-prME
  source 1..9873: mol_type = other RNA
acctccctgtgcctcatgatgatgctgcccgccacccttgctttccacctgacgtcccgggacggcgaacctcggatgatcgtggggaagaatgaacgcggaaaatctctcctgtttaagaccgccagcggcattaatatgtgtacacttatcgcgatggatctgggggagatgtgcgacgataccgtgacatacaaatgtccgctcattaccgaagttgagcccgaagacatcgattgctggtgtaacctgacatccacctgggtgacgtatggaacctgcaatcaggctggcgagcatcggcgggacaagcgctctgtggccctggcccctcacgttgggatgggactcgatacacggacccagacatggatgagcgctgagggcgcctggagacaggtggaaaaagttgagacctgggctttccgccatcccggctttacgattctggcccttttcctggcgcactacatcgggacatccctcacccagaaggtggtgatctttattctgcttatgctggtgacaccttctatgaccatgcggtgtgttggagtgggcaaccgggacttcgtcgaagggctcagcggagccacctgggtggatgtggtcctggagcatggcgggtgcgttacaacgatggctaagaataaacccaccctggacatcgagctccagaagacagaagccacccaactggctacacttcgcaaactgtgtattgagggaagaatcaccaacgtgacgacagattcccggtgccctacccagggcgaagccattctcccggaggaacaggaccagaattatgtgtgtaagcacacctacgtcgatcgcggctgggggaacggatgcggcctgtttgggaaaggaagccttgtgacatgcgcgaagttccaatgtctggagtctatcgagggcaaggccgttcagcacgaaaatctcaaatataccgtgattatcacagtccatacgggggaccagcaccaggtgggatccgagacccaaggcgttacagctgaaatcacaccccaggccagcacagtggaggctattctgcctgaatacggcaccctggggctcgagtgctctcccagaacgggactggactttaacgagatgatccttctgaccatgaagaataaagcctggatggtccatcggcagtggttctttgatctccctctgccctggacatccggcgccaccacagaaaccccgacgtggaacaagaaagagcttctggtgacattcaagaatgctcacgcgaaaaagcaagaagtcgtggttctcgggagccaggagggagccatgcacaccgctctgacaggcgccaccgaaattcagacctctgggggcacatccatctttgccggacatctgaagtgtcgcctcaaaatggacaagctggagcttaaaggcatgagctatgctatgtgcctgaacgccttcgtgctcaagaaagaggtctccgaaacgcagcacgggaccattctgatcaaggtggagtacaagggagaagatgcgccttgtaaaatccccttctctacagaggacggccaagggaaggctcataatggaagactgattaccgccaaccctatcgttaccaagaaggaggaacccgtgaacattgaggccgaacccccttttggcgagagcaatatcgtcattgggatcggcgataaagctcttaagatcaactggtacaagaaaggatccagcattggcaagatgttcgaagccaccgctagaggggccagacgcatggcgatcctcggagacacggcctgggattttggctctgtcgggggagtgctcaattccctgggcaaaatggttcaccagattttcgggagcgcttatacagccctcttttctggcgtcagctggatcatgaagattggaatcggcgtgctgcttacctggattgggctgaactccaaaaatacctctatgagcttctcctgcatcgtgatcggaattatcacactctacctgggcgctgtcgtgcaggccgacatggggtgtgttattaactggaagggaaaggagctgaaatgcggcagcgggatctttgtgaccaatgaggtccatacatggacggaacagtataagttccaagcggattctccgaaacggcttgccaccgctattgccggcgcttgggagaacggagtgtgtggcatcagatccacaacccgcatggaaaatctcctgtggaagcagatcgccaacgagctgaattacattctctgggaaaacaatatcaaactgacaattgttgtgggggacgtcatcggagtgcttgagcagggcaagcggaccctgacgccccagcctatggagctcaaatatagctggaagacctgggggaaggccaaaattgttacagctgaaacccaaaactcttcctttatcatcgatggacccaatacacctgagtgccccagcgcgtccagagcctggaacgtgtgggaagtcgaggactacggcttcggcgtgtttaccacaaacatttggctgaagctgcgcgaaatgtatacccagctttgtgaccaccggctcatgtctgctgccgtgaaagatgagagagccgtccacgctgacatggggtactggatcgagagccagaagaatggatcctggaaactggaaaaggcctctctgattgaggttaagacgtgcacatggccgaaaagccataccctctggtccaacggcgtgctggaaagcgatatgatcattcctaagtctcttgcggggcccatctcccagcacaattaccgccctggatatcatacccaaacagctggcccctggcacctggggaaactcgagctggacttcaactactgcgagggaaccacggtggtcatcacagaaaattgtggcacccggggccctagcctgagaacaaccacagtgtctgggaaacttattcacgagtggtgctgtcgctcctgcaccctgcccccgctgcggtatatgggagaagatggctgttggtacgggatggagatcagacctattaacgaaaaagaggagaatatggttaagagcctggtgtctgccggaagcggcaaggccgacaactttacgatgggggtcctctgcctggctatccttttcgaagaggtgatgcggggaaaattcggcaagaaacatatgattgccggcgcgctgtttaccttcgttctcctgctgtccgggcagatcacatggcgcgatatggctcacacccttattatgatcggaagcaatgcctctgacagaatgggcatgggggtgacatatctggccctcatcgctacctttaagattcagcccttcctggccctcggatttttcctgcggaaacttacgtccagagaaaacctgctcctgggcgtcgggctggctatggccacaacccttcaactgcccgaggatatcgaacagatggcgaatggaattgccctcggcctgatggctctcaagctgatcacacagtttgagacctaccagctttggaccgccctggtgagcctcatgtgttccaacacaattttcacgctgaccgttgcttggcgcacagccaccctgatccttgccgtgatctctctgctccctgtctgccaaagctcctctatgcggaagacagactggctgccgatgaccgtggctgcgatgggcgtgccccctctccccctgtttattttcagccttaaagatacgctgaagagacgctcctggcctctgaatgagggggtcatggccgttggactcgtgtctatcctggctagctcctttcttagaaacgacgtgcccatggccggccctctggtcgccgggggactcctgattgcttgttatgtgatcacaggcaccagcgccgatctcaccgttgaaaaagcggctgacgtgacatgggaggaagaggccgaacagaccggggtctctcataatctgatgattacagtggacgatgacggaacgatgcggatcaaggatgacgagaccgagaacatccttacagttctgctgaaaaccgccctcctgattgtgtccggcatcttcccctacagcattccggctacacttctggtctggcacacctggcagaagcagacgcaacgctctggcgtgctctgggatgtcccttctccccctgaaacccagaaagccgagctggaagagggggtgtacagaatcaagcagcagggaatttttggcaagacacaagttggggtgggagtccagaaagagggcgtgttccataccatgtggcacgttacaagaggggcggtgctcacccacaacggaaagcgcctggaacccaattgggctaacgtcaaaaaggaccttatcagctatggcggcgggtggaaactgagcgcccagtggcaaaagggagaggaagtccaggtgattgccgttgagccgggcaagaatcctaaaaacttccagacaatgcccgggatctttcagacgaccacaggagaaatcggcgctattgccctggatttcaagcctgggacctccggaagccccatcattaatagagagggcaaagtcgtgggcctctacgggaacggagtggtcaccaagaatggcgggtatgtgtccggaatcgctcaaacaaacgccgagcccgacggccctacgccggaactggaggaagagatgtttaaaaagcggaatcttaccattatggatctgcatcccgggagcggcaagacacgcaaatacctccctgcgatcgttagagaagccatcaagcggcgcctgagaaccctcattctggctcccacacgggtggtcgccgctgagatggaggaagcccttaaaggactgcctatcagatatcagaccacggccacaaagtctgagcacaccggccgcgaaattgtggacctgatgtgccatgctaccttcacaatgcggctcctgagccccgttagagtgcctaactacaatcttatcgtcatggatgaggcgcactttaccgacccggcctccattgctgcccgcgggtatatctctacacgggtgggaatgggcgaagccgctgccatcttcatgaccgcgacgccccctgggacagctgatgcctttccccagagcaacgcccctattcaggacgaggagagagacatccccgaacgctcctggaactctggaaacgagtggattaccgatttcgctggcaaaacagtttggtttgtgccgagcatcaaggccgggaatgacattgcgaactgtctgcggaagaacggcaaaaaggtcatccaactctccagaaaaaccttcgatacggaataccagaagaccaaactgaatgactgggattttgtggtgacaaccgacatttctgagatgggagccaacttcaaggctgatcgcgtcatcgaccctcggagatgcctgaagcccgttatcctcacagatggccccgagcgggtgattcttgccgggcctatgcccgtgaccgtcgctagcgccgctcagcgcagaggacgggtgggccgcaatcctcagaaagaaaacgaccaatacatcttcacagggcagccgctgaataacgatgaggaccatgcccactggaccgaagcgaagatgctgctcgacaatattaacacgcccgagggaatcattcctgccctgtttgaacccgagagagagaaatccgctgccatcgatggcgaatatcggcttaagggggagagcagaaaaacattcgttgaactgatgcgccggggcgacctccctgtgtggctggctcacaaggtcgcctctgagggaatcaaatacaccgatagaaagtggtgctttgacggcgaacgcaataaccagattctggaggagaatatggatgtggaaatctggaccaaggagggggagaagaagaaactccggcccagatggcttgacgcccgcacatattccgatccgctggctctgaaggagttcaaagactttgcggccggaagaaagagcattgctctcgatctggttaccgaaatcggccgggtgccttctcatcttgcccaccgcacaagaaacgccctggacaatctcgtcatgctgcatacgtccgagcacgggggacgggcttaccgccacgccgtggaggaactgcccgagaccatggaaacactccttctgctgggcctcatgattctgcttaccggcggggcgatgctgttcctcatcagcggaaagggcatcgggaaaacatccattggactgatctgtgtcgtggcctctagcggcatgctgtggatggctgatgttcctctccagtggattgcctccgctatcgtgcttgagtttttcatgatggtgctgctgattcccgagcctgaaaagcaaagaacaccccaggacaaccagctcgcctatgtcgttatcgggattctgacgcttgcggccatcgtggctgccaatgagatgggactgctcgaaaccacaaaacgggatctgggcatgagcaaggagccgggcgtggtctctcctacctcctacctggacgtggacctccatcccgctagcgcctggacactttatgctgttgccaccacggtgatcacacccatgctgcgccacaccattgaaaactctacagcgaatgtcagcctggccgctatcgccaaccaagctgtggtcctcatggggctggataaaggatggcctatttccaagatggaccttggcgtgccgctgctcgccctggggtgctactctcaggttaaccccctgaccctcaccgccgcggtgcttctgctggtcacacattacgctatcattggacctggcctccaggccaaggctacgagagaggcccagaaacggaccgccgctgggatcatgaagaatcccacagtggatggaatcatgaccattgacctggatcctgttatctatgacagcaaatttgagaagcaacttggccaggtgatgctgctcgtcctgtgtgccgtgcagctgctccttatgagaacatcctgggcgttctgcgaagccctgaccctggctacgggccccattacaaccctctgggaggggtctcctggaaaattttggaacaccacaatcgccgtgagcatggctaatattttccgcggctcctacctggccggggcgggacttgcctttagcatcatgaagtctgttggcaccgggaagcggggaacaggctcccagggcgaaacgctgggggagaaatggaagaaaaagctcaaccaactgagcagaaaagagttcgatctgtataagaaatccggaatcaccgaggtcgaccgcacagaggctaaggaaggcctcaagagaggggaaattacccaccatgccgtgtctcggggaagcgctaaacttcagtggttcgtggaacggaatatggtcatcccggagggccgcgttattgatctggggtgtggaagaggcggctggtcctactattgcgccgggctgaagaaagtgacagaagtgcggggatacaccaagggcgggcccggacacgaggagcctgtccccatgtctacgtatggctggaacatcgtgaaactcatgagcgggaaggacgtcttttacctgcctcccgaaaagtgtgatacccttctgtgcgacattggagagtccagcccgtctcctacagtggaagagtcccgcaccatcagagtcctcaaaatggtggagccctggctgaagaataaccagttctgtattaaagttctgaatccctacatgcctacagtgatcgaacacctcgagcggcttcagcgcaagcatggcggcatgctggtcagaaaccccctgagcagaaattctacccacgaaatgtattggatctccaacgggacaggaaatattgtgagctctgtgaacatggtcagccgcctcctgcttaatagatttaccatgacgcatcggagacctacaatcgagaaagatgttgacctgggcgctgggacccgccacgtgaacgccgaaccggagacccccaacatggacgtgattggagagcggatcagacgcattaaggaagaacactcctctacatggcattacgatgacgaaaatccttataagacgtgggcgtaccacggcagctatgaggtcaaagccaccgggtccgctagctccatgatcaacggagtggttaagctcctgacaaaaccctgggatgtggtccctatggtgacccaaatggccatgacagacaccacacccttcggccagcagcgggtttttaaggaaaaagtggataccagaacgccgcgccctatgcccggcacccggaaggtcatggagatcacagctgagtggctgtggagaaccctcgggcgcaataagcggcctagactgtgcacacgcgaagagttcattaaaaaggtgcggaccaacgccgccatgggagcggtttttacggaagagaatcaatgggactctgctagagccgccgtggaagatgaggagttctggaaacttgtcgaccgcgaaagagagctgcataagctcggcaaatgtgggagctgcgtgtacaacatgatgggaaagcgggagaaaaagctgggcgagtttgggaaggctaaaggctcccgcgccatctggtatatgtggcttggagctagatacctggagttcgaagccctcggctttctgaatgaggatcactggttctctcgggaaaacagctactccggggtcgagggagaaggcctgcataagctcgggtatattctgagagacatctctaaaattcccggaggcgcgatgtacgccgatgacacagctgggtgggacacccggatcacagaggatgaccttcacaatgaggaaaagatcacccagcagatggatcctgagcaccgcagactggccaacgctatttttaaactcacgtatcagaataaggtggttaaggtgcaacggcccaccccgaaaggcacagtcatggacatcattagccgcaaggatcagagaggatccggccaggtggggacctacggactgaacacattcaccaatatggaagcccagcttatccggcaaatggagggcgaaggggtgctgagcaaagcggacctcgagaaccctcatctgctggagaagaaagttacacagtggctcgaaaccaagggagtggagcgcctgaagagaatggccatttctggcgatgactgcgtcgtgaaacccatcgatgaccggttcgctaatgcccttctggctctcaacgatatggggaaggttcgcaaagacatcccccagtggcagccttccaagggctggcacgattggcaacaggtgccgttttgtagccatcacttccacgaactgattatgaaagacggaagaaaacttgtcgtgccctgccggcctcaggacgagctgatcggccgcgccagaatttctcagggggctggatggtccctccgggaaacggcctgtctgggcaaggcgtatgcccaaatgtgggctctgatgtactttcatcgcagagatctccggctggccagcaacgccatctgctctgctgtccccgtgcactgggttcctacatccagaaccacctggagcattcatgcccaccatcagtggatgacaaccgaggacatgcttacagtgtggaatcgcgtctggatcgaggataacccctggatggaagacaaaacgcctgtgaccacatgggaggatgttccctatctggggaagcgggaagaccagtggtgtggatccctcattggcctgaccagcagagcgacatgggctcaaaatatccttaccgccatccaacaggtgcgctctctgattgggaacgaggagttcctcgattacatgccgagcatgaaacggtttagaaaggaagaggaatccgagggcgccatctggtga

SEQ ID NO: 20947 - RNA, 9873 nt, synthetic construct
  misc_feature 1..9873: note = derived and/or modified CDS sequence (opt5) from DENV-3__AY744682__SS-prME
  source 1..9873: mol_type = other RNA
accagcctgtgcctcatgatgatgctgcccgccacacttgctttccacctgacgtccagagacggagaacctcggatgatcgtggggaagaacgaacgcggaaagtctctcctgtttaagaccgcctccggcattaatatgtgtacacttatcgcgatggatctgggggagatgtgcgacgataccgtgacatacaagtgtccgctcattaccgaagttgagcccgaagacatcgattgctggtgtaacctgacatccacctgggtgacgtatggaacctgcaatcaggctggcgagcatagacgggacaagcgctctgtggccctggcccctcacgtcgggatgggactcgatacaagaacccaaacatggatgagcgctgagggcgcctggcggcaggtcgaaaaagttgagacctgggctttccgccatcccggctttacgattctggcccttttcctggcgcactacatcgggacatccctcacccagaaggtggtcatctttattctgcttatgctggtgacaccttctatgaccatgagatgtgttggagtgggcaaccgggacttcgtcgaagggctcagcggagccacctgggtggatgtggtcctggagcatggcgggtgcgttacaacgatggctaagaataaacccaccctggacatcgagctccagaagacagaagccacccaactggctacacttcgcaaactgtgtattgagggaaagatcaccaacgtgacgacagattccagatgccctacccagggcgaagccattctcccggaggaacaggaccagaattatgtgtgtaaacacacctacgtcgatcggggctgggggaacggatgcggcctgtttgggaagggaagccttgtgacatgcgcgaagttccaatgtctggagtctatcgagggcaaagccgttcagcacgaaaatctcaagtataccgtgacaattacggtccataccggggaccagcaccaggtgggaaacgagacacaaggcgttaccgctgaaatcacaccccaggcctccaccgtggaggctatcctgcctgaatacggcacgctggggctcgagtgcagcccccgcaccggactggactttaatgagatgattcttctgacaatgaaaaacaaggcctggatggtccatagacagtggttctttgatctccctctgccctggacctctggcgccacaaccgaaacgccgacatggaataaaaaggagcttctggtgaccttcaaaaacgctcacgcgaagaagcaagaagtcgtggttctcgggtcccaggagggagccatgcacacagctctgaccggcgccaccgaaatccagacaagcgggggcacgtctatttttgccggacatctgaaatgtcggctcaagatggacaaactggagcttaagggcatgtcctatgctatgtgcctgaatgccttcgtgctcaaaaaggaggtcagcgaaacccagcacgggacaatcctgattaaggtggagtacaaaggagaagatgcgccttgtaagatccccttctccaccgaggacggccaagggaaagctcataacggacgcctgatcacagccaaccctattgttaccaagaaagaggaacccgtgaatatcgaggccgaacccccttttggcgagtctaacattgtcatcgggattggcgataaggctcttaagatcaattggtacaaaaagggaagctccatcggcaaaatgttcgaagccacggctagaggggcccggagaatggcgattctcggagacacagcctgggattttggcagcgtcgggggagtgctgaactctctgggcaagatggttcaccagatcttcgggtccgcttataccgccctctttagcggcgtctcttggattatgaaaatcggaattggcgtgctgcttacctggatcgggctgaatagcaagaacacatccatgtctttcagctgcattgtgatcggaatcattaccctctacctgggcgctgtcgtgcaggccgacatggggtgtgttatcaattggaagggaaaagagctgaagtgcggctccgggatttttgtgacaaacgaggtccatacgtggaccgaacagtataaattccaagcggatagcccgaagcgccttgccacagctatcgccggcgcttgggagaatggagtgtgtggcattcggtctaccacaagaatggaaaacctcctgtggaaacagatcgccaatgagctgaactacatcctctgggaaaataacattaagctgaccatcgttgtgggggacgtcattggagtgcttgagcagggcaaacgcacgctgacaccccagcctatggagctcaagtattcctggaagacatgggggaaagccaagatcgttaccgctgaaacacaaaatagctcttttattatcgatggacccaacacccctgagtgcccctccgcgagccgggcctggaacgtgtgggaagtcgaggactacggcttcggcgtgtttacaaccaatatctggctgaaactgagagaagtgtatacgcagctttgtgaccaccgcctcatgtccgctgccgtcaaggatgagcgggccgttcacgctgacatggggtactggattgagtctcagaaaaacggaagctggaagctggaaaaggcctccctgatcgaggtgaaaacatgcacctggccgaagtctcataccctctggagcaatggcgtgctggaatccgatatgattatccctaaaagccttgcggggcccatttctcagcacaactacagacctggatatcatacacaaaccgctggcccctggcacctggggaagctcgagctggacttcaattactgcgagggaacgacagtcgtgatcaccgaaaactgtggcacacgcggcccttccctgcggaccacaaccgttagcgggaaacttatccacgagtggtgctgtagatcttgcacgctgcccccgctgcgctatatgggagaagatggctgttggtacgggatggagattcggcctatcaatgaaaaggaggagaacatggtgaagtccctggtcagcgccggatctggcaaagccgacaattttaccatgggggtgctctgcctggctattcttttcgaagaggttatgagaggaaagttcggcaaaaagcatatgatcagcggcgccctgtttacattcgtgctcctgctgtccgggcagattacctggcgggatatggcgcacacacttatcatgattggaagcaacgcttctgaccgcatgggcatgggggtcacctatctggccctcatcgccacgtttaaaatccagcccttcctggctctcggatttttcctgagaaaacttacatcccgggaaaatctgctcctgggcgtggggctggccatggctaccacacttcaactgcccgaggatattgaacagatggccaacggaatcgcgctcggcctgatggccctcaagctgattacccagtttgagacctaccagctttggacagctctggttagcctcatgtgttccaatacgatcttcaccctgacagtggcctggagaaccgctacactgattcttgccgtcatctctctgctccctgtgtgccaaagctcctctatgcgcaaaaccgactggctgccgatgacggtggccgctatgggcgtgccccctctccccctgtttatcttcagccttaaggatacactgaaacggagatcctggcctctgaacgagggggttatggcggtgggactcgtgtctattctggccagctcctttcttcgcaatgacgtccccatggctggccctctggtggccgggggactcctgatcgcctgttatgttattaccggcaccagcgctgatctcacagtggaaaaggccgcggacgtcacctgggaggaagaggctgaacagacaggggtgtctcataacctgatgatcacggttgacgatgacggaaccatgagaattaaagatgacgagacagagaacatccttaccgtgctgctgaagacagccctcctgatcgtctccggcattttcccctacagcatcccggccacccttctggtgtggcacacgtggcagaaacagacccaacggtctggcgtcctctgggatgtgccttctccccctgaaacacagaaggctgagctggaagagggggtttaccgcattaagcagcagggaatctttggcaaaacccaagtgggggtcggagtgcagaaggagggcgttttccatacaatgtggcacgtgaccagaggggccgtcctcacacacaatggaaaacggctggaacccaactgggcgaatgtgaagaaagaccttattagctatggcggcgggtggaagctgagcgctcagtggcaaaagggagaggaagtgcaggttatcgccgtcgagccgggcaaaaaccctaagaatttccagacgatgcccgggatttttcagaccacaaccggagaaatcggcgccatcgctctggatttcaaacctgggacctccggaagccccattatcaaccgcgagggcaaggtggtgggcctctacgggaatggagtcgtgaccaagaacggcgggtatgtttccggaattgcccaaacgaatgctgagcccgacggccctaccccggaactggaggaagagatgtttaagaagagaaaccttacaatcatggatctgcatcccgggagcggcaaaacccggaagtacctccctgccattgtgcgcgaagcgatcaaaagacggctgcgcacactcatcctggcccccaccagagtcgtggctgccgagatggaggaagctcttaagggactgcctattcggtatcagacgacagccaccaaatctgagcacaccggcagagaaatcgttgacctgatgtgccatgccacattcaccatgcgcctcctgagccccgtgcgggtccctaattacaaccttattgtgatggatgaggctcactttacagacccggcgtccatcgccgctagagggtatatttctacccgcgttggaatgggcgaagccgccgctatcttcatgacggccacaccccctgggaccgcggatgcttttccccagagcaatgcccctatccaggacgaggagcgggacattcccgaaagatcctggaactctggaaatgagtggatcacagatttcgccggcaagaccgtgtggtttgtcccgagcattaaggctgggaacgacatcgccaactgtctgcgcaaaaatggcaagaaagtgattcaactctcccggaagacgttcgataccgaataccagaaaacaaagctgaacgactgggattttgtggtcaccacagacatctctgagatgggagcgaatttcaaggccgatagagttattgaccctcgccggtgcctgaaacccgtgatcctcaccgatggccccgagagagtgatccttgctgggcctatgcccgtcacagtggccagcgctgcccagcggcgcggaagagttggccggaaccctcagaaggaaaatgaccaatacattttcaccgggcagccgctgaacaatgatgaggaccatgctcactggacggaagccaaaatgctgctcgacaacatcaatacacccgagggaattatccctgcgctgtttgaacccgagcgcgagaagtccgccgctattgatggcgaatatagacttaaaggggagagccggaagaccttcgtggaactgatgagacgcggcgacctccctgtctggctggcccacaaagtggcttctgagggaatcaagtacaccgatcggaagtggtgctttgacggcgaaagaaacaatcagatcctggaggagaacatggatgttgaaatttggacaaaagagggggaaaagaaaaagctccgcccccggtggcttgacgccagaacctattccgatccgctggccctgaaagagttcaaggactttgctgcgggacgcaagagcatcgccctcgatctggtgacagaaattggccgggtcccttctcatcttgctcacagaacgcgcaatgccctggacaacctcgtgatgctgcatacctccgagcacgggggcagagcctaccggcacgctgtcgaggaactgcccgagacaatggaaaccctccttctgctgggcctcatgatcctgcttacaggcggggccatgctgttcctcattagcggaaaaggcatcgggaagacctccatcggactgatttgtgtggttgcgtctagcggcatgctgtggatggccgatgtgcctctccagtggatcgcttccgccattgtgcttgagtttttcatgatggtcctgctgatccccgagcctgaaaaacaacgcacgccccaggacaatcagctcgcttatgttgtgattgggatcctgacccttgccgcgattgtggccgctaacgagatgggactgctcgaaacaaccaagagagatctgggcatgagcaaagagccgggcgtcgtgtctcctacatcctacctggacgttgacctccatcccgccagcgcttggaccctttatgccgtggctacgacagtcatcacccccatgctgcggcacacaatcgaaaattctaccgccaacgtgagcctggcggccattgctaaccaagccgtcgtgctcatggggctggataagggatggcctatctccaagatggaccttggcgttccgctgctcgctctggggtgctactctcaggtgaatcccctgaccctcacagccgccgtccttctgctggtgacgcattacgcgattatcggacctggcctccaggctaaagccacccgcgaggctcagaagagaacagccgccgggattatgaaaaaccccaccgttgatggaatcatgacaatcgacctggatcctgtgatttatgacagcaagtttgagaaacaacttggccaggtcatgctgctcgtgctgtgtgctgtgcagctgctccttatgcggacctcctgggccttctgcgaagcgctgacgctggccacaggccccatcaccaccctctgggaggggtctcctggaaagttttggaatacaaccattgctgttagcatggccaacatcttcagaggctcctacctggctggggccggacttgcgtttagcattatgaagtctgtcggcacagggaaacgcggaacgggctcccagggcgaaaccctgggggagaagtggaaaaagaaactcaatcaactgagccggaaggagttcgatctgtataaaaagtccggaatcacagaggtggacagaaccgaggccaaggaaggcctcaaacgcggggagatcacacaccatgctgtgtctcggggaagcgccaaacttcagtggttcgtcgaaagaaacatggttattccggagggccgggtgatcgatctggggtgtggacgcggcggctggtcctactattgcgctgggctgaaaaaggtgaccgaagtcagaggatacacgaaaggcgggcccggacacgaggagcctgtgcccatgtctacctatggctggaatattgttaagctcatgagcgggaaggacgtgttttacctgcctcccgaaaaatgtgatacacttctgtgcgacatcggagagtccagcccgtctcctaccgtcgaagagtcccggacaattcgcgtgctcaagatggttgagccctggctgaaaaacaatcagttctgtatcaaggtgctgaacccctacatgcctaccgtcattgaacacctcgagagacttcagcggaaacatggcggcatgctggtgcgcaatcccctgagcagaaactctacacacgaaatgtattggatctccaatgggaccggaaacatcgtgagctctgtcaatatggttagccggctcctgcttaaccgctttacgatgacacatagacggcctaccattgagaaggatgtggacctgggcgccgggaccagacacgtgaacgctgaaccggagacacccaatatggacgtcatcggagagcgcattcggagaatcaaggaagaacactcctctacgtggcattacgatgacgaaaacccttataaaacctgggcctaccacggcagctatgaggtgaaggcgacagggtccgccagctccatgattaatggagttgtgaaactcctgaccaagccctgggatgtcgtgcctatggttacacaaatggctatgaccgacacaacccccttcggccagcagcgcgtgtttaaagaaaaggtcgatacgcggaccccgagacctatgcccggcacacgcaaggtgatggagatcaccgccgagtggctgtggcggacactcgggagaaacaaacgccctcggctgtgcaccagagaagagttcatcaagaaagttcgcacgaatgctgccatgggagccgtgtttacagaagagaaccaatgggactctgcgcgggctgccgtcgaagatgaggagttctggaaacttgtggacagagaacgcgagctgcataaactcggcaagtgtgggagctgcgtctacaatatgatgggaaaaagagaaaagaagctgggcgagtttgggaaagccaagggctcccgggctatttggtatatgtggcttggagcccgctacctggagttcgaagctctcggctttctgaacgaggatcactggttctctagagaaaatagctactccggggtggagggagaaggcctgcataaactcgggtatatcctgcgggacatttctaagatccccggaggcgccatgtacgcggatgacaccgccgggtgggacacaagaattaccgaggatgaccttcacaacgaggagaagatcacgcagcagatggatcctgagcaccggcagctggctaatgccatctttaagctcacctatcaaaacaaggttgtgaaagtccagcgccccacaccgaagggcaccgtgatggacattatcagcagaaaagatcagcggggatccggccaggtggggacatacggactgaataccttcacaaacatggaagctcaacttattcgccagatggagggcgaaggggttctgagcaaggccgacctcgagaatccttatctgctggagaaaaaggtgacccagtggctcgaaacgaagggagtcgagagactgaaacggatggcgatctctggcgatgactgcgtggttaagcccattgatgaccgcttcgccaacgcccttctcgctctcaacgatatggggaaagtgagaaaggacatcccccagtggcaaccttccaaaggctggcatgattggcagcaggtcccgttttgtagccaccatttccacgaactgatcatgaaggacggacggaaacttgtggtcccctgccgccctcaggacgagctgattggcagagctcggatctctcaaggggccggatggtccctccgcgaaacagcttgtctgggcaaagcctacgcgcagatgtgggccctgatgtattttcacagacgggatctccgcctggctagcaatgccatttgctctgccgtgcccgttcattgggtgcctacctccagaaccacatggagcatccacgctcatcaccagtggatgaccacagaggacatgcttacggtctggaaccgggtgtggattgaggataatccctggatggaagacaagacccctgttacaacctgggaggatgtgccctacctggggaaaagagaagaccaatggtgtggatccctcatcggcctgacaagccgcgccacctgggcgcagaacattcttacggctatccagcaggtccggtctctgatcgggaatgaggagttcctcgattacatgccgagcatgaagagatttcgcaaagaagaggaatccgagggcgccatttggtga

SEQ ID NO: 20948 - RNA, 9873 nt, synthetic construct
  misc_feature 1..9873: note = derived and/or modified CDS sequence (opt5) from DENV-3__AY744683__SS-prME
  source 1..9873: mol_type = other RNA
accagcctgtgcctcatgatgatgctgcccgccacacttgctttccacctgacgtccagagacggcgagcctcggatgatcgtggggaagaacgaacgcggaaaatctctcctgtttaagaccgccagcggcattaatatgtgtacacttatcgcgatggatctgggggagatgtgcgacgataccgtcacatacaaatgtccgctcattaccgaagttgagcccgaagacatcgattgctggtgtaacctgacatccacctgggtgacgtatggaacctgcaatcaggctggcgagcatagacgggacaagcgctctgtggccctggcccctcacgtcgggatgggactcgatacaagaacccaaacatggatgagcgctgagggcgcctggcggcaggtggaaaaagttgagacctgggctttccgccatcccggctttacgattctggcccttttcctggcgcactacatcgggacatccctcacccagaaggtggtcatctttattctgcttatgctggtgacaccttctatgaccatgagatgtgttggagtgggcaaccgggacttcgtcgaagggctcagcggagccacctgggtggatgtggtcctggagcatggcgggtgcgttacaacgatggctaagaataaacccaccctggacatcgagctccagaagacagaagccacccaactggctacacttcgcaaactgtgtattgagggaaagatcaccaacgtgacgacagattccagatgccctacccagggcgaagccattctcccggaggaacaggaccagaattatgtgtgtaaacacacctacgtcgatcggggctgggggaacggatgcggcctgtttgggaagggaagccttgtgacatgcgcgaagttccaatgtctggagtctatcgagggcaaagccgttcagcacgaaaatctcaagtataccgtgattatcacagtccatacgggggaccagcaccaggtgggaaacgagacccaaggcgttacagctgaaatcaccccccaggcctccacagtggaggctattctgcctgaatacggcaccctggggctcgagtgcagcccccgcacgggactggactttaatgagatgatccttctgaccatgaaaaacaaggcctggatggtccatagacagtggttctttgatctccctctgccctggacatctggcgccaccacagaaaccccgacgtggaataaaaaggagcttctggtgacattcaaaaacgctcacgcgaagaagcaagaagtcgtggttctcgggtcccaggagggagccatgcacaccgctctgacaggcgccaccgaaattcagaccagcgggggcacatctatctttgccggacatctgaaatgtcggctcaagatggacaaactggagcttaagggcatgtcctatgctatgtgcctgaatgccttcgtgctcaaaaaggaggtcagcgaaacgcagcacgggaccattctgatcaaggtggagtacaaaggagaagatgcgccttgtaagatccccttctccacagaggacggccaagggaaagctcataacggacgcctgattaccgccaaccctatcgttacaaagaaagaggaacccgtgaatattgaggccgaacccccttttggcgagtctaacatcgtcattgggatcggcgataaggctcttaagatcaattggtacaaaaagggaagctccattggcaaaatgttcgaagccaccgctagaggggcccggagaatggcgatcctcggagacacggcctgggattttggcagcgtggggggagtgctgaactctctgggcaagatggttcaccagattttcgggtccgcttatacagccctctttagcggcgtctcttggatcatgaaaattggaatcggcgtgctgcttacctggattgggctgaatagcaagaacacctccatgtctttcagctgcatcgtgatcggaattatcacactctacctgggcgctgtcgtgcaggccgacatggggtgtgttattaattggaagggaaaagagctgaagtgcggctccgggatctttgtgaccaacgaggtccatacatggacggaacagtataaattccaagcggatagcccgaagcgccttgccaccgctattgccggcgcttgggagaatggagtgtgtggcatccggtctacaaccagaatggaaaacctcctgtggaaacagatcgccaatgagctgaactacattctctgggaaaataacatcaagctgacaattgttgtgggggacgtcatcggagtgcttgagcagggcaaacgcaccctgacgccccagcctatggagctcaagtattcctggaagacctgggggaaagccaagattgttacagctgaaacccaaaatagctcttttatcatcgatggacccaacacacctgagtgcccctccgcgagccgggcctggaacgtgtgggaagtcgaggactacggcttcggcgtgtttaccacaaatatttggctgaaactgagagaaatgtatacccagctttgtgaccaccgcctcatgtccgctgccgtgaaggatgagcgggccgtccacgctgacatggggtactggatcgagtctcagaaaaacggaagctggaagctggaaaaggcctccctgattgaggttaaaacgtgcacatggccgaagtctcataccctctggagcaatggcgtgctggaatccgatatgatcattcctaaaagccttgcggggcccatctctcagcacaactacagacctggatatcatacccaaacagctggcccctggcacctggggaagctcgagctggacttcaattactgcgagggaaccacggtggtcatcacagaaaactgtggcacccgcggcccttccctgcggacaaccacagtgagcgggaaacttattcacgagtggtgctgtagatcttgcaccctccccccgctgcgctatatgggagaagatggctgttggtacgggatggagatccggcctattaatgaaaaggaggagaacatggttaagtccctggtgagcgccggatctggcaaagccgacaattttacgatgggggtcctctgcctggctatccttttcgaagaggtgatgagaggaaagttcggcaaaaagcatatgattgccggcgcgctgtttaccttcgttctcctgctgagcgggcagatcacatggcgggatatggctcacacccttattatgatcggatccaacgccagcgaccgcatgggcatgggggtgacatatctggccctcatcgctacctttaaaattcagcccttcctggccctcggatttttcctgagaaagcttacgtctcgggaaaatctgctcctgggcgtcgggctggctatggccacaacccttcaactgcccgaggatatcgaacagatggcgaacggaattgccctcggcctgatggctctcaagctgatcacacagtttgagacctaccagctttggaccgccctggtgtccctcatgtgtagcaatacaattttcacgctgaccgttgcttggagaacagccaccctgatccttgccgtgatctccctgctccctgtctgccaatctagctccatgcgcaaaacagactggctgccgatgaccgtggctgcgatgggcgtgccccctctccccctgtttattttctctcttaaggatacgctgaaacggagaagctggcctctgaacgagggggtcatggccgttggactcgtgtccatcctggcttctagctttcttcgcaatgacgtgcccatggccggccctctggtcgccgggggactcctgattgcttgttatgtgatcacaggcacctccgccgatctcaccgttgaaaaggcggctgacgtgacatgggaggaagaggccgaacagaccggggtcagccataacctgatgattacagtggacgatgacggaacgatgagaatcaaagatgacgagaccgagaacatccttacagttctgctgaagaccgccctcctgattgtgtctggcatcttcccctactccattccggctacacttctggtctggcacacctggcagaaacagacgcaacggagcggcgtgctctgggatgtcccttctccccctgaaacccagaaggccgagctggaagagggggtgtaccgcatcaagcagcagggaatttttggcaaaacacaagttggggtgggagtccagaaggagggcgtgttccataccatgtggcacgttacaagaggggcggtgctcacccacaatggaaaacggctggaacccaactgggctaatgtcaagaaagaccttatctcctatggcggcgggtggaagctgagcgcccagtggcaaaagggagaggaagtgcaggtgattgccgttgagccgggcaaaaaccctaagaatttccagacaatgcccgggatctttcagacgaccacaggagaaatcggcgctattgccctggatttcaaacctgggacctctggatcccccatcattaaccgcgagggcaaggtcgtgggcctctacgggaatggagtggtcaccaaaaacggcgggtatgtgagcggaatcgctcaaacaaatgccgagcccgacggccctacgccggaactggaggaagagatgtttaagaagagaaaccttaccattatggatctgcatcccgggtccggcaaaacacggaagtacctccctgcgatcgttcgcgaagccatcaaaagacggctgcgcaccctcattctggctcccacaagagtggtcgccgctgagatggaggaagcccttaagggactgcctatccggtatcagaccacggccacaaaaagcgagcacaccggcagagaaattgtggacctgatgtgccatgctaccttcacaatgcgcctcctgtctcccgttcgggtgcctaattacaaccttatcgtcatggatgaggcgcactttaccgacccggccagcattgctgccagagggtatatctccacacgcgtgggaatgggcgaagccgctgccatcttcatgaccgcgacgccccctgggacagctgatgcctttccccagtctaatgcccctattcaggacgaggagcgggacatccccgaaagaagctggaactccggaaatgagtggattaccgatttcgctggcaagacagtttggtttgtgccgtctatcaaggccgggaacgacattgcgaactgtctgcgcaaaaatggcaagaaagtcatccaactcagccggaagaccttcgatacggaataccagaaaaccaagctgaacgactgggattttgtggtgacaaccgacatttccgagatgggagccaatttcaaggctgatagagtcatcgaccctcgccggtgcctgaaacccgttatcctcacagatggccccgagagagtgattcttgccgggcctatgcccgtgaccgtcgcttctgccgctcagcggcgcggaagagtgggccggaaccctcagaaggaaaatgaccaatacatcttcacagggcagccgctgaacaatgatgaggaccatgcccactggaccgaagcgaaaatgctgctcgacaacattaatacgcccgagggaatcattcctgccctgtttgaacccgagcgcgagaagagcgctgccatcgatggcgaatatagacttaaaggggagtcccggaagacattcgttgaactgatgagacgcggcgacctccctgtgtggctggctcacaaagtcgccagcgagggaatcaagtacaccgatcggaagtggtgctttgacggcgaaagaaacaatcagattctggaggagaacatggatgtggaaatctggaccaaagagggggaaaagaaaaagctccgcccccggtggcttgacgccagaacatattctgatccgctggctctgaaagagttcaaggactttgcggccggacgcaagtccattgctctcgatctggttaccgaaatcggccgggtgcctagccatcttgcccacagaacacgcaatgccctggacaacctcgtcatgctgcatacgtctgagcacgggggaagagcttaccggcacgccgtggaggaactgcccgagaccatggaaacactccttctgctgggcctcatgattctgcttaccggcggggcgatgctgttcctcatctccggaaaaggcatcgggaagacaagcattggactgatctgtgtcgtggcctcctctggcatgctgtggatggctgatgttcctctccagtggattgccagcgctatcgtgcttgagtttttcatgatggtgctgctgattcccgagcctgaaaaacaacgcaccccccaggacaatcagctcgcctatgtcgttatcgggattctgacgcttgcggccatcgtggctgccaacgagatgggactgctcgaaaccacaaagagagatctgggcatgtccaaagagccgggcgtggtcagccctacctcttacctggacgtggacctccatcccgcttccgcctggacactttatgctgttgccaccacggtgatcacacccatgctgcggcacaccattgaaaatagcacagcgaacgtctctctggccgctatcgccaaccaagctgtggtcctcatggggctggataagggatggcctattagcaagatggaccttggcgtgccgctgctcgccctggggtgctactcccaggttaatcccctgaccctcaccgccgcggtgcttctgctggtcacacattacgctatcattggacctggcctccaggccaaagctacgcgcgaggcccagaagagaaccgccgctgggatcatgaaaaaccccacagtggatggaatcatgaccattgacctggatcctgttatctatgactctaagtttgagaaacaacttggccaggtgatgctgctcgtcctgtgtgccgtgcagctgctccttatgcggacaagctgggcgttctgcgaagccctgaccctggctacgggccccattacaaccctctgggaggggtcccctggaaagttttggaataccacaatcgccgtgtctatggctaacattttcagaggcagctacctggccggggcgggacttgccttttccatcatgaagagcgttggcaccgggaaacgcggaacaggctctcagggcgaaacgctgggggagaagtggaaaaagaaactcaatcaactgtcccggaaggaattcgatctgtataaaaagagcggaatcaccgaggtcgacagaacagaggctaaggaaggcctcaaacgcggggagattacccaccatgccgtgtcccggggatctgctaagcttcagtggttcgtggaaagaaacatggtcatcccggagggccgggttattgatctggggtgtggacgcggcggctggagctactattgcgccgggctgaaaaaggtgacagaagtgagaggatacaccaaaggcgggcccggacacgaggagcctgtccccatgtccacgtatggctggaatatcgtgaagctcatgtctgggaaggacgttttttacctgcctcccgaaaaatgtgatacccttctgtgcgacattggagagagctccccgagccctacagtggaagagtctcggaccatccgcgtcctcaagatggtggagccctggctgaaaaacaatcagttctgtattaaggttctgaacccctacatgcctacagtgatcgaacacctcgagagacttcagcggaaacatggcggcatgctggtccgcaatcccctgtccagaaacagcacccacgaaatgtattggatctctaatgggacaggaaacattgtgtccagcgtgaatatggtctctcggctcctgcttaaccgctttaccatgacgcatagacggcctacaatcgagaaggatgttgacctgggcgctgggaccagacacgtgaacgccgaaccggagacccccaatatggacgtgattggagagcgcatccggagaattaaggaagagcacagctccacatggcattacgatgacgaaaacccttataaaacgtgggcgtaccacggctcttatgaggtcaaggccaccgggagcgcttccagcatgatcaatggagtggttaaactcctgacaaagccctgggatgtggtccctatggtgacccaaatggccatgacagacaccacacccttcggccagcagcgcgtttttaaagaaaaggtggatacccggacgccgagacctatgcccggcacccgcaaggtcatggagatcacagctgagtggctgtggcggaccctcgggagaaacaaacgccctcggctgtgcacaagagaagagttcattaagaaagtgcgcaccaatgccgccatgggagcggtttttacggaagagaaccaatgggactccgctcgggccgccgtggaagatgaggagttctggaagcttgtcgacagagaacgcgagctgcataaactcggcaagtgtgggtcttgcgtgtacaatatgatgggaaaaagagaaaagaagctgggcgagtttgggaaagctaagggcagccgggccatctggtatatgtggcttggagctcgcttcctggagtttgaagccctcggcttcctgaacgaggatcactggttttccagagaaaattcttacagcggggtcgagggagaaggcctgcataaactcgggtacattctgcgggacatctccaagattcccggaggcgcgatgtatgccgatgacacagctgggtgggacaccagaatcacagaggatgaccttcacaacgaggaaaaaatcacccagcagatggatcctgagcaccggcagctggccaatgctattttcaagctcacgtaccaaaacaaggtggttaaagtgcagcgccccaccccgaagggcacagtcatggacatcatttctagaaaagatcagcggggaagcggccaggtggggacctatggactgaatacattcaccaacatggaagcccaacttatccgccagatggagggcgaaggggtgctgtccaaggcggacctcgagaatcctcatctgctggagaaaaaggttacacagtggctcgaaaccaagggagtggagagactgaaacggatggccattagcggcgatgactgcgtcgtgaagcccatcgatgaccgctttgctaacgcccttctggctctcaacgatatggggaaagttagaaaggacatcccccagtggcaaccttctaaaggctggcacgattggcagcaggtgccgttctgttcccatcactttcacgaactgattatgaaggacggacggaagcttgtcgtgccctgccgccctcaggacgagctgatcggcagagcccggattagccaaggggctggatggtctctccgcgaaacggcctgtctgggcaaagcgtacgcccagatgtgggctctgatgtatttccatagacgggatctccgcctggcctccaatgccatctgcagcgctgtccccgtgcactgggttcctacatctagaaccacctggtccattcatgcccaccatcagtggatgacaaccgaggacatgcttacagtgtggaaccgggtctggatcgaggataatccctggatggaagacaagacgcctgtgaccacatgggaggatgttccctacctggggaaaagagaagaccaatggtgtggaagcctcattggcctgacctcccgcgcgacatgggctcagaacatccttaccgccatccagcaggtgcggagcctgattgggaatgaggagtttctcgattatatgccgtctatgaagagattccgcaaagaagaggaaagcgagggcgccatctggtga

SEQ ID NO: 20949 - RNA, 9873 nt, synthetic construct
  misc_feature 1..9873: note = derived and/or modified CDS sequence (opt5) from DENV-3__AY744684__SS-prME
  source 1..9873: mol_type = other RNA
accagcctctgcctcatgatgatgctgcccgccacccttgctttccacctgacgtccagagacggagagcctcggatgatcgtggggaagaacgaacgcggaaagtctctcctgtttaagaccgcctccggcattaatatgtgtacccttatcgcgatggatctgggggagatgtgcgacgataccgtgacatacaagtgtccgctcattaccgaagttgagcccgaagacatcgattgctggtgtaacctgacatccacctgggtgacgtatggaacctgcaatcaggctggcgagcatagacgggacaagcgctctgtggccctggcccctcacgtggggatgggactcgatacaagaacccagacatggatgagcgctgagggcgcctggagacaggtggaaaaggttgagacctgggctttccgccatcccggctttacgattctggcccttttcctggcgcactacatcgggacatccctcacccagaaggtggtcatctttattctgcttatgctggtgacaccttctatgaccatgagatgtgttggagtgggcaaccgggacttcgtcgaagggctcagcggagccacctgggtggatgtggtcctggagcatggcgggtgcgttacaacgatggctaagaataaacccaccctggacatcgagctccagaagacagaagccacccagctggctacacttcgcaaactgtgtattgagggaaagatcaccaacgtgacgacagattccagatgccctacccagggcgaagccattctcccggaggaacaggaccagaattatgtgtgtaaacacacctacgtcgatcggggctgggggaacggatgcggcctgtttgggaagggaagccttgtgacatgcgcgaagttccaatgtctggagtctatcgagggcaaagccgttcagcacgaaaatctcaagtataccgtgattatcacagtccatacgggggaccagcaccaggtgggaaacgagacccaaggcgttacagctgaaatcacaccccaggcctccacagtggaggctattctgcctgaatacggcaccctggggctcgagtgcagcccccgcacgggactggactttaatgagatgatccttctgaccatgaaaaacaaggcctggatggtccatagacagtggttctttgatctccctctgccctggacatctggcgccaccacagaaaccccgacgtggaataaaaaggagcttctggtgacattcaaaaacgctcacgcgaagaagcaagaagtcgtggttctcgggtcccaggagggagccatgcacaccgctctgacaggcgccaccgaaattcagaccagcgggggcacatctatctttgccggacatctgaaatgtcggctcaagatggacaaactggagcttaagggcatgtcctatgctatgtgcctgaatgccttcgtgctcaaaaaggaggtcagcgaaacgcagcacgggaccattctgatcaaggtggagtacaaaggagaagatgcgccttgtaagatccccttctccacagaggacggccaagggaaagctcataacggacgcctgattaccgccaaccctatcgttacaaagaaagaggaacccgtgaatattgaggccgaacccccttttggcgagtctaacatcgtcattgggatcggcgataaggctcttaagatcaattggtacaaaaagggaagctccattggcaaaatgttcgaagccaccgctagaggggcccggagaatggcgatcctcggagacacggcctgggattttggcagcgtcgggggagtgctgaactctctgggcaagatggttcaccagattttcgggtccgcttatacagccctctttagcggcgtctcttggatcatgaaaattggaatcggcgtgctgcttacctggattgggctgaatagcaagaacacctccatgtctttcagctgcatcgtgatcggaattatcacactctacctgggcgctgtcgtgcaggccgacatggggtgtgttattaattggaagggaaaagagctgaagtgcggctccgggatctttgtgaccaacgaggtccatacatggacggaacagtataaattccaagcggatagcccgaagcgccttgccaccgctattgccggcgcttgggagaatggagtgtgtggcatccggtctacaaccagaatggaaaacctcctgtggaaacagatcgccaatgagctgaactacattctctgggaaaataacatcaagctgacaattgttgtgggggacgtcatcggagtgcttgagcagggcaaacgcaccctgacgccccagcctatggagctcaagtattcctggaagacctgggggaaagccaagattgttacagctgaaacccaaaatagctcttttatcatcgatggacccaacacacctgagtgcccctccgcgagccgggcctggaacgtgtgggaagtcgaggactacggcttcggcgtgtttaccacaaatatttggctgaaactgagagaaatgtatacccagctttgtgaccaccgcctcatgtccgctgccgtgaaggatgagcgggccgtccacgctgacatggggtactggatcgagtctcagaaaaacggaagctggaagctggaaaaggcctccctgattgaggttaaaacgtgcacatggccgaagtctcataccctctggagcaatggcgtgctggaatccgatatgatcattcctaaaagccttgcggggcccatctctcagcacaactacagacctggatatcatacccaaacagctggcccctggcacctggggaagctcgagctggacttcaattactgcgagggaaccacggtggtcatcacagaaaactgtggcacccgcggcccttccctgcggacaaccacagtgagcgggaaacttattcacgagtggtgctgtagatcttgcaccctgcccccgctgcgctatatgggagaagatggctgttggtacgggatggagatccggcctattaatgaaaaggaggagaacatggttaagtccctggtgagcgccggatctggcaaagccgacaattttacgatgggggtcctctgcctggctatccttttcgaagaggtgatgagaggaaagttcggcaaaaagcatatgattgccggcgcgctgtttaccttcgttctcctgctgagcgggcagatcacatggcgggatatggctcacacccttattatgatcggatccaacgccagcgaccgcatgggcatgggggtgacatatctggccctcatcgctacctttaaaattcagcccttcctggccctcggatttttcctgagaaaacttacgtctcgggaaaatctgctcctgggcgtcgggctggctatggccacaacccttcaactgcccgaggatatcgaacagatggcgaacggaattgccctcggcctgatggctctcaagctgatcacacagtttgagacctaccagctttggaccgccctggtgtccctcatgtgtagcaatacaatttccacgctgaccgttgcttggagaacagccaccctgatccttgccgtgatctctctgctccctgtctgccaaagctcctctatgcgcaaaacagactggctgccgatgaccgtggctgcgatgggcgtgccccctctccccctgttcatttttagccttaaggatacgctgaaacggagatcctggcctctgaacgagggggtcatggccgttggactcgtgtctatcctggctagctccttccttcgcaatgacgtgcccatggccggccctctggtcgccgggggactcctgattgcttgttatgtgatcacaggcaccagcgccgatctcaccgttgaaaaggcggctgacgtgacatgggaggaagaggccgaacagaccggggtctctcataacctgatgattacagtggacgatgacggaacgatgagaatcaaagatgacgagaccgagaacatccttacagttctgctgaagaccgccctcctgattgtgtccggcatctttccctacagcattccggctacacttctggtctggcacacctggcagaaacagacgcaacggtctggcgtgctctgggatgtcccttctccccctgaaacccagaaggccgagctggaagagggggtgtaccgcatcaagcagcagggaattttcggcaaaacacaagttggggtgggagtccagaaggagggcgtgtttcataccatgtggcacgttacaagaggggcggtgctcacccacaatggaaaacggctggaacccaactgggctaatgtcaagaaagaccttatcagctatggcggcgggtggaagctgagcgcccagtggcaaaagggagaggaagtccaggtgattgccgttgagccgggcaaaaaccctaagaatttccagacaatgcccgggatcttccagacgaccacaggagaaatcggcgctattgccctggattttaaacctgggacctccggaagccccatcattaaccgcgagggcaaggtcgtgggcctctacgggaatggagtggtcaccaaaaacggcgggtatgtgtccggaatcgctcaaacaaatgccgagcccgacggccctacgccggaactggaggaagagatgttcaagaagagaaaccttaccattatggatctgcatcccgggagcggcaaaacacggaagtacctccctgcgatcgttcgcgaagccatcaaaagacggctgcgcaccctcattctggctcccacaagagtggtcgccgctgagatggaggaagcccttaagggactgcctatccggtatcagaccacggccacaaaatctgagcacaccggcagagaaattgtggacctgatgtgccatgctacctttacaatgcgcctcctgagccccgttcgggtgcctaattacaaccttatcgtcatggatgaggcgcacttcaccgacccggcctccattgctgccagagggtatatctctacacgcgtgggaatgggcgaagccgctgccatctttatgaccgcgacgccccctgggacagctgatgccttcccccagagcaatgcccctattcaggacgaggagcgggacatccccgaaagatcctggaactctggaaatgagtggattaccgattttgctggcaagacagtttggttcgtgccgagcatcaaggccgggaacgacattgcgaactgtctgcgcaaaaatggcaagaaagtcatccaactctcccggaagacctttgatacggaataccagaaaaccaagctgaacgactgggatttcgtggtgacaaccgacatttctgagatgggagccaattttaaggctgatagagtcatcgaccctcgccggtgcctgaaacccgttatcctcacagatggccccgagagagtgattcttgccgggcctatgcccgtgaccgtcgctagcgccgctcagcggcgcggaagagtgggccggaaccctcagaaggaaaatgaccaatacatcttcacagggcagccgctgaacaatgatgaggaccatgcccactggaccgaagcgaaaatgctgctcgacaacattaatacgcccgagggaatcattcctgccctgttcgaacccgagcgcgagaagtccgctgccatcgatggcgaatatagacttaaaggggagagccggaagacatttgttgaactgatgagacgcggcgacctccctgtgtggctggctcacaaagtcgcctctgagggaatcaagtacaccgatcggaagtggtgcttcgacggcgaaagaaacaatcagattctggaggagaacatggatgtggaaatctggaccaaagagggggaaaagaaaaagctccgcccccggtggcttgacgccagaacatattccgatccgctggctctgaaagagtttaaggacttcgcggccggacgcaagagcattgctctcgatctggttaccgaaatcggccgggtgccttctcatcttgcccacagaacacgcaatgccctggacaacctcgtcatgctgcatacgtccgagcacgggggccgggcttaccggcacgccgtggaggaactgcccgagaccatggaaacactccttctgctgggcctcatgattctgcttaccggcggggcgatgctgtttctcatcagcggaaaaggcatcgggaagacatccattggactgatctgtgtcgtggcctctagcggcatgctgtggatggctgatgttcctctccagtggattgcctccgctatcgtgcttgagttctttatgatggtgctgctgattcccgagcctgaaaaacaacgcacaccccaggacaatcagctcgcctatgtcgttatcgggattctgacgcttgcggccatcgtggctgccaacgagatgggactgctcgaaaccacaaagagagatctgggcatgagcaaagagccgggcgtggtctctcctacctcctacctggacgtggacctccatcccgctagcgcctggacactttatgctgttgccaccacggtgatcacacccatgctgcggcacaccattgaaaattctacagcgaacgtcagcctggccgctatcgccaaccaagctgtggtcctcatggggctggataagggatggcctatttccaagatggaccttggcgtgccgctgctcgccctggggtgctactctcaggttaatcccctgaccctcaccgccgcggtgcttctgctggtcacacattacgctatcattggacctggcctccaggccaaagctacgcgcgaggcccagaagagaaccgccgctgggatcatgaaaaaccccacagtggatggaatcatgaccattgacctggatcctgttatctatgacagcaagttcgagaaacaacttggccaggtgatgctgctcgtcctgtgtgccgtgcagctgctccttatgcggacatcctgggcgttttgcgaagccctgaccctggctacgggccccattacaaccctctgggaggggtctcctggaaagttctggaataccacaatcgccgtgagcatggctaacatttttagaggctcctacctggccggggcgggacttgccttcagcatcatgaagtctgttggcaccgggaaacgcggaacaggctcccagggcgaaacgctgggggagaagtggaaaaagaaactcaatcaactgagccggaaggaatttgatctgtataaaaagtccggaatcaccgaggtcgacagaacagaggctaaggaaggcctcaaacgcggggagattacccaccatgccgtgtctcggggaagcgctaaacttcagtggttcgtggaaagaaacatggtcatcccggagggccgggttattgatctggggtgtggacgcggcggctggtcctactattgcgccgggctgaaaaaggtgacagaagtgagaggatacaccaaaggcgggcccggacacgaggagcctgtccccatgtctacgtatggctggaatatcgtgaagctcatgagcgggaaggacgttttctacctgcctcccgaaaaatgtgatacccttctgtgcgacattggagagtccagcccgtctcctacagtggaagagtcccggaccatccgcgtcctcaagatggtggagccctggctgaaaaacaatcagttttgtattaaggttctgaacccctacatgcctacagtgatcgaacacctcgagagacttcagcggaaacatggcggcatgctggtccgcaatcccctgagcagaaactctacccacgaaatgtattggatctccaatgggacaggaaacattgtgagctctgtgaatatggtcagccggctcctgcttaaccgcttcaccatgacgcatagacggcctacaatcgagaaggatgttgacctgggcgctgggaccagacacgtgaacgccgaaccggagacccccaatatggacgtgattggagagcgcatccggagaattaaggaagaacactcctctacatggcattacgatgacgaaaacccttataaaacgtgggcgtaccacggcagctatgaggtcaaggccaccgggtccgctagctccatgatcaatggagtggttaaactcctgacaaagccctgggatgtggtccctatggtgacccaaatggccatgacagacaccacaccctttggccagcagcgcgttttcaaagaaaaggtggatacccggacgccgagacctatgcccggcacccgcaaggtcatggagatcacagctgagtggctgtggcggaccctcgggagaaacaaacgccctcggctgtgcacaagagaagagtttattaagaaagtgcgcaccaatgccgccatgggagcggttttcacggaagagaaccaatgggactctgctcgggccgccgtggaagatgaggagttttggaaacttgtcgacagagaacgcgagctgcataaactcggcaagtgtgggagctgcgtgtacaatatgatgggaaaaagagaaaagaagctgggcgagttcgggaaagctaagggctcccgggccatctggtatatgtggcttggagctcgctacctggagtttgaagccctcggcttcctgaacgaggatcactggttttctagagaaaatagctactccggggtcgagggagaaggcctgcataaactcgggtatattctgcgggacatctctaagattcccggaggcgcgatgtacgccgatgacacagctgggtgggacaccagaatcacagaggatgaccttcacaacgaggagaagatcacccagcagatggatcctgagcaccggcagctggccaatgctattttcaagctcacgtatcaaaacaaggtggttaaagtgcagcgccccaccccgaagggcacagtcatggacatcattagcagaaaagatcagcggggatccggccaggtggggacctacggactgaatacatttaccaacatggaagcccaacttatccgccagatggagggcgaaggggtgctgagcaaggcggacctcgagaatcctcatctgctggagaaaaaggttacacagtggctcgaaaccaagggagtggagagactgaaacggatggccatttctggcgatgactgcgtcgtgaagcccatcgatgaccgcttcgctaacgcccttctggctctcaacgatatggggaaagttagaaaggacatcccccagtggcaaccttccaaaggctggcacgattggcaacaggtgccgttctgtagccatcactttcacgaactgattatgaaggacggacggaaacttgtcgtgccctgccgccctcaggacgagctgatcggcagagcccggatttctcaaggggctggatggtccctccgcgaaacggcctgtctgggcaaagcgtatgcccagatgtgggctctgatgtacttccatagacgggatctccgcctggccagcaatgccatctgctctgctgtccccgtgcactgggttcctacatccagaaccacctggagcattcatgcccaccatcagtggatgacaaccgaggacatgcttacagtgtggaaccgggtctggatcgaggataatccctggatggaagacaagacgcctgtgaccacatgggaggatgttccctatctggggaaaagagaagaccaatggtgtggatccctcattggcctgaccagccgcgcgacatgggctcagaacatccttaccgccatccaacaggtgcggtctctgattgggaatgaggagtttctcgattacatgccgagcatgaagagattccgcaaagaagaggaatccgagggcgccatctggtga

SEQ ID NO: 20950 - RNA, 9873 nt, synthetic construct
  misc_feature 1..9873: note = derived and/or modified CDS sequence (opt5) from DENV-3__AY744685__SS-prME
  source 1..9873: mol_type = other RNA
accagcctgtgcctcatgatgatgctgcccgccacacttgctttccacctgacgagcagagacggagaacctcggatgatcgtggggaagaacgaacgcggaaaatctctcctgtttaagaccgccagcggcattaatatgtgtacacttatcgcgatggatctgggggagatgtgcgacgataccgtgacatacaaatgtccgctcattaccgaagttgagcccgaagacatcgattgctggtgtaacctgacatccacctgggtgacgtatggaacctgcaatcaggctggcgagcatagacgggacaagcgctctgtggccctggcccctcacgtcgggatgggactcgatacaagaacccaaacatggatgagcgctgagggcgcctggagacaggtggaaaaagttgagacctgggctttccgccatcccggctttacgattctggcccttttcctggcgcactacatcgggacatccctcacccagaaggtggtcatctttattctgcttatgctggtgacaccttctatgaccatgagatgtgttggagtgggcaaccgggacttcgtcgaagggctcagcggagccacctgggtggatgtggtcctggagcatggcgggtgcgttacaacgatggctaagaataaacccaccctggacatcgagctccagaagacagaagccacccaactggctacacttcgcaaactgtgtattgagggaaagatcaccaacgtgacgacagattccagatgccctacccagggcgaagccattctcccggaggaacaggaccagaattatgtgtgtaaacacacctacgtcgatcggggctgggggaacggatgcggcctgtttgggaagggaagccttgtgacatgcgcgaagttccaatgtctggagtctatcgagggcaaagccgttcagcacgaaaatctcaagtataccgtgattatcacagtccatacgggggaccagcaccaggtgggaaacgagatgcaaggcgttaccgctgaaatcacaccccaggcctccaccgtggaggctattctgcctgaatacggcacactggggctcgagtgcagcccccgcaccggactggactttaatgagatgatccttctgacgatgaaaaacaaggcctggatggtccatagacagtggttctttgatctccctctgccctggacctctggcgccacaaccgaaacaccgacctggaataaaaaggagcttctggtgacgttcaaaaacgctcacgcgaagaagcaagaagtcgtggttctcgggtcccaggagggagccatgcacacagctctgaccggcgccacagaaattcagaccagcgggggcacctctatctttgccggacatctgaaatgtcggctcaagatggacaaactggagcttaagggcatgtcctatgctatgtgcctgaatgccttcgtgctcaaaaaggaggtcagcgaaacacagcacgggacgattctgatcaaggtggagtacaaaggagaagatgcgccttgtaagatccccttctccaccgaggacggccaagggaaagctcataacggacgcctgattacagccaaccctatcgttaccaagaaagaggaacccgtgaatattgaggccgaacccccttttggcgagtctaacatcgtcattgggatcggcgataaggctcttaagatcaattggtacaaaaagggaagctccattggcaaaatgttcgaagccacagctagaggggcccggagaatggcgatcctcggagacaccgcctgggattttggcagcgtcgggggagtgctgaactctctgggcaagatggttcaccagattttcgggtccgcttatacggccctctttagcggcgtctcttggatcatgaaaattggaatcggcgtgctgcttacatggattgggctgaatagcaagaacgcttccatgtctttcagctgcatcgtgatcggaattatcaccctctacctgggcgccgtcgtgcaggcggacatggggtgtgttattaattggaagggaaaagagctgaagtgcggctccgggatctttgtgaccaacgaggtccatacatggaccgaacagtataaattccaagccgatagcccgaagcgccttgctacagccattgctggcgcctgggagaatggagtgtgtggcatccggtctacgaccagaatggaaaacctcctgtggaaacagatcgccaatgagctgaactacattctctgggaaaataacatcaagctgacaattgttgtgggggacgtcatcggagtgcttgagcagggcaaacgcaccctgacaccccagcctatggagctcaagtattcctggaagacctgggggaaagctaagattgttacggcggaaacccaaaatagctcttttatcatcgatggacccaacacacctgagtgcccctccgccctgcgggcttggaacgtgtgggaagtcgaggactacggcttcggcgtgtttaccacaaatatttggctgaaacttagagaaaagtatacccagctctgtgaccaccgcctgatgagcgccgccgtgaaagatgagcgggctgtccacgccgacatggggtactggatcgagtcccagaagaacggatcttggaagctggaaaaagcgagcctcattgaggttaagacatgcacctggccgaaatcccatacgctgtggtctaatggcgtgcttgaaagcgatatgatcattcctaagtccctggctgggcccatcagccagcacaactacagacctggatatcatacacaaaccgccggcccctggcacctcgggaaactggagctggacttcaattactgcgagggaaccacagtggtcatcaccgaaaactgtggcattcgcggcccttctcttcggacgacaaccgtgtccgggaagctcatccacgagtggtgctgtagaagctgcacactgcccccgctgcgctatatgggagaagatggctgttggtacgggatggagattcggcctatcaatgaaaaggaggagaacatggttaaatctctcgtgtccgccggaagcggcaagaccgacaattttacaatgggggtcctgtgccttgctattctgttcgaagaggtgatgagaggaaaattcggcaagaaacatatgatcgccggcgcgctctttaccttcgttctgctgctttctgggcagattacgtggcgggatatggctcacaccctgatcatgatcggaagcaacgcctccgaccgcatgggcatgggggtgacatatctcgccctgattgctacctttaagatccagcccttcctcgccctgggatttttccttagaaagctgacaagccgggaaaatctcctgctgggcgtcgggcttgctatggccaccacgctgcaactccccgaggatattgaacagatggcgaacggaatcgccctgggcctcatggctctgaaacttattacacagtttgagacctaccagctgtggacagccctcatctctctgatgtgttccaataccatcttcaccctgacagtggcttggagaacggccacccttattctggccgttatcagcctcctgcctgtgtgccaatcctctagcatgcgcaagacagactggctcccgatgaccgtcgctgcgatgggcgtgccccctctgcccctttttattttctccctgaaagatacactgaagcggagatcttggcctctcaacgagggggtgatggccgtcggactggttagcatccttgcttcctcttttctgcgcaatgacgtgcccatggccggccctctcgtggccgggggactgctcattgcttgttatgtcatcaccggcacgagcgccgatctgacagtggaaaaagcggctgacgttacctgggaggaagaggccgaacagaccggggtgtcccataaccttatgatcacagtcgacgatgacggaaccatgagaattaaggatgacgagacagagaacatcctgacggtgctgctcaaaaccgccctgcttattgttagcggcatcttcccctactctattccggctacactgctcgtgtggcacacctggcagaagcagacacaacggtccggcgtcctgtgggatgtgccttctccccctgaaacccagaaggccgagctcgaagagggggtctaccgcatcaaacagcagggaatttttggcaagacgcaagtgggggttggagtgcagaaagagggcgtcttccataccatgtggcacgtgacaagaggggcggttctgacccacaatggaaagcggcttgaacccaactgggctaatgtgaaaaaggacctgatctcctatggcggcgggtggaagctgtccgcccagtggcaaaaaggagaggaagtccaggtgatcgccgtggagccgggcaagaaccctaaaaatttccagacaatgcccgggatttttcagaccacaacgggagaaatcggcgctattgccctcgatttcaagcctgggaccagcggatctcccatcattaaccgcgagggcaaagttgtcggcctgtacgggaatggagtggtgacaaagaacggcgggtatgtctccggaatcgctcaaaccaatgccgagcccgacggccctaccccggaacttgaggaagagatgtttaagaaaagaaacctgacaatcatggatctccatcccgggagcggcaagacgcggaaatacctgcctgcgattgtgcgcgaagccatcaagagacggctccgcaccctgattcttgctcccacaagagttgtggccgctgagatggaggaagccctgaaaggactgcctatccggtatcagaccacagccaccaagtccgagcacacgggcagagaaattgtcgacctcatgtgccatgctacattcaccatgcgcctgcttagccccgtgcgggttcctaattacaacctgatcgtgatggatgaggcgcactttaccgacccggcctctatcgctgccagagggtatattagcacacgcgtcggaatgggcgaagccgctgccatcttcatgaccgcgacaccccctgggaccgctgatgcctttccccagtccaatgcccctattcaggacgaggagcgggacatccccgaaagatcttggaacagcggaaatgagtggattacggatttcgctggcaagacagtgtggtttgttccgtccatcaaagccgggaacgacattgcgaactgtctccgcaagaatggcaaaaaggtgatccaactgtctcggaaaaccttcgatacagaataccagaagaccaagctgaacgactgggattttgtcgtgacgaccgacatcagcgagatgggagccaatttcaaagctgatagagtgattgaccctcgccggtgcctcaagcccgtcatccttacagatggccccgagagagttattctggccgggcctatgcccgtgaccgtggcttccgccgctcagcggcgcggaagagtcggccggaactctcagaaagaaaatgaccaatacatcttcacagggcagcctctgaacaatgatgaggaccatgcccactggaccgaagcgaagatgctcctggacaacattaatacaccggagggaatcatccccgccctttttgaacctgagcgcgagaaaagcgctgccattgatggcgaatatagactgaagggggagtcccggaaaaccttcgtggaactcatgagacgcggcgacctgcccgtttggctggctcacaaggtggccagcgagggaatcaagtacacggatcggaaatggtgctttgacggcgaaagaaacaatcagattctcgaggagaacatggatgtcgaaatctggacaaaggagggggagaagaagaaacttcgccctcggtggctggacgccagaacctattctgatcccctggctctcaaggagttcaaggactttgcggccggacgcaaatccattgctctggatcttgtgaccgaaatcggccgggttccgagccatctggcccacagaacacgcaatgccctcgacaacctggtgatgctgcatacctctgagcacgggggccgggcttaccggcacgccgtcgaggaactccctgagacaatggaaacgcttctgctgctcggcctgatgatccttctgaccggcggggcgatgctgttcctgatttccggaaagggcatcgggaaaacaagcattggactgatctgtgtggtcgcctcctctggcatgctctggatggctgatgtgccccttcagtggattgccagcgctatcgttctggagtttttcatgatggtgctgctcattcctgagcccgaaaagcaacgcacccctcaggacaatcagctggcctatgtggtcatcgggatccttacactggcggccattgttgctgccaacgagatgggactcctggaaaccacgaaaagagatctgggcatgtccaaggagcccggcgtggtgagcccgacctcttacctcgacgtcgaccttcatcctgcttccgcctggacactgtatgctgtggccaccacagttatcacccccatgctgcggcacacgattgaaaatagcacagcgaacgtgtctctcgccgctatcgccaaccaagctgtcgtgctgatggggcttgataagggatggcccattagcaaaatggacctgggcgtccctctcctggccctggggtgctactcccaggtgaatccgctcacccttacagccgcggttctgctgctcgtgacccattacgctatcatcggacccggcctgcaggccaaggctacccgcgaggcccagaaaagaacagccgctgggattatgaagaaccctacggtcgatggaatcatgaccattgaccttgatcccgtgatctatgactctaaatttgagaagcaactgggccaggttatgctcctggtgctgtgtgccgtccagctccttctgatgcggacaagctgggcgttctgcgaagccctgaccctcgctacaggccctattaccacgctgtgggaggggtcccccggaaagttttggaatacaaccatcgccgtgtctatggctaacatcttcagaggcagctaccttgccggggcgggactggccttttccattatgaaaagcgtgggcaccgggaagcgcggaacaggctctcagggcgaaaccctcggggagaaatggaagaaaaagctgaatcaactgtcccggaaagagttcgatctctataaaaagagcggaatcacagaggttgacagaacggaggctaaagaaggccttaagcgcggggagattacccaccatgccgtctcccggggatctgctaaactgcagtggttcgtggaaagaaacatggtgatccctgagggccgggtcattgatctggggtgtggacgcggcggctggagctactattgcgccgggctcaagaaagttacagaagtgagaggatacaccaagggcgggccgggacacgaggagcccgtgcctatgtccacatatggctggaatatcgtcaagctgatgtctgggaaagacgtgttttaccttccccctgaaaagtgtgataccctgctctgcgacattggagagagctcccccagcccgacggttgaagagtctcggaccatccgcgtgctgaaaatggtcgagccttggctgaagaacaatcagttctgtatcaaagtgctcaacccctacatgcccacagttattgaacaccttgagagactgcagcggaagcatggcggcatgctggtgcgcaatcctctctccagaaacagcacccacgaaatgtattggatctctaatgggacaggaaacattgtctccagcgtgaatatggtgtctcggctgcttctgaaccgctttaccatgacacatagacggcccaccatcgagaaggatgtcgacctcggcgctgggacgagacacgttaacgccgaacctgagacaccgaatatggacgtgattggagagcgcatccggagaatcaaagaagaacacagctccacctggcattacgatgacgaaaacccctataagacctgggcgtaccacggctcttatgaggtgaaagccacagggagcgcttccagcatgattaatggagtcgtgaagctgctgacgaaaccttgggatgttgtgcccatggtcacccaaatggccatgacagacaccacacctttcggccagcagcgcgtgtttaaggaaaaggttgatacccggacacccagaccgatgcctggcacccgcaaagtgatggagatcacggctgagtggctctggcggaccctggggagaaacaagcgcccccggctttgcacaagagaagagttcattaaaaaggtccgcaccaatgccgccatgggagcggtgtttacagaagagaaccaatgggactccgctcgggccgccgttgaagatgaggagttctggaaactggtggacagagaacgcgagctccataagctgggcaaatgtgggtcttgcgtctacaatatgatgggaaagagagaaaagaaacttggcgagtttgggaaggctaaaggcagccgggccatctggtatatgtggctgggagctcgctacctcgagttcgaagccctgggctttctgaacgaggatcactggttctccagagaaaattctcatagcggggtggagggagaaggcctccacaagctggggtacattcttcgggacatctccaaaatccctggaggcgcgatgtatgccgatgacaccgctgggtgggacacgagaattacagaggatgacctgcacaacgaggaaaagatcacccagcagatggatcccgagcatcggcagctcgccaatgctatttttaagctgacataccaaaacaaagtcgtgaaggttcagcgccctacccccaaaggcacggtgatggacatcatttctagaaaggatcagcggggaagcggccaggtcgggacctatggacttaatacattcaccaacatggaagcccaactgatccgccagatggagggcgaaggggtgctctccaaagcggacctggagaatccgcacctcctcgagaagaaggtgacacagtggctggaaaccaaaggagttgagagacttaagcggatggccatcagcggcgatgactgcgtggtcaaacctattgatgaccgcttcgctaacgccctgctcgctctgaacgatatggggaaggtgagaaaagacatcccccagtggcaaccctctaagggctggcatgattggcagcaggttcctttttgttcccaccacttccatgaacttattatgaaggacggacggaaactggtggtcccgtgccgcccccaggacgagctcatcggcagagcccggattagccaaggggctggatggtctctgcgcgaaacagcctgtctgggcaaggcgtacgcccagatgtgggctctcatgtattttcacagacgggatctgcgccttgcctccaatgccatctgcagcgctgtgcctgtccattgggtgcccacctctagaacgacatggtccattcacgcccatcaccagtggatgaccaccgaggacatgctgacagtttggaaccgggtgtggatcgaggataatccttggatggaagacaaaacccccgtcacaacgtgggaggatgtgccttacctcgggaagagagaagaccaatggtgtggaagcctgatcggccttacctcccgcgcgacatgggctcagaacattctgaccgccatccagcaggttcggagcctcattgggaatgaggagttcctggattatatgccctctatgaaaagatttcgcaaggaagaggaaagcgagggcgccatctggtga

SEQ ID NO: 20951 - RNA, 9873 nt, synthetic construct
  misc_feature 1..9873: note = derived and/or modified CDS sequence (opt5) from DENV-3__AY876494__SS-prME
  source 1..9873: mol_type = other RNA
acctccctgtgcctcatgatgatgctgcccgccacccttgctttccacctgacgtccagagacggagaacctcggatgatcgtggccaaaaacgaacgcgggaaatctctcctgtttaagaccgcgagcggaattaatatgtgtacccttatcgctatggatctgggcgagatgtgcgacgataccgtcacctacaaatgtccgctcattgccgaagttgagcccgaagacatcgattgctggtgtaacctgacctccacatgggtgacctatgggacgtgcaatcaggccggagagcacagacgggacaagcgctctgtggctctggcccctcacgtcggcatggggctcgataccagaacacaaacctggatgagcgctgagggagcctggcggcccgtggaaaaagttgagacatgggcgctgcgccatcctggcttcaccattcttgccctgtttctcgctcactacatcggcacgtccctgacacagaaggtggtcatcttcattcttctgatgctcgtgaccccctctatgacaatgagatgtgttggggtgggaaaccgggactttgtcgaaggcctgagcggggccacctgggtggatgtggtcctggagcatggaggctgcgttaccacaatggctaagaataaacctacgctcgacatcgagctgcagaagaccgaagccacacagcttgcgaccctgcgcaaactctgtattgaggggaagatcacaaacgtgaccacggattccagatgcccgacacaaggagaagccattctgcccgaggaacaggaccagaattatgtgtgtaaacacacctacgtcgatcggggctggggcaacgggtgcggacttttcggcaaggggagcctggtgacctgcgctaagtttcagtgtctcgagcctatcgagggaaaagttgtgcaacacgaaaatctgaagtatacagtcattatcaccgtgcatacaggcgaccagcaccaggttgggaacgacacgcagggagtgaccgtcgagatcacaccccaagcctctaccgctgaagccattctgcctgagtacggcacactcgtgctggaatgcagcccccgcaccggccttgatttcaatgagatgatcctgctcacgatgaaaaacaaggcctggatggtccatagacagtggtttttcgacctgccgcttccttggaccagcggggctacaaccgagacacccacctggaatcggaaagaactgctcgtgacgtttaagaacgcgcacgccaaaaagcaggaggttgtggtcctgggatctcaagaaggcgctatgcacacagccctgaccggggccacagagattcaaaattccggaggcaccagcatcttcgctgggcatctcaagtgtcgcctgaaaatggataaacttgaactgaaaggcatgtcttatgccatgtgcctcaacacctttgtgctgaagaaagaggtttccgagacacagcacggaacgattctgatcaaggtggaatacaagggcgaggacgcgccttgtaaaatccccttcagcaccgaagatgggcagggaaaggctcataacggcagacttattacagccaatcccgtcgtgaccaaaaaggaggagcctgtgaacatcgaagccgagccgcccttcggggaatccaatattgttatcggaattggcgacaaagctctcaagatcaactggtacaagaaagggtctagcatcggcaagatgtttgaggccacagctcggggagccagacgcatggcgattctgggcgataccgcctgggacttcgggtccgtcggaggcgtgctgaatagcctcgggaaaatggtgcaccaaatctttggatctgcttatacggccctgttctccggcgtcagctggattatgaagatcgggattggcgtgcttctgacatggatcggactcaactctaaaaataccagcatgtccttttcttgcattgttatcggcatcattaccctgtacctgggggctgtggtccaggccgatatgggatgtgtgatcaactggaagggcaaggaacttaaatgcgggagcggaattttcgttacaaatgaggtgcatacctggacagagcagtataagtttcaggcggactcccctaaacggctcgccacggctatcgccggcgcttgggaaaacggggtctgtggcattagaagcaccacacgcatggagaatctgctgtggaagcaaatcgccaacgaactcaattacatcctgtgggagaacaatattaaacttaccgtggttgtgggagatatcattggcgtcctggaacaggggaagcggacactcacaccccagcctatggagctgaaatattcttggaagacgtggggaaaggccaaaatcgtgaccgctgagacacagaactccagcttcattatcgacggccccaacaccccggaatgcccttctgcgtccagagcctggaatgtgtgggaggtcgaagactacgggtttggagttttcacaaccaacatctggctgaaacttcgcgaggtgtatacacaaagctgtgatcaccggctcatgtccgctgccattaaagacgaaagagccgtgcacgctgatatgggctactggatcgagtctcagaagaatggcagctggaaactggagaaggcctcctttattgaagtcaagacctgcacgtggcccaaatctcatacactgtggagcaacggggtgctcgagtccgacatgatcattcctaagagcctggcgggacccatctctcagcacaatcatcgccctggctactatacccagaccgctgggccctggcaccttggaaaactggaactcgatttcaactactgcgagggcacaaccgttgtgatcacggagaattgtgggacacggggaccgtccctgagaaccacaaccgtcagcggcaagctgattcacgaatggtgctgtcgctcttgcacacttcctcccctccggtatatgggcgaggacgggtgttggtacggaatggaaatcagacccattaacgagaaagaagagaatatggtgaagtccctggttagcgccggctctgggaaggtggataactttaccatgggagtcctgtgcctcgccatcctgttcgaggaagtgatgcggggcaaattcgggaagaaacatatgattgctggagttctttttacgttcgtgctgctcctgagcggccaaatcacctggcgcgacatggcccacacactgattatgatcggctccaatgcgagcgatagaaccgggatgggagtcacatatcttgctctgatcgccacctttaagattcagcctttcctcgccctgggctttttcctccggaaactgacgtctagagagaaccttctgctcggggtgggactggctatggccacaaccctgcagcttccggaagacatcgagcaaatggctaatggcattgccctggggctcatgacactgaagctcatcacccagtttgaaacctaccagctgtggacagcgcttgtgtccctgacgtgtagcaacaccattttcacactcaccgtcgcctggcgcacagctaccctgatcctggccggagtttcccttctgcccctctgccagtctagctccatgcggaagacggattggctgcctatgacagtggctgccatgggcgtgccccctctccccctgtttatcttctctcttaaagacacccctaagagacgcagctggcccctgaatgagggcgtcatggccgtggggctggtttccattctcgcttctagcctgcttagaaacgatgtgccgatggcgggacctctggtcgccggcgggctcctgatcgcttgttatgtgattaccggaacatccgccgacctcaccgttgagaaagccgctgacgtgacatgggaagaggaagccgagcaaacgggcgtcagccataacctgatgatcaccgtggatgacgatgggacaatgcggattaaggacgatgaaaccgagaatatccccacagtccttctgaaaaccgcgctgctcatcgtgtctggaatttttccttactccatccccgctacgctgcttgtttggcacacctggcagaagcagacacagcgcagcggcgtgctgtgggacgtcccgtctcctcccgagacccaaaaagccgaactcgaggaaggcgtgtacagaattaagcagcaggggatcttcggaaagacacaggttggcgtgggggtccaaaaagagggagtgtttcataccatgtggcacgtgacacggggcgccgttctgacgcacaacgggaagcgcctcgagcctaattgggcttccgtcaaaaaggatctgattagctatggaggcggctggagactttctgcccagtggcagaaaggggaagaggtgcaagtgatcgcggtcgaacccggaaagaaccccaagaatttccagaccatgcctggcattttccagacaaccaccggggagatcggagctatcgccctggactttaaaccgggcacatccgggagccccattatcaaccgggaaggaaaggtggttggcctgtacggcaatggggtggtcacgaaaaacggaggctatgtgtccgggattgcccagaccaatgctgagcctgatggacccacacctgagctcgaagaggaaatgttcaagaaacgcaacctgaccatcatggaccttcatcccggcagcgggaagacaagaaagtacctgcctgccattgttcgggaggctatcaaacgcagactccggaccctgatcctcgccccgacgagagtggtcgcggccgaaatggaggaggctctgaagggccttcccattcgctatcaaacaaccgccaccaaatctgaacacacaggacgggagatcgtggatctgatgtgccatgctacctttacaatgagactgctcagccctgttcgcgtgcccaattacaacctgattatcatggacgaagcccacttcaccgatcctgcctccattgctgcgcggggctatatctctacgagagtcgggatgggagaggccgctgccatctttatgacagccacacccccgggcacagctgaagccttccctcagagcaatgcgcccattcaggacgaggagcgcgacatccccgaacggtcctggaactctgggaatgagtggattaccgattttgtgggaaagacggtgtggttcgtccctagcatcaaagctggcaacgacattgccaactgtcttagaaagaatgggaagaaagttatccagctgtcccgcaagacctttgatacagaataccagaagacccggctcaacgactgggatttcgtggtgacaaccgacatttctgagatgggcgccaattttaaggctgatagagtcatcgacccccggcgctgcctgaaacctgtgatcctgacagatggaccggagagagttattctcgccggccccatgcctgtgaccgcggccagcgctgcccagcggcgcgggagagtcggacggaacccccagaaggaaaatgaccagtacatcttcacgggccaacctcttaacaatgatgaggaccatgctcactggacagaagccaagatgctgctggacaacattaatacccccgaggggatcattccggctctcttcgaacctgagagagagaaatccgccgcgatcgatggagaatatcgcctgaagggcgagagccggaaaacctttgtggaacttatgagacgcggggacctgcccgtttggctcgcccacaaggtggcttctgagggcatcaaatacacagatcggaagtggtgcttcgacggagaaagaaacaatcagattctggaggagaacatggatgtcgaaatctggaccaaagagggcgaacgcaagaagctgcggcctagatggctcgacgcccgcacatattccgatccccttgctctgaaagagtttaaggacttcgccgccgggagaaaaagcattgctctggatctcgtgacggaaatcggacgggtcccttctcatctggcgcaccgcaccagaaatgcccttgacaacctggtgatgctccatacatccgagcacggcgggcgggcttaccgccacgccgttgaggaactgcccgagaccatggaaacactgctccttctgggactgatgattctcctgaccggcggcgccatgctttttctgatcagcgggaagggaatcggcaaaacgtccattgggctcatctgtgtgattgtgtctagcggaatgctgtggatggctgatgtcccgctgcagtggatcgcctccgcgattgttctcgagttctttatgatggtgcttctgatccctgagcccgaaaagcagagaacaccccaagacaatcagctggcctatgtggtcattggcatcctcacactggctgccatcgtggctgccaacgagatggggcttctggaaaccacaaagcgggatctcggaatgagcaaagagcctggcgttgtgtctccgacctcctacctggacgtcgacctgcatcccgcgagcgcctggacgctctatgctgtggccacaaccgtcattacacctatgcttagacacaccatcgaaaattctaccgctaacgtgagcctggccgctattgccaaccaggcggttgtgctgatgggcctcgataaggggtggcccatctccaaaatggacctgggagtccctcttctggccctcggctgctactctcaagtgaatcccctgacactgacggctgccgttctccttctggtgacccattacgctattatcgggcctggactgcaggccaaggccacacgcgaggcgcagaaacggaccgctgccggcatcatgaagaacccgacagtcgatgggattatgaccatcgacctcgatcccgtgatttatgacagcaagttcgagaaacagctgggacaagtgatgcttctggttctctgtgctgtccagctgctgctcatgagaacgtcctgggccctttgcgaagccctgacactggctaccggccctatcaccacactctgggagggctctcccgggaagttttggaataccacaattgccgtgagcatggcgaacatcttccgcggatcctacctggccggcgctgggcttgcctttagcatcatgaaatctgtgggaacgggcaagcgggggaccggatcccagggcgaaacactgggcgagaaatggaagaagaaactcaatcagctgagcagaaaggagttcgatctgtataaaaagtccgggattaccgaggtcgaccggacagaggctaaagaaggactcaagcgcggcgagaccacgcaccatgccgtttctagagggagcgcgaaacttcaatggtttgtggaacggaacatggtgatccctgagggacgcgtcattgatctgggctgtgggagaggaggctggtcctactattgcgccggcctgaagaaggtgaccgaagttcgggggtacacaaaaggaggccccgggcacgaggagccggtgcctatgtctacctatggatggaatatcgtcaagctcatgagcggcaaagacgtgttctacctgcctcccgaaaagtgtgatacacttctgtgcgacattggggagtccagcccctctcccaccgttgaagagtcccgcacaatcagagtgctcaaaatggtcgagccttggctgaagaacaatcagttctgtattaaggtgctgaacccgtacatgcccaccgtgatcgaacacctcgagcggcttcagcgcaaatatggaggcatgctggtcagaaatcctctgagccggaactctacgcatgaaatgtactggatctccaatggcacagggaacattgttagctctgtgaatatggtgagcagactcctgcttaaccgctttaccatgacccaccggagacccacaatcgagaaggatgtcgacctgggagctggcacgcgccatgtgaacgccgaacctgagacccccaatatggacgttattggggagcggatcaaaagaattaaggaagaacactcctctacatggcactatgatgacgaaaacccgtacaaaacctgggcttatcatggaagctacgaggtgaaggccacaggctccgctagctccatgatcaatggggtcgtgaagctcctgaccaaaccttgggatgttgtgcccatggtcacacagatggccatgaccgacacgacccctttcggacaacagcgcgtgtttaaggaaaaagttgatacacggacccccagacctatgcccggcacacgcaaggtgatggagatcaccgcggagtggctgtggcggacgctcggcagaaacaaacgcccgcggctgtgcacaagagaagagttcaccaagaaggtccgcacaaatgccgctatgggggccgtgtttaccgaagagaaccagtgggactctgctagagccgccgtcgaagatgaggagttctggaatctttgggaccgggaacgcgagctgcacaaactcggaaagtgtggcagctgcgtgtataacatgatggggaaaagagaaaagaaactgggagagtttggcaaggcgaaagggtcccgggctatttggtacatgtggcttggcgccagatacctggagttcgaagccctcggatttctgaatgaggatcattggttctctcgggaaaacagctattccggcgttgagggggaaggactgcacaagctcggctacatcctgcgcgacatttctaagatccctgggggagctatgtatgccgatgacacggctggctgggacaccagaattacagaggatgaccttcataatgaggagaagatcacccaacagatggatcccgagcaccggcagctggccaacgcgatctttaagctcacataccagaataaagtggtcaaggtgcaacgccccacccctaaagggacagtgatggacattatcagcagaaaggatcagcggggctccggacaggttggcacctatgggctgaacacgttcacaaatatggaagcccagcttgtgcgccaaatggagggagaaggcgtcctgagcaaggctgacctcgagaacccgcatctgctggagaaaaagattaccccctggctcgaacctaaaggggtggagagactgaagcggatggccatctctggagatgactgcgttgtgaaacccattgatgaccgctttgctaacgcccttctggcgctcaatgatatgggcaaggtcagaaaggacatccctcagtggcagccctccaaagggtggcatgattggcagcaagtgcctttctgtagccaccatttccacgaactgatcatgaaggacggccggaaacttgtcgtgccctgccgcccgcaggacgagctgattggcagagcccggatctctcagggcgctgggtggtccctcaaggaaaccgcctgtctgggaaaggcttacgcccagatgtggagcctgatgtattttcaccgcagagatctccggctggcttctaacgccatttgctccgcggttcctgtgcattgggtccccacaagcagaaccacatggtccatccacgcccatcaccaatggatgacgaccgaggacatgcttacagtgtggaatcgcgtttggattgaggataacccttggatggaagacaagacccccgtgacaacctgggaggatgtcccgtacctgggcaagcgggaagaccagtggtgtgggagcctcatcggactgacgtctagaagcacctgggctcagaatattcttacagccatccaacaggtgcgctccctgatcggcgatgaggagttcctcgactacatgccttctatgaaacggtttagaaaggaagaggaaagcgagggggccatttggtga

SEQ ID NO: 20952 - RNA, 9873 nt, synthetic construct
  misc_feature 1..9873: note = derived and/or modified CDS sequence (opt5) from DENV-3__AY923865__SS-prME
  source 1..9873: mol_type = other RNA
accagcctgtgcctgatgatgatgctgcccgccacacttgctttccacctgacgtcccgggacggcgagcctcggatgatcgtggggaagaatgaacgcggaaaatctctcctgtttaagaccgccagcggcattaatatgtgtacccttatcgcgatggatctgggggagatgtgcgacgataccgtgacatacaaatgtccgctcattgctgaagttgagcccgaagacatcgattgctggtgtaacctgacctccacatgggtgacctatggaacgtgcaatcaggccggcgagcacagacgggacaagcgctctgtggccctggctcctcacgtcgggatgggactcgataccagaacacagacctggatgagcgccgagggcgcttggcggcaggtcgaaaaagttgagacatgggccctgcgccatcccggcttcaccattcttgcgctgtttctcgcccactacatcgggacgtccctgacacagaaggtggtcatcttcattcttctgatgctcgtgaccccttctatgacaatgagatgtgttggagtgggcaaccgggactttgtcgaagggctgagcggagctacctgggtggatgtggtcctggagcatggcgggtgcgttaccacaatggccaagaataaacccacgctcgacatcgagctgcagaagaccgaagctacacagcttgccaccctgcgcaaactctgtattgagggaaagatcacaaacattaccacgggctccagatgccctacacagggcgaagcgatcctgccggaggaacaggatcagaattatgtgtgtaaacacacctacgtggaccgggggtggggaaacggctgcgggcttttcggaaagggcagcctggtgacctgcgccaagtttcaatgtctcgagcccattgaggggaaagtggttcagtatgaaaatctgaagtacacagtgatcatcaccgtccacacaggagatcagcctcaggtgggcaacgacacgcaaggcgttaccgtggagattacaccccaggcttctaccgtcgaagccgtgctgctcgagtatgggacactgggacttaaatgctcccctcgcaccggcctggacttcaatgaaatgatcctcctgacgatgaagaccaaggcttggatggtccatagacagtggtttttcgatcttcccctgccgtggacaagcggggccaccacagagacccctacgtggaaccggaaggagctcctggtgacatttaaaaatgcccacgctaagaagcaagaagttgtggtcctgggatctcaggagggcgcgatgcataccgccctcacaggggctaccgaaattcagaactccggcggaaccagcatcttcgccggccacctgaaatgtcgccttaagatggacaaactggagctcaaggggatgtcttacgccatgtgcctgaatacatttgtgctgaaaaaggaagtttccgagacgcagcacggaaccattcttatcaaggtggagtacaaaggcgaagatgctccctgtaagatccctttcagcacagaggacgggcaaggaaaagcccataacggcagactcattaccgcgaaccccgtcgtgacaaagaaagaagaacccgtgaatatcgaggctgaacctccgttcggggagtccaacattgttatcggcattggagataaggccctgaagatcaattggtataaaaagggctctagcatcgggaaaatgtttgaagccaccgctcggggagccagacgcatggctattctgggcgacacggcctgggatttcgggtccgtcggaggcgtgctcaacagcctggggaagatggtgcaccagatctttggctctgcgtacacagcccttttctccggagtcagctggattatgaaaatcggcattggggtgctgctcacctggatcggactcaattctaagaacaccagcatgtccttttcttgcattgttatcggcatcattacactgtatcttggggctgtggtccaggccgacatgggatgtgtgatcaattggaagggcaaagagctcaagtgcgggagcggcattttcgttaccaacgaagtgcatacatggacggagcagtacaaatttcaagctgattcccccaagcggctggccaccgcgatcgccggagcttgggagaatggcgtctgtgggattagaagcacaacccgcatggaaaacctgctctggaaacagatcgccaatgagctgaactatatcctttgggaaaataacattaagctgacagtggttgtgggagacatcattggcgtcctcgagcaggggaaacggaccctgacgcctcagcccatggaactgaagtactcttggaagacctggggaaaagctaagatcgtgacagccgagacccaaaattccagcttcattatcgatggccctaacacacccgagtgcccgtctgcctccagagcttggaacgtgtgggaagtcgaggactatggctttggggttttcaccacaaatatctggcttaaactccgcgaagtgtacacccagagctgtgaccaccggctgatgtccgcggccattaaggatgagagagctgtgcatgccgacatgggatactggatcgaatctcagaaaaacggcagctggaagctggagaaggcctcctttattgaggtcaaaacgtgcacatggcctaagtctcacaccctctggagcaatggggtgctggaatccgatatgatcattcccaaaagccttgctggacctatctctcagcacaaccatcgccccggctatcacacccaaacagccgggccttggcatctgggaaagctcgagctggacttcaattactgcgaaggcaccacggttgtgatcacagagaactgtggcacccgggggccctccctgagaacaaccacagtcagcggaaaacttattcacgagtggtgctgtcgctcttgcaccctcccgcctctgcggtatatgggcgaagatgggtgttggtacggaatggagatcagacccattaatgaaaaggaggaaaacatggtgaagtccctggttagcgcgggctctgggaaagtggacaattttacgatgggagtcctctgcctggctatccttttcgaggaggtgatgcggggcaagttcggcaaaaagcacatgattgccggggttctgtttaccttcgtgctcctgctgagcggacagatcacatggcgcgatatggcccatacccttattatgatcggctccaacgctagcgacagaatggggatgggagtcacatatctggccctcatcgcgacctttaaaattcagcccttcctggctctcggctttttcctgcggaaacttacgtctagagaaaatctgctcctgggggtgggactggccatggccacaacccttcaactgcctgaggatatcgaacagatggctaacggcattgccctcggcctgatgacactcaagctgatcacccagtttgagacctaccagctttggacagctctggtgtccctcacgtgtagcaataccattttcacactgaccgtcgcctggcgcacagcgaccctgatccttgccggggtttccctgctcccgctgtgccaatctagctccatgcggaaaacggactggctccccatgacagtggctgccatgggagtgcctcccctgcctctttttatcttctctctgaaggatacccccaaaagacgcagctggcctctgaacgaaggcgtcatggctgtggggctcgtttccattctggcctctagccttctgagaaatgacgtgcccatggccggaccgctcgtcgctggcgggctgctcatcgcgtgttatgtgattaccggaacatccgccgatctgaccgttgagaaggctgccgacgtgacatgggaggaagaggccgaacagacgggcgtcagccacaaccttatgatcaccgtggacgatgacggcacaatgcggattaaagatgacgagaccgaaaacatcctgacagtcctgctcaagaccgctctgcttatcgtgtctgggatttttccttactccatccccgccacgctgctcgtttggcatacctggcagaaacagacacaacgcagcggagtgctgtgggatgtcccttctcccccggagacccagaaggcggagctcgaagagggcgtgtacagaattaagcagcaggggatcttcggaaaaacacaagttggcgtgggggtccagaaggaaggagtgtttcacaccatgtggcatgtgacacggggcgctgttctgacgcacaatggcaaacgccttgagcctaactgggcctccgtcaagaaagacctgattagctatgggggaggctggagactgtctgcccagtggcaaaagggggaggaagtccaggtgatcgctgtcgagcccggaaagaatcctaaaaacttccagaccatgcccggcattttccagacaaccaccggggaaatcggagccatcgcgctcgattttaagcccggcacatccggcagccctattatcaatcgggaggggaaagtggttggactgtacggcaacggggtggtcacgaagaatggaggctatgtgtccgggattgctcaaaccaacgccgaaccggacggccccacacctgagcttgaggaagagatgttcaaaaagcgcaatctgaccatcatggatctccaccccggaagcggcaagacaagaaaatacctgcctgccattgttcgggaagctatcaagcgcagactccggaccctgatccttgcccccacgagagtggtcgctgccgagatggaagaggcgctgaaagggctgcctattcgctatcagacaaccgccaccaagtctgagcatacaggacgggaaatcgtggacctcatgtgccacgctacctttacaatgagactgcttagcccggttcgcgtgcccaactacaatctgattatcatggatgaggcccatttcaccgaccctgcttccattgccgcccggggctatatctctacgagagtcgggatgggagaagctgcggccatctttatgacagctacaccccctggcacagccgaggccttcccccagagcaacgctccgattcaggatgaagaacgcgacatccctgagcggtcctggaactctgggaacgaatggattaccgactttgtgggcaaaacggtgtggttcgtccccagcatcaaggccggaaatgatattgcgaactgtctcagaaagaacggcaaaaaggttatccaactgtcccgcaaaacctttgacacagagtaccagaagacccggctgaatgattgggacttcctcgtgacaaccgatatttctgaaatgggggctaactttaaagccgacagagtgatcgatccccggcgctgccttaagcctgtcatcctgacagacggacccgagagagtgattctggccggccctatgccggttaccgctgccagcgcggcccagcggcgcgggagagtgggacggaatccccagaaggagaacgatcaatacatcttcacgggccagcctctcaataacgacgaagatcacgctcattggacagaggccaaaatgctgcttgacaatattaacacccccgaagggatcattcctgctctgttcgagcccgaaagagagaagtccgccgctatcgacggcgagtatcgcctcaaaggagaaagccggaagacctttgtcgagctgatgagacgcggcgatctgccggtgtggctcgcccacaaagttgcgtctgaagggatcaagtacacagaccggaaatggtgcttcgatggagagagaaataaccagattcttgaagagaatatggacgtggagatctggaccaaggaaggcgagcgcaagaaactgcggcctagatggctggatgcccgcacatattccgaccccctcgctctgaaggaatttaaagatttcgccgctgggagaaagagcattgcccttgacctggtcacggagatcggacgggtgccttctcacctcgcccatcgcaccagaaacgctctggataatctggtcatgctccacacatccgaacatggcggccgggcgtaccgccacgccgtggaggagcttcccgaaaccatggagacactgctgctcctggggcttatgattctgctcaccggaggcgctatgctgtttctgatcagcgggaaaggaatcggcaagacgtccattgggctcatctgtgttattgtgtctagcggaatgctttggatggccgacgtgcctctgcagtggatcgcctccgctattgtcctggagttctttatgatggttctcctgatccccgagccggagaagcaaagaacccctcaggataaccagcttgcctatgtggtgattggcatcctgacactcgcggccatcgtcgctgccaatgaaatgggcctgctggagaccacaaaacgggacctcgggatgagcaaggaacccggagtggtttctcccacctcctaccttgatgtggacctgcaccctgctagcgcctggacgctgtatgcggtcgccacaaccgtgattacaccgatgctcagacataccatcgagaactctaccgctaatgtcagcctggccgctattgccaaccaagctgtggttcttatgggcctggacaaagggtggcccatctccaagatggatctcggagtgcctctgctggccctcggctgctactctcaggtcaacccccttacactgacggcggccgtgctgctcctggttacccactacgctattatcgggcctggacttcaggccaaagctacacgcgaagcccagaagcggaccgccgcgggcatcatgaagaatcccacagtggacggcattatgaccatcgatctggaccctgtcatttatgatagcaaattcgagaagcaactcggacaggtgatgctgctggtgctctgtgctgttcagcttctgctgatgagaacgtcctgggccctctgcgaggctctgacacttgccaccggaccgatcaccacactgtgggaaggctctcccgggaaattttggaacaccacaattgccgtcagcatggctaatatcttccgcggatcctacctcgccggcacggggctggcgtttagcatcatgaagtctgtgggaaccggccggagaggcacagggtcccagggagagaccctgggcgaaaaatggaagaagaaactcaaccaacttagccggaaggagttcgacctgtataaaaagtccgggattacagaagtggatcgcaccgaggccaaagagggactgaagagaggcgaaacgacccatcacgctgtctctcgggggagcgccaaactccagtggtttgttgagcgcaatatggtgatccctgaaggaagagtgattgacctgggctgtggcagaggagggtggtcctactattgcgctggccttaagaaggtcacagaggtgcgcgggtacaccaaaggaggccccgggcatgaggaacctgttcccatgtctacatatggatggaacatcgtgaagctgatgagcggcaaagatgtcttctacctcccgcctgagaagtgtgacaccctgctgtgcgatattggcgaatccagcccctctcccacagtggaggaatccagaaccatccgggttctcaaaatggtggagccttggcttaagaataaccagttctgtattaaggtcctgaatccctacatgcctacggtgatcgagcacctggaacgcctccagagaaaatatgggggaatgctggtgcggaacccgcttagcagaaattctacacacgagatgtactggatctccaacggcaccgggaatattgtcagctctgttaacatggtgagccgcctgctcctgaatcggtttaccatgacacatagacgccccacgatcgaaaaggacgtggatctgggagccggcacccggcacgtcaacgcggagcctgaaacacccaacatggacgtgattggggagagaatcaaacgcattaaggaggaacattcctctacctggcactatgacgatgagaatccttacaaaacatgggcctatcacggaagctacgaagttaaggctaccggctccgccagctccatgatcaacggcgtggtcaagctcctgacaaaaccctgggacgtggttccgatggtgacccaaatggctatgacggataccacacctttcgggcagcagcgggtctttaaggagaaagtggacaccagaacaccccgccctatgcccggaacccggaaggttatggaaatcacggccgagtggctttggagaacactgggccgcaataaaaagcctcggctctgcaccagagaggagttcacaaagaaagtgcgcaccaacgctgccatgggggcggtctttacggaggaaaatcaatgggattctgccagagctgccgtggaggacgaagagttctggaagctggtcgatcgggagcgcgaacttcataaactgggaaagtgtggcagctgcgtgtataacatgatggggaaaagagagaagaaactcggcgaatttggaaaggctaagggctcccgggccatttggtacatgtggctgggggccagatacctggagttcgaggcgctcggatttctgaatgaagaccactggttctctcgggagaacagctattccggcgttgaaggggagggacttcataaactgggctacatcctccgcgatatttctaagatccccgggggcgctatgtatgccgacgataccgccggatgggacacaagaattaccgaagacgatctgcacaatgaggagaaaatcacacagcagatggacccggaacatcggcagcttgctaacgccatctttaagctgacctaccaaaataaagtggtcaaggtgcagcgccctacacccaagggcaccgtgatggatattatcagcagaaaagaccagcgggggtccggacaggttggcacgtatgggctcaacacattcaccaatatggaggctcaactggtgcgccagatggaaggagagggcgtcctgagcaaggccgatctcgaaaacccccatctgcttgagaaaaagattacccagtggctggagacaaaaggggtggaaagactcaagcggatggcgatctctggcgacgattgcgttgtgaagcctattgacgatcgctttgccaatgctctgcttgccctgaacgacatgggaaaagtcagaaaggatatcccgcagtggcaaccctccaaaggctggcacgactggcaacaggtgcctttctgtagccatcacttccatgagctcatcatgaaggatgggcggaaactggtcgtgccctgccgccctcaggacgaactgattgggagagctcggatctctcaaggcgccgggtggtccctcaaggagaccgcgtgtctgggaaaggcctacgctcagatgtggagccttatgtattttcaccgcagagacctgcggctcgcctctaacgctatttgctccgccgttcccgtgcactgggtccctacaagcagaacgacctggtccatccatgctcaccatcagtggatgacaaccgaagatatgctgacagtgtggaatcgcgtttggattgaggacaacccctggatggaggataaaaccccggtgacgacctgggaagacgtcccttaccttggcaagcgggaggatcaatggtgtgggagcctgatcggcctcacatctagagccacctgggcgcagaatattctgacagccatccaacaggtgcgcagcctgatcggagacgaagagttcctcgattacatgccctccatgaaacggtttagaaaggaggaagagtctgaaggcgctatttggtga

SEQ ID NO: 20953 - RNA, 9867 nt, synthetic construct
  misc_feature 1..9867: note = derived and/or modified CDS sequence (opt5) from DENV-4__KR922405__SS-prME
  source 1..9867: mol_type = other RNA
agcaccatcacactgctctgcctgattcccacggtgatggccttccacctttccaccagagacggcgagcctctgatgatcgtcgctaagcatgaacgggggcgcccgctcctgtttaaaacaaccgagggaattaacaagtgtacacttatcgccatggatctgggcgaaatgtgcgaggacaccgttacatacaaatgtcccctcctggtgaataccgaacctgaggatattgactgctggtgtaacctgacgtctgcgtgggtgatgtatgggacctgcacacagagcggagagagacggcgcgaaaagagatccgtcgctctcaccccccactctggcatggggctggagacacgggccgaaacctggatgagctccgagggagcctggaaacatgctcaacgcgtggagtcttggatccttagaaatcctggcttcgccctgctcgctggctttatggcctacatgatcgggcagacgggaattcagcggacagttttctttatcctgatgatgcttgtggcgcccagctatggcatgcgctgtgtcggggtgggaaacagagatttcgttgaaggcgtgtccgggggagcctgggtcgacctggtgctcgagcacggcggctgcgtgaccacaatggctcaggggaagcctaccctggattttgaactgattaagaccacagccaaagaggtcgctctcctgcggacgtactgtatcgaagccagcatttctaatatcaccacagcgacccgctgcccgacacaaggagagccctatcttaaggaggaacaggaccagcagtacatttgtagacgggatatggttgaccgcggctgggggaacggatgcggcctgttcgggaaaggaggcgtggtgacctgcgccaagttttcctgtctcggcaaaatcacggggaatctggtccaaatcgagaaccttgaatatacagtggttgtgaccgtccataatggagatacccacgctgtgggcaacgacacaagcaatcacggggttaccgccacaattacgcctagatctccctccgtggaggtcaagctgcctgattacggagaactcaccctggactgcgagccccggagcggcatcgacttcaacgagatgattctgatgaagatgaaaacaaagacctggctcgtgcataaacagtggtttctggatcttccgctgccttggacaaccggggctgacacgctcgaagtccactggaatcataaggagagaatggtgaccttcaaagttccccacgccaagcgccaggatgtgacagtcctgggctctcaggaaggagccatgcactccgctcttgcgggcgccaccgaggtggacagcggggatggaaaccatatgtttgctggccacctgaaatgtaaggttcggatggaaaagctcagaatcaaagggatgtcctacacaatgtgctctggaaagttcagcattgacaaagagatggccgagacccaacatggcacgacagtggtcaaggtgaaatatgaagggaccggcgccccttgtaaggtgcccatcgagatccgcgatgttaataaggaaaaagtcgtgggacggattatctccagcacacccttcgctgagaacaccaactctgtgaccaatattgagctggaacctccgtttggcgactcctacatcgtcattggggtgggagatagcgccctgacactccactggttcagaaagggctctagcatcgggaaaatgtttgagtccacgtatcgcggagcgaagcggatggctatcctgggcgaaaccgcctgggacttcgggtctgttggcggacttctgacaagcctcggcaaagccgtgcatcaggtctttgggtccgtgtacaccacaatgttcggaggcgttagctggatggtgagaattctgatcgggctgcttgtcctctggattggaaccaactctcgcaatacgtccatggctatgagctgcatcgccgtgggcgggattacactgtttctgggcttcaccgttcacgctgatatgggatgtgtggtctcttggtccggcaaggagctcaagtgcgggagcggaatctttgtgattgacaacgtgcacacctggacagaacagtataaattccaacccgagtcccctgcccggctggcgtctgccatccttaatgctcataaggagggcgtctgtgggatcagaagcaccacacgcctggaaaacgttatgtggaaacagattacgaatgagctcaactacgtgctgtgggaaggaggccacgacctgaccgtggtcgccggcgatgtgaagggggttctttccaaaggaaagcgggctctcgccccccctgtgaatgacctgaagtattcttggaaaacatggggcaaggcgaaaatctttacccccgagacaagaaacagcaccttcctggtcgatgggccggacacgtccgaatgccctaatgagcggcgcgcctggaactttctcgaggtggaagattacggattcggcatgttcaccacaaatatttggatgaagtttagagaggggagctctgaagtttgtgaccatcggctgatgtccgctgccatcaaagatcagaaggctgtgcacgccgacatgggatactggattgagagctctaaaaaccagacctggcaaatcgaaaaggcctcccttatcgaggtcaagacatgcctgtggcccaaaacccacacactctggagcaatggcgtgctggagtctcagatgctgattcctaaggcttatgcgggccccatcagccagcataactacagacaggggtatgccacccaaacggctggaccttggcaccttggcaaactcgaaattgatttcggggagtgccccggaacaaccgttaccatccaggaagactgtgatcatcgcggcccgtccctgcggacaaccacggccagcgggaagctggtgacacagtggtgctgtagatcttgcaccatgcctcccctccgctttctgggagaggacggctgttggtacggcatggagattagaccccttaacgaaaaagaggaaaatatggtcaagtcccaggtgagcgccgggcaaggaacatccgagaccttctctatgggcctgctctgcctgacactgtttgtggaagagtgtcttcggcgcagagtcacccggaagcacatgatcctcgttgtggtgacgaccctgtgcgctatcattctggggggactcacatggatggatctgcttcgcgccctgatcatgctcggcgacaccatgagcgggagaatgggaggccagattcatctggcgatcatggctgtcttcaaaatgtcccctggctatgtgctggggatttttcttcggaagctgacatctcgcgagaccgccctcatggttatcggaatggccatgacgacagtgctgagcatcccgcacgacctcatggaattcattgatggcatctccctggggcttattctgctcaaaatggtcacccactttgacaacacacaggtgggaaccctggctctggcccttaccttcatcaagtctacaatgcccctggttatggcgtggagaacgattatggctgtgctctttgtcgtgaccctgatccctctctgtcggacaagctgcctgcagaaacaatcccattgggtcgagattaccgcccttatcctgggcgcccaggctctccccgtgtacctgatgacactgatgaagggggccagcaagcgctcttggcctcttaatgaaggaatcatggctgttggcctggtgtccctcctgggcagcgccctcctgaaaaacgatgtcccccttgcggggcctatggtggccggaggcctgctgctcgctgcctatgttatgtctgggtccagcgctgacctgtctcttgagaaggccgccaatgtgcagtgggatgaaatggctgacattaccggatccagccccatcattgaggtcaaacaagatgaggacggctccttcagcatcagagatgtggaagagacgaacatgattacactgctcgtgaagctggcgctcatcaccgtttctgggctgtacccgcttgccatccctgtcaccatgacactgtggtacatgtggcaggtgaaaacccagcggagcggagctctgtgggacgtgccctcccctgccgccgctcagaaggccacactcacggaaggcgtctatagaattatgcaacgcggcctgtttgggaagacccaggtgggagttggcatccacacagagggggtgttccataccatgtggcacgtcacacggggatctgtgatttgtcatgaaagcggcagacttgagccctcctgggcggatgttcgcaatgacatgatctcttacgggggaggctggcggctgggcgataaatgggacaaggaggaagacgtgcaggtcctcgctattgagccggggaaaaaccctaagcacgtgcagaccaaacccggactgttcaagacgctcaccggcgaaatcggggccgttacactggattttaaacctggaaccagcggctcccccatcattaatagaaaggggaaggtgatcggcctttatggaaacggcgtcgtgacaaaatctggggactacgtgagcgccattacccaagctgagcgcatcggagagcccgattatgaagtcgacgaggatattttccggaagaaaagactgacaatcatggacctgcaccctggcgccgggaagacgaaacgcattctcccgtccatcgttcgggaagcgctgaagagacggcttcgcaccctgatcctcgctcccacaagagtggtggccgccgagatggaagaggctctgcggggactccctattcgctaccagacccccgccgtcaagagcgagcataccggcagagaaatcgtggatctgatgtgccacgctacatttacgacccggcttctgtcttccacaagagttcctaattataacctgattgtgatggacgaggcccatttcaccgatcccagctctgtcgcggcccgcgggtacatctccacacgggtggaaatgggcgaggctgccgctatttttatgaccgccacgcctccgggaacaaccgaccccttccctcagagcaattcccccatcgaagatatcgagagagagattcctgaacgctcttggaacaccggctttgactggatcacagactaccaggggaaaaccgtttggttcgtgcccagcattaaggccggaaatgatatcgctaactgcctccggaaatccggcaagaaagtcattcaactgagcagaaagacatttgacaccgagtatccgaagacgaaacttacagattgggacttcgtggtcaccacagatatctctgaaatgggggcgaactttcgcgccggacgggtgatcgaccctagacgctgtctgaagcccgttattctcaccgatggccccgagagagtgatcctggctgggcctattcccgtgacgcctgcctccgccgctcagcggcgcggcagaatcggacggaatccggcccaggaagacgatcaatacgtcttcagcggcgaccccctgcgcaacgatgaggaccacgcgcactggaccgaggctaaaatgctccttgataatatttatacacctgaagggatcattcccaccctgttcggacctgagagagaaaagacacaggccatcgacggcgagtttcggctgagaggggagcagcgcaaaaccttcgttgaactcatgcggagaggagacctgcccgtgtggctttcttacaaggtggccagcgctggcatctcctataaggatcgcgagtggtgctttacaggcgaacggaacaatcagattctggaggaaaacatggaggtcgagatctggaccagagaaggggagaaaaagaaactccggccgaagtggctggacgcccgcgtgtacgcggatcctatggccctgaaagacttcaaggaatttgcttctggaagaaagagcattacgctcgatatccttacagagattgcctccctgcccatgtatctgtctagccgggctaaactcgccctggacaatatcgttatgcttcataccaccgaacgcggcgggaaggcttaccaacacgccctgaacgagctccctgagtccctggaaacactgatgctcgtggcgcttctgggagccatgaccgctggcatcttcctgtttttcatgcaggggaaaggaattggcaagctcagcatgggcctgatcgccattgctgtcgcctctgggcttctgtgggtggccgagatccagccccagtggattgctgcgtccatcatcctcgaatttttcctgatggtcctgctcgtgcctgagcccgaaaaacaaagaacaccgcaggataatcagcttatttacgttatcctgacgattctgaccatcattgccctcgtggctgccaacgagatgggactgatcgagaagacaaaaaccgactttggcttctatcaggtcaaggccgaaacaaccattcttgatgtggacctgcggcctgctagcgcctggacgctctacgcggttgccaccacaatcctgacccccatgctgcgccatacaatcgagaatacctccgctaacctctctcttgccgctattgccaatcaagcggccgtgctgatggggctgggaaagggctggcccctccacagaatggatctgggggtccctcttctggctatgggatgttatagccaggtgaacccgacgacactcaccgcctccctggtgatgctgctcgttcattacgctatcattggccccggccttcaggccaaagctacacgggaagcccagaagcgcaccgcggccgggatcatgaaaaatcctaccgtcgacggaattacagtgatcgatctggagcccatctcttatgaccctaagtttgagaaacaactgggccaggtgatgctcctggtcctttgcgctgggcagctgctcctgatgagaacgacctgggccttctgtgaagttctgacactcgctaccggacccattcttacactgtgggagggcaaccctgggcggttctggaacaccacgatcgccgtgagcacagccaatatttttagaggatcctacctggcgggcgctggcctcgccttcagcctgatcaagaacgctcaaaccccgcgccgggggaccggaacaaccggcgaaacacttggggagaagtggaaaagacagctgaattctctcgaccgcaaggaatttgaggagtataaacggtccggaattctggaagtggatagaacggaggccaagagcgccctgaaagacggctctaagatcaagttcgctgtctcccgcgggaccagcaaaatccggtggattgtggaaagaggaatggttaagcccaaaggcaaggtggtcgatctcggctgcgggcgcggaggctggtcttactacatggccacacttaaaaacgtgaccgaggttaaggggtatacaaagggaggccctgggcacgaagagcccgtgcctatggcgacctacggatggaatctggtcaaactgcacagcggcgtggacgtgttttataagcccacggagcaggtcgataccctcctgtgtgacatcggcgaatcctctagcaacccgacaattgaggaagggcggacccttagagttctgaaaatggtggagccttggctctccagcaagcccgaattctgcatcaaagtgctgaatccctacatgcctacagtcattgaggagctggaaaagctccagcgccggcatggaggctcccttgtgagatgtcccctgtctcgcaacagcacccacgagatgtattgggtttccggggtgtctggaaatatcgtcagctccgtgaacacaacctctaaaatgctgctcaatagatttacgacacggcatcgcaagcctacctacgaaaaggatgccgacctgggcgctgggaccagaagcgtttccacagagacggagaaaccggatatgaccattatcggacggagacttcaacggctgcaggaagagcacaaggaaacatggcactatgaccatgagaacccctaccgcacctgggcctaccacggcagctatgaagctccttctacaggctccgccagctctatggtgaatggggtcgtgaaactcctgaccaagccctgggatgttgtgcctatggtcacacagctggcgatgaccgacacgacccccttcggacagcaaagagtgtttaaagagaaggtcgacacacggaccccgcagcctaagcccggcacacgcgtgatcatgaccacgacagccaactggctctggaccctgcttgggagaaaaaagaatcctcggctgtgcacacgcgaggaattcatttccaaagttagaagcaacgctgccatcggagctgtgtttcaggaggaacagggctggacctctgcctccgaggctgtcaatgatagccggttctgggaactcgtggacaaggagcgcgccctgcatcaagaggggaaatgtgaatcctgcgtgtacaacatgatgggcaagagagagaagaaacttggagaatttggccgggcgaaggggagccgcgccatttggtatatgtggctgggagctagattcctcgagttcgaagccctgggctttctgaacgaggatcactggttcgggcgggagaattcttggagcggagttgaaggcgaggggctccatcgcctgggctacatccttgaagacattgataaaaaggacggagatctgatctatgctgacgatacggccggctgggacaccagaatcacagaggatgacctcctgaacgaggaacttattaccgagcagatggccccccaccacaaaatcctggcgaaggctatttttaagctcacataccagaataaagtggtcaaggtgctgcggcctacccccaaaggggccgttatggatatcatttccagaaaggaccaacgcggatctggccaggtggggacatatggactgaacaccttcacgaatatggaagtccagctcatccggcagatggaggccgaaggcgtgatcacacaagacgatatgcataacccgaaagggctgaaggagagagtcgagaaatggcttaaggaatgcggcgtggaccgcctgaagcggatggctattagcggagatgactgtgttgtgaaacctctcgatgagagattttccacctctctgcttttcctgaatgacatgggcaaggtccgcaaagatatcccccagtgggaacccagcaaggggtggaaaaactggcaggaggtgcctttttgctcccaccatttccacaagatttttatgaaggacggacggtctctcgttgtgccgtgtagaaatcaggatgaactgatcggccgcgcccggattagccaaggggctggatggtccctgagagagaccgcctgcctcggcaaagcgtacgcccagatgtggagcctgatgtacttccaccgccgggaccttagactggcttctatggccatctgttccgctgtccccacagagtggtttcctaccagccggacaacgtggtctatccatgcccaccatcagtggatgaccacagaagatatgctcaaggtgtggaacagagtgtggattgaggacaatcccaacatgatcgacaaaacccctgttcactcctgggaagatattccctatctggggaagcgcgaggacctttggtgcggcagcctgatcggactctcctctcgggcgacatgggccaaaaatattcataccgctatcacgcaggtcagaaacctgattggcaaggaagagtacgtggattatatgcctgccatgcgcagatacagcgctcacttcgagtccgaaggggtgctgtga

SEQ ID NO: 20954 - RNA, 9867 nt, synthetic construct
  misc_feature 1..9867: note = derived and/or modified CDS sequence (opt5) from DENV-4__KP188557__SS-prME
  source 1..9867: mol_type = other RNA
agcaccatcaccctgctctgcctgattcccacggtgatggctttccacctttccaccagagacggcgaacctctgatgatcgtggctaagcatgaacgggggcgcccgctcctgtttaagaccaccgagggaattaacaagtgtacacttatcgccatggatctgggcgaaatgtgcgaggacaccgttacatacaaatgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccagcgcgtggagtcttggatccttagaaatcctggcttcgctctgctcgccggctttatggcttacatgatcgggcagacaggcattcaacggaccgttttctttgtgctgatgatgcttgtcgcccccagctatggaatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctcttattagcaatatcaccacagccacccgctgcccgacgcaaggagagccctatctgaaggaggaacaggaccagcagtacatttgtagacgggatgtggtggaccgcggctgggggaacggatgcggcctcttcgggaaaggaggcgtcgtgacatgcgcgaagttttcttgttccggcaaaatcaccgggaatctggttcaaattgagaaccttgaatataccgtggtcgtgacagttcataatggagatacccacgccgtgggcaacgacacaagcaatcacggggtcacggctaccatcacacctagatctccctccgtggaggtcaagctgcctgattacggagaactcaccctggactgcgagccccggagcggcatcgacttcaacgagatgattctgatgaagatgaaaaagaaaacatggctcgtgcataagcagtggtttctggatcttccgctgccttggaccacgggggccgacacctctgaagttcactggaattacaaagagagaatggtgacattcaaggtcccccatgctaaacgccaggatgtgaccgttctcggctcccaggaaggagccatgcacagcgccctggctggcgcgacagaggtggactccggggatggaaaccacatgtttgccggccatcttaagtgtaaggtccggatggaaaaactgagaatcaaggggatgtcttataccatgtgcagcggaaaattctccattgacaaggagatggctgagacgcaacacggcacaaccgtggtgaaagttaagtacgaaggggccggcgccccttgtaaggtccccatcgagattcgcgatgtgaataaagaaaaggtggtcggacgggtgatcagcgctacacccctcgccgagaacaccaactctgttaccaatatcgagctggaacctccgttcggcgactcctatattgtgatcggggtcggaaacagcgcgctgacactccattggtttagaaaaggctctagcattgggaagatgttcgagtccacgtaccgcggagctaaacggatggccatcctgggcgaaaccgcctgggattttgggtctgtgggcggacttttcacaagcctgggcaaggctgttcaccaggtgtttgggtccgtctataccacaatgttcggaggcgtgagctggatgattagaatcctcatcgggtttctggttctgtggattggaaccaattctcgcaacacgtccatggccatgacatgcatcgctgtgggcgggattacccttttcctcggctttaccgtccaggccgacatgggatgtgtggtgagctggtctggccgggagctgaagtgcgggtccggaatcttcgtcgttgataatgtgcatacatggaccgaacaatacaaatttcagcccgagagccctgcgagactggcctccgctattctcaacgcccacaaggacggcgtgtgtgggatccgctctacaacgcggctggagaatgtcatgtggaaacagattaccaacgaacttaattatgtgctgtgggagggaggccacgacctcacagttgtggctggcgatgtcaagggggtgctgaccaaaggaaagagagccctgacaccccctgcgagcgaccttaagtactcctggaaaacctggggcaaggcccggatcttcacgcccgaagctcgcaacaatacctttctcatcgatgggccggacacatctgagtgccctaacgaaagacgggcctggaatagcttcgaggttgaggattacggattcggcatgtttaccacaaacatttggatgaaattcagagaagggtccagcgaggtgtgtgaccatcgcctgatgtctgctgccatcaaggatcagaaagccgtccacgctgacatgggatattggattgaatccagcaagaatcaaacctggcagatcgagcgggcgtctctgattgaagtgaaaacatgcctctggcccaagacccatacgctgtggtccaacggcgttcttgagagccagatgctgatccctaagtcttacgccggcccctttagccagcacaactatagacaagggtacgctacacagaccgtgggaccttggcacctcggcaaactggagatcgatttcggggaatgccccggaaccacagtcaccattcaggagaattgtgaccatcgcggcccgtccctgagaacgacaaccgccagcgggaaacttgtgacacagtggtgctgtcggtcttgcaccatgcctcccctccgctttctgggagaagatggctgttggtatggcatggagatcagacccctgtccgagaaagaagagaacatggtcaagagccaagtcacagccgggcagggaacctccgaaacgttctctatgggcctcctgtgccttaccctgtttgttgaggaatgtctccggcgcagagtgacacggaaacacatgattctggctgtggtcatcaccctgtgcgccattatccttgggggactcacatggatggacctgctgcgcgcgctcatcatgctgggcgataccatgagcgggagaattggaggccagacgcatcttgctatcatggccgtgttcaagatgtcccctggctacgttctgggggtgtttctccggaagctgacatctcgcgagaccgccctgatggtcattggaatggctatgacaaccacccttagcatcccgcacgacctgatggagctcattgacggcatctccctggggctcatcctgcttaaaattgtgacacagttcgataatacgcaagttggaaccctggccctctctctgacatttatcagaagcaccatgtccctggtgatggcgtggcggacaattatggctgtccttttcgtggtcaccctgatccccctctgtagaacgagctgcctgcagaagcagtctcattgggtggaaattacagccctcatcctgggcgcccaagcccttcctgtttatctgatgaccctcatgaaaggggcctcccgccggagctggcccctgaacgagggaattatggctgtgggcctggtctctcttctgggctccgccctcctgaagaatgacgtgcctctcgcggggcccatggttgccggaggcctgcttctggctgcctacgtgatgagcgggtcttccgctgatctgagcctcgaaaaagccgccaacgtcagatgggacgagatggctgatatcaccggatccagccctatcattgaagtgaagcaggacgaggatggctcttttagcatccgcgacgtggaggaaacaaatatgattaccctgcttgttaagctggcgctcatcacagtctccgggctgtaccccctcgccattccgatcacgatgaccctgtggtatatgtggcaagtgaaaacacagcggtctggagctctttgggatgtgcctagccccgccgccacccaaaaggctgccctgtccgagggcgtctacagaatcatgcagcgcggcctgttcgggaaaacacaggtgggagttggcattcacatggaaggggtgttccacaccatgtggcatgtcacgcggggatctgtgatctgtcacgagaccggcagactcgaacctagctgggcggacgttcgcaacgatatgatttcctatgggggaggctggcggctgggcgacaagtgggataaagaggaggacgtgcaggtccttgctatcgaacccgggaagaatccgaagcatgtgcaaacaaaacctggactgtttaagaccctcacaggcgagattggggccgttaccctggacttcaaacccggaacatctggcagccctatcatcaacagaaaggggaaagtgattggcctctacggaaatggcgtcgtgacgaagtccggggattatgtgagcgccatcacccaggctgaacggattggagagcccgactacgaggtcgatgaagacatctttcgcaaaaagagactgacaattatggatcttcaccccggcgccgggaagaccaaacggatcctgccttctattgttcgcgaggcgctgaagagacggctcagaaccctgatccttgctccgacacgcgtggtggccgccgaaatggaggaagctctgcggggactccccatcagatatcagacgcctgccgtcaaatccgagcataccggccgcgagattgtggacctgatgtgccacgctacattcaccacacggctcctgagctctaccagagttcccaactacaatcttatcgtgatggatgaagcccactttacggacccttccagcgtcgcggcccgcgggtacatttccacacgggtggagatgggcgaagctgccgctatcttcatgaccgccacaccccctggagccacagatccgtttccccagtctaacagccctattgaggacatcgaaagagagatccccgagcgctcctggaataccggcttcgattggattacagactatcaagggaagaccgtttggtttgtgcctagcatcaaagctggaaacgacattgcgaactgcctgagaaagtctggcaagaaagtcatccagctgtcccggaagacgttcgatacagaataccccaaaaccaagctcacagactgggattttgtggtcaccacggacattagcgagatgggggccaatttccgcgctggaagagtgatcgatccgcggcgctgtctgaaacctgttatccttaccgacgcccccgaaagagtgattctggccggccccatccctgtgacacccgcttctgccgcgcagcggagagggcgcattggccggaaccctgctcaagaggatgaccagtatgtcttcagcggagatccgctcaagaatgacgaagatcatgcccactggaccgaggccaagatgctgctggacaacatctacacacccgagggcattatccctaccctctttgggcccgaaagagagaaaacacaggctattgatggagagttccgccttcggggcgagcagagaaagacctttgttgagctgatgcggcgcggggacctgcctgtgtggctctcctataaagtggcctctgcgggaatcagctacaaggacagagaatggtgcttcacgggcgagcggaataaccaaatcctggaagagaatatggaagtcgagatttggacacgcgagggcgagaagaagaaacttagacccaaatggctggatgcccgggtgtatgctgacccgatggccctcaaggattttaaagagttcgcttccgggcgcaagtctatcaccctggacattctgaccgaaatcgccagcctccctacatacctttccagcagagctaaactggccctggataacattgttatgctccataccacagagcggggaggccgcgcgtaccagcacgccctgaatgaacttcccgagtctctggagacgctcatgctggtggctctgctcggggccatgaccgctggaatctttcttttctttatgcagggcaaggggatcggaaagctgtccatgggcctgattacaatcgccgtcgccagcggcctcctgtgggtggctgaaattcagcctcaatggatcgcggcctccattatccttgagttctttctgatggtcctcctgatccccgaacctgagaaacagagaacaccccaggacaaccagctgatttatgtgatcctcacaattcttaccatcattgggctgatcgctgccaatgaaatgggactgattgagaagacgaaaaccgatttcggcttttaccaagttaagacagagaccacaatcctcgacgtggatctgcggccggcctctgcttggaccctttatgccgtcgcgacgacaatcctgacccctatgctcagacacacaattgaaaacaccagcgccaatctgtccctggctgccatcgctaaccaggccgcggtgctcatggggcttggaaaaggctggcccctgcatcgcatggacctgggggttcccctcctggccatgggatgttactctcaggtgaatcctaccacacttacggctagcctggtcatgctcctggtgcactatgccattatcggcccgggcctgcaggctaaggccacccgggaggctcagaagagaacagccgcggggattatgaagaaccccaccgtggatggaatcacagttatcgacctcgaacctatttcctacgatcccaagttcgagaaacagcttggccaggtcatgctgctggtgctctgcgccgggcaactgcttctgatgcgcaccacgtgggctttctgtgaggtgctcacactggccaccggacctatcctgaccctctgggaaggcaaccccgggcggttttggaatacaaccattgctgtcagcacagccaacatcttcagaggatcttatcttgccggcgcgggcctggctttttccctgattaagaatgcccagacgcctcgccgggggaccggaacagctggcgagaccctcggggaaaaatggaagagacagctgaacagccttgaccgcaaagagttcgaagagtacaagcggtctggaatcctggaggttgacagaacagaagccaagtccgccctcaaagatggcagcaagatcaaacatgctgtgtctcgcgggagctccaagattcggtggatcgtggagagaggaatggtcaaaccgaagggcaaggtggttgacctgggctgcgggcgcggaggctggtcttactatatggccaccctgaaaaatgtgacggaagtcaaggggtacaccaaaggaggccccgggcacgaggaacctattcccatggcgacatatggatggaacctcgtgaaacttcatagcggcgttgatgtgttttacaaacctaccgagcaggtcgacacactgctgtgtgatatcggcgagtccagctccaatcccaccattgaagaggggagaacactccgggtgctgaagatggtggaaccgtggctttctagcaagcctgagttctgcatcaaagtcctgaacccctatatgcccaccgttattgaagaactcgagaagctgcaacgcaaacacggaggcaatctggtgagatgtcctctctcccggaactctacgcacgaaatgtactgggtgagcggggcctccggaaatatcgtctctagcgtgaacacaacctccaagatgcttctgaatagatttaccacacggcatcgcaaacccacgtatgagaaggacgttgatctgggcgctgggaccagaagcgtgtctacagaaaccgagaaacctgacatgacaatcattggacggcgcctccagagactgcaggaggaacacaaggagacctggcattacgatcaggaaaacccgtaccggacatgggcctatcacggctcctacgaggctcccagcaccggctctgcctccagcatggtcaatggggtggttaaacttctgacgaaaccttgggacgtgatccccatggtcacccaactcgcgatgacagataccacacctttcggacagcagcgcgtgtttaaggaaaaagttgacaccagaacgccccagccgaagcctggcacacggatggtgatgaccacaaccgccaactggctgtgggctctgctcgggaaaaagaagaatccccgcctgtgcacgagagaggagttcatttctaaagtccggtccaacgccgctatcggagccgtgtttcaagaagaacagggctggaccagcgcttccgaagccgtcaacgacagccgcttctgggagcttgtggataaggaaagagcgctgcaccaggaggggaaatgtgagtcttgcgtttataatatgatgggcaagcgggagaagaagctcggagagtttggccgcgccaaggggagcagagctatttggtacatgtggctgggagcccggttccttgagttcgaggctctgggctttctcaacgaagaccattggttcgggagagaaaattcctggtctggagtggagggcgaagggctgcaccgcctgggctatatcctcgaggaaatcgataaaaaggacggagatctgatgtacgccgacgatacagccggctgggacacccggattacagaggatgaccttcaaaacgaggaactgatcaccgagcagatggcgcctcatcacaaaattctcgctaaggccatctttaaactgacatatcagaataaggtcgtgaaggtgcttagacccacccctcgcggggccgttatggatattatcagccggaaagaccagagaggatccggccaagtggggacgtacggactgaacacattcaccaatatggaagtccagctcatccgccagatggaggctgaaggcgtgattacccaggatgacatgcaaaaccccaaggggctgaaagagcgggttgagaagtggctgagagaatgcggcgtggaccgcctcaaacggatggccatctctggagatgactgtgtcgtgaagccgctggatgagagatttggcacaagccttctgttcctcaatgacatggggaaagtccgcaaggatattcctcagtgggaaccctccaagggatggaaaaactggcaggaggtgcccttttgctctcatcacttccacaagatctttatgaaagacggccggagcctggttgtgccttgtagaaatcaggatgaacttattgggcgggctagaatctcccaaggagccggctggagcctgcgcgagaccgcgtgcctcgggaaggcctacgctcagatgtggtctctgatgtatttccatcggagagacctgcgcctcgcctccatggctatctgtagcgccgtcccgacagagtggtttcccacgtctagaaccacatggtccattcacgcgcatcaccagtggatgaccacagaagatatgctgaaagtgtggaaccgggtttggatcgaggacaatcctaacatgattgataagacccccgtgcacagctgggaagacatcccttaccttggcaagcgcgaggacctgtggtgcggatccctcattggcctgtctagcagagccacgtgggctaaaaatatccataccgccattacacaggtccggaaccttatcgggaaggaagagtatgtggattacatgcccgtgatgaaacgctattccgctcctagcgagtctgaaggagttctgtga

SEQ ID NO: 20955 - RNA, 9867 nt, synthetic construct
  misc_feature 1..9867: note = derived and/or modified CDS sequence (opt5) from DENV-4__KP188558__SS-prME
  source 1..9867: mol_type = other RNA
agcaccatcacactgctctgcctgattcccacggtgatggccttccacctttccaccagagacggcgagcctctgatgatcgtcgctaagcatgaacgggggcgcccgctcctgtttaaaacaaccgagggaattaacaagtgtacacttatcgccatggatctgggcgaaatgtgcgaggacaccgttacatacaaatgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggatccttagaaatcctggcttcgctctgctcgccggctttatggcttacatgatcgggcagacaggaattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctcttattagcaatatcaccacagccacccgctgcccgacgcaaggagagccctatctgaaggaggaacaggaccagcagtacatttgtagacgggatgtggtggaccgcggctgggggaacggatgcggcctcttcgggaaaggaggcgtcgtgacatgcgcgaagttttcttgttccggcaaaatcaccgggaatctggttcaaattgagaaccttgaatataccgtggtcgtgacagttcatgatggagacacccacgccgtgggcaatgatacaagcaaccacggggtcacggctaccatcacacctagatctccctccgtggaggtcaagctgcctgactacggagaactcaccctggactgcgagccccggagcggcatcgatttcaatgagatgattctgatgaagatgaaaaagaaaacatggctcgtgcataagcagtggtttctggaccttccgctgccttggaccacgggggccgatacctctgaagttcactggaactacaaagagagaatggtgacattcaaggtcccccatgctaaacgccaggacgtgaccgttctcggctcccaggaaggagccatgcacagcgccctggctggcgcgacagaggtggattccggggacggaaatcacatgtttgccggccatcttaagtgtaaggtccggatggaaaaactgagaatcaaggggatgtcttataccatgtgcagcggaaaattctccattgataaggagatggctgagacgcaacacggcacaaccgtggtgaaagttaagtacgaaggggccggcgccccttgtaaggtccccatcgagattcgcgacgtgaacaaagaaaaggtggtcggacgggtgatcagcgctacacccctcgccgagaataccaactctgttaccaacatcgagctggaacctccgttcggcgattcctatattgtgatcggggtcggaaatagcgcgctgacactccattggtttagaaaaggctctagcattgggaagatgttcgagtccacgtaccgcggagctaaacggatggccatcctgggcgaaaccgcctgggactttgggtctgtgggcggacttttcacaagcctgggcaaggctgttcaccaggtgtttgggtccgtctataccacaatgttcggaggcgtgagctggatgattagaatcctcatcgggtttctggttctgtggattggaaccaactctcgcaatacgtccatggccatgacatgcatcgctgtgggcgggattacccttttcctcggctttaccgtccaggccgatatgggatgtgtggtgagctggtctggccgggagctgaagtgcgggtccggaatcttcgtcgttgacaacgtgcatacatggaccgaacaatacaaatttcagcccgagagccctgcgagactggcctccgctattctcaatgcccacaaggacggcgtgtgtgggatccgctctacaacgcggctggagaacgtcatgtggaaacagattaccaatgaacttaactatgtgctgtgggagggaggccacgatctcacagttgtggctggcgacgtcaagggggtgctgaccaaaggaaagagagccctgacaccccctgcgagcgatcttaagtactcctggaaaacctggggcaaggccaaaatcttcacgcccgaagctcggaattctacctttctcatcgacgggccggatacaagcgagtgccctaacgaacgcagagcctggaattccttcgaggttgaggactacggattcggcatgtttaccacaaacatttggatgaagttccgggaagggagctctgaggtgtgtgatcatagactgatgtccgctgccatcaaagaccagaaggccgtccacgctgatatgggatattggattgaaagctctaaaaatcaaacctggcagatcgagcgcgcgtccctgattgaagtgaagacatgcctctggcccaagacccatacgctgtggagcaacggcgttcttgagtctcagatgctgatccctaaaagctacgccggccccttttcccagcacaattatcggcaagggtacgctacacagaccgtgggaccttggcacctcggcaagctggagatcgacttcggggaatgccccggaaccacagtcaccattcaggagaactgtgatcatagaggcccgagcctgcgcacgacaaccgcctctgggaaacttgtgacacagtggtgctgtagatcctgcaccatgcctcccctccggtttctgggagaagacggctgttggtatggcatggagatccgccccctgagcgagaaggaagagaacatggtgaaatcccaagtcacagccgggcagggaacctctgaaacgttcagcatgggcctcctgtgccttaccctgtttgttgaggaatgtctcagacggcgcgtgacaagaaagcacatgattctggctgtggtcatcaccctgtgcgccattatccttgggggactcacatggatggatctgctgcgggcgctcatcatgctgggcgacaccatgtccgggcgcattggaggccagacgcatcttgctatcatggccgtgttcaagatgtctcctggctacgttctgggggtgtttctcagaaaactgacaagccgggagaccgccctgatggtcattggaatggctatgacaaccaccctttccatcccgcacgacctgatggagctcattgatggcatctctctggggctcatcctgcttaagattgtgacacagttcgacaatacgcaagttggaaccctggccctcagcctgacatttatccgctccaccattagcctggtgatggcgtggagaacaatcatggctgtccttttcgtggtcaccctgattcccctctgtcggacgtcttgcctgcagaaacagtcccattgggtggaaatcacagccctcattctgggcgcccaagctcttcctgtttatctgatgaccctcatgaagggggccagcagacgctcttggcccctgaacgagggaatcatggctgtgggcctggtctcccttctgggcagcgccctcctgaaaaatgatgtgcctctcgcggggcccatggttgccggaggcctgcttctggctgcctacgtgatgtctgggtccagcgctgacctgtccctcgaaaaggccgccaacgtccagtgggatgagatggctgacatcaccggaagctctcctattatcgaagtgaagcaggatgaggacggcagcttttccattcgggatgtggaggaaacaaatatgatcaccctgcttgttaaactggcgctcattacagtctctgggctgtaccccctcgccatcccgatcacgatgaccctgtggtatatgtggcaggtgaagacacaaagaagcggagctctttgggacgtgccttcccccgccgccacccagaaagctgccctgtctgagggcgtctaccgcattatgcagcggggcctgttcgggaagacacaggtgggagttggcatccacatggaaggggtgttccacaccatgtggcatgtcacgagaggaagcgtgatttgtcacgagaccggccgcctcgaaccttcctgggcggatgttcggaacgacatgatctcttatgggggaggctggagactgggcgataaatgggacaaggaggaggacgtgcaagtccttgctattgaacccgggaagaatccgaaacatgtgcagacaaagcctggactgtttaaaaccctcacaggcgagatcggggccgttaccctggatttcaagcccggaacaagcggctcccctatcattaaccgcaaagggaaggtgatcggcctctacggaaatggcgtcgtgacgaaaagcggggactatgtgtctgccattacccaggctgaacggatcggagagcccgattacgaggtcgacgaagatatttttagaaagaagcggctgacaatcatggaccttcaccccggcgccgggaaaaccaagcgcattctgccttccatcgttagagaggcgctgaaacggcgcctcagaaccctgatccttgctccgacacgggtggtggccgccgaaatggaggaagctctgagaggactccccattcgctatcagacgcctgccgtcaagagcgagcataccggccgggagatcgtggatctgatgtgccacgctacattcaccacaagactcctgtcttccacccgcgttcccaactacaatcttattgtgatggacgaagcccactttacggatcctagctccgtcgcggcccgggggtacatctctacaagagtggagatgggcgaagctgccgctattttcatgaccgccaccccccctggagccacagacccgtttccccaaagcaactcccctatcgaggatatcgaacgcgagattcccgagcggagctggaataccggcttcgactggatcacagactatcaggggaaaaccgtttggtttgtgccttctattaaggctggaaacgatatcgcgaattgcctgagaaagtccggcaaaaaggtcattcagctgagccgcaaaacgttcgacacagaataccccaagaccaaactcacagattgggactttgtggtcaccacggatatctctgagatgggggccaacttcagagctggacgggtgatcgacccgcgcagatgtctgaagcctgttattcttaccgatggccccgaacgggtgatcctggccgggcccattcctgtgacacccgccagcgctgcccaacgcagaggccggatcggaagaaaccctgcgcaggaggacgatcagtatgtcttctccggcgacccgctcaagaatgatgaagaccatgctcactggaccgaggccaaaatgctgctggataacatttacacacccgaggggatcattcctaccctctttggacccgaacgcgagaagacacaggccatcgacggcgaattccggcttagaggggagcaacgcaaaacctttgttgagctgatgcggagaggagacctgcctgtgtggctctcttataaggtggctagcgccggcatctcctacaaagatcgggaatggtgcttcacgggcgagcgcaataaccagattctggaagagaatatggaagtcgagatctggacaagagagggggaaaagaagaaacttcggcccaagtggctggacgcgcgcgtgtatgccgatccgatggctctcaaagactttaaggagttcgcctctggaagaaaaagcattaccctggatatcctgaccgaaattgcttccctccctacataccttagctctcgggccaagctggctctggacaacatcgttatgctccataccacagagcgcggcgggagagcctaccagcacgcgctgaatgaacttcccgagtccctggagacgctcatgctggtggccctgctcggagctatgaccgccggcatctttcttttctttatgcaggggaagggaattggcaaactgagcatgggcctgatcacaattgctgtcgcctccgggctcctgtgggtggccgaaatccaacctcagtggattgctgcgtctatcatccttgagttctttctgatggtcctcctgattcccgaacctgagaagcagcggaccccccaggataaccaactgatctatgtgattctcacaatccttaccattatcggactgattgccgctaatgaaatgggcctgatcgagaaaacgaagaccgacttcgggttttaccaggttaaaacagagaccacaatcctcgatgtggacctgcgcccggccagcgcctggaccctttatgctgtcgccacgacaattctgacccctatgctcagacacacaatcgaaaacacctccgcgaatctgtctctggccgctattgccaaccaggctgccgtgctcatgggacttggcaaggggtggcccctgcatcggatggatctgggagttcccctcctggcgatgggctgttacagccaggtgaatcctaccacacttacggcctccctggtcatgctcctggtgcactatgctatcattggcccggggctgcaagccaaagctaccagagaggcccagaagcgcacagctgccggaatcatgaagaaccccaccgtggacggcatcacagttattgatctcgaacctatcagctacgaccccaaattcgagaagcagcttgggcaagtcatgctgctggtgctctgcgcgggacagctgcttctgatgcggaccacgtgggccttctgtgaggtgctcacactggctaccggccctattctgaccctctgggaagggaatcccggaagattttggaacacaaccatcgccgtctctacagctaacattttccgcggctcctatcttgccggcgccgggctggcgtttagcctgatcaaaaatgctcagacgcctcggagaggaaccggcacagccggggagaccctcggagaaaagtggaaacgccagctgaactctcttgaccggaaggagttcgaagagtacaagagatccggcatcctggaggttgatcgcacagaagctaaaagcgccctcaaggacgggtctaaaattaagcatgccgtgagccggggatcctctaaaatcagatggattgtggagcgcggcatggtcaagccgaagggcaaagtggttgatctggggtgcggacggggcgggtggagctactatatggctaccctgaagaatgtgacggaagtcaaaggatacaccaagggcgggcccggacacgaggaacctatccccatggccacatatggctggaacctcgtgaaacttcattccggcgttgacgtgttttacaagcctaccgagcaagtcgatacactgctgtgtgacattggggagagctcctctaatcccaccatcgaagagggaagaacactccgcgtgctgaagatggtggaaccgtggcttagctccaaacctgagttctgcattaaggtcctgaacccctatatgcccaccgttatcgaagagctcgagaaactgcagagaaagcacggcgggaatctggtgcggtgtcctctctctcgcaacagcacgcacgaaatgtactgggtgtccggagcgtctggcaatatcgtcagctccgtgaacacaaccagcaaaatgcttctgaatagatttaccacacggcatagaaagcccacgtatgagaaagatgttgacctgggggccggaacccggtctgtgtccacagaaaccgagaagcctgatatgacaattatcggccgcagactccagcggctgcaggaggaacacaaggagacctggcattacgaccaagaaaacccgtaccgcacatgggcttatcacggcagctacgaggccccctctaccgggtccgctagctctatggtcaatggagtggttaaacttctgacgaagccttgggatgtgattcccatggtcacccagctcgccatgacagacaccacacctttcggccagcagagagtgtttaaagaaaaggttgacacccggacgccccaaccgaaacctgggacacgcatggtgatgaccacaaccgcgaactggctgtgggccctgctcggaaagaagaaaaatcccagactgtgcacgcgggaggagttcatctccaaggtccgcagcaacgctgccattggcgctgtgtttcaggaagagcaggggtggacctccgccagcgaagctgtcaatgattctagattctgggagcttgtggacaaagaacgggccctgcaccaagagggcaagtgtgagagctgcgtttataacatgatgggaaaacgcgaaaagaagctcggcgagtttgggagagcgaaaggatcccgggccatctggtacatgtggctgggcgctcgcttccttgaattcgaggccctggggtttctcaacgaagatcattggttcggaagagagaattcttggagcggcgtggagggggaaggcctgcaccggctgggatatatcctcgaggaaattgacaagaaagatggcgacctgatgtacgctgatgacacagccgggtgggataccagaatcacagaggacgatcttcagaacgaggaactgattaccgagcagatggcccctcatcacaagatcctcgcgaaagctatttttaagctgacatatcagaataaggtcgtgaaagtgcttcgccccacccctcggggagccgttatggacatcatctccagaaaggatcaacgcggctctgggcaggtgggaacgtacggcctgaacacattcaccaatatggaagtccagctcattcggcagatggaggccgaaggggtgatcacccaagacgacatgcagaaccccaaaggcctgaaggagagagttgagaaatggctgcgcgaatgcggagtggatcggctcaagagaatggctattagcggcgacgattgtgtcgtgaaaccgctggacgagcgctttgggacatcccttctgttcctcaatgatatgggaaaggtccggaaggacatccctcagtgggaaccctctaaaggctggaagaactggcaggaggtgcccttttgcagccatcacttccacaaaatttttatgaaggatgggagatccctggttgtgccttgtcgcaatcaagacgaacttatcggacgggccagaatcagccagggcgctgggtggtctctgcgggagaccgcctgcctcggcaaagcgtacgcccagatgtggtccctgatgtatttccatagacgcgatctgcggctcgctagcatggccatttgttctgctgtcccgacagagtggtttcccacgtccagaaccacatggagcatccacgcccatcaccagtggatgaccacagaagacatgctgaaggtgtggaaccgcgtttggattgaggataatcctaacatgatcgacaagacccccgtgcactcctgggaagacattccttaccttggaaaaagagaggatctgtggtgcggctctctcatcgggctgagctcccgggcgacgtgggccaagaatattcataccgctatcacacaagtccgcaaccttatcggaaaagaagagtatgtggactacatgcccgtgatgaagagatatagcgccccttctgagtccgaaggcgttctgtga

SEQ ID NO: 20956 - RNA, 9867 nt, synthetic construct
  misc_feature 1..9867: note = derived and/or modified CDS sequence (opt5) from DENV-4__KP188563__SS-prME
  source 1..9867: mol_type = other RNA
agcaccatcacactgctctgcctgattcccacggtgatggccttccacctttccaccagagacggcgagcctctgatgatcgtcgctaagcatgaacgggggcgcccgctcctgtttaaaacaaccgagggaattaacaagtgtacacttatcgccatggatctgggcgaaatgtgcgaggacaccgttacatacaaatgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggatccttagaaatcctggcttcgctctgctcgccggctttatggcttacatgatcgggcagacaggaattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctcttattagcaatatcaccacagccacccgctgcccgacgcaaggagagccctatctgaaggaggaacaggaccagcagtacatttgtagacgggatgtggtggaccgcggctgggggaacggatgcggcctcttcgggaaaggaggcgtcgtgacatgcgcgaagttttcttgttccggcaaaatcaccgggaatctggttcaaattgagaaccttgaatataccgtggtcgtgacagttcataatggagatacccacgccgtgggcaacgacacaagcaatcacggggtcacggctaccatcacacctagatctccctccgtggaggtcaagctgcctgattacggagaactcaccctggactgcgagccccggagcggcatcgacttcaacgagatgattctgatgaagatgaaaaagaaaacatggctcgtgcataagcagtggtttctggatcttccgctgccttggaccacgggggccgacacctctgaagttcactggaattacaaagagagaatggtgacattcaaggtcccccatgctaaacgccaggatgtgaccgttctcggctcccaggaaggagccatgcacagcgccctggctggcgcgacagaggtggactccggggatggaaaccacatgtttgccggccatcttaagtgtaaggtccggatggaaaaactgagaatcaaggggatgtcttataccatgtgcagcggaaaattctccattgacaaggagatggctgagacgcaacacggcacaaccgtggtgaaagttaagtacgaaggggccggcgccccttgtaaggtccccatcgagattcgcgatgtgaataaagaaaaggtggtcggacgggtgatcagcgctacacccctcgccgagaacaccaactctgttaccaatatcgagctggaacctccgttcggcgactcctatattgtgatcggggtcggaaacagcgcgctgacactccattggtttagaaaaggctctagcattgggaagatgttcgagtccacgtaccgcggagctaaacggatggccatcctgggcgaaaccgcctgggattttgggtctgtgggcggacttttcacaagcctgggcaaggctgttcaccaggtgtttgggtccgtctataccacaatgttcggaggcgtgagctggatgattagaatcctcatcgggtttctggttctgtggattggaaccaattctcgcaacacgtccatggccatgacatgcatcgctgtgggcgggattacccttttcctcggctttaccgtccaggccgacatgggatgtgtggtgagctggtctggccgggagctgaagtgcgggtccggaatcttcgtcgttgataatgtgcatacatggaccgaacaatacaaatttcagcccgagagccctgcgagactggcctccgctattctcaacgcccacaaggacggcgtgtgtgggatccgctctacaacgcggctggagaatgtcatgtggaaacagattaccaacgaacttaattatgtgctgtgggagggaggccacgacctcacagttgtggctggcgatgtcaagggggtgctgaccaaaggaaagagagccctgacaccccctgcgagcgaccttaagtactcctggaaaacctggggcaaggccaaaatcttcacgcccgaagctcggaactctacctttctcatcgatgggccggacacaagcgagtgccctaatgaacgcagagcctggaactccttcgaggttgaggattacggattcggcatgtttaccacaaatatttggatgaagttccgggaagggagctctgaggtgtgtgaccatagactgatgtccgctgccatcaaagatcagaaggccgtccacgctgacatgggatattggattgaaagctctaaaaaccaaacctggcagatcgagcgcgcgtccctgattgaagtgaagacatgcctctggcccaagacccatacgctgtggagcaatggcgttcttgagtctcagatgctgatccctaaaagctacgccggccccttttcccagcacaactatcggcaagggtacgctacacagaccgtgggaccttggcacctcggcaagctggagatcgatttcggggaatgccccggaaccacagtcaccattcaggagaactgtgaccatagaggcccgagcctgcgcacgacaaccgcctctgggaaacttgtgacacagtggtgctgtagatcctgcaccatgcctcccctccggtttctgggagaagatggctgttggtatggcatggagatccgccccctgagcgagaaggaagagaatatggtgaaatcccaagtcacagccgggcagggaacctctgaaacgttcagcatgggcctcctgtgccttaccctgtttgttgaggaatgtctcagacggcgcgtgacaagaaagcacatgattctggctgtggtcatcaccctgtgcgccattatccttgggggactcacatggatggacctgctgcgggcgctcatcatgctgggcgataccatgtccgggcgcattggaggccagacgcatcttgctatcattgccgtgttcaagatgtctcctggctacgttctgggggtgtttctcagaaaactgacaagccgggagaccgccctgatggtcatcggaatggctatgacaaccaccctttccattccgcacgacctgatggagctcatcgacggcatctctctggggctcattctgcttaagatcgtgacacagttcgataacacgcaagttggaaccctggccctcagcctgacatttattcgctccaccatgagcctggtgatggcgtggagaacaatcatggctgtccttttcgtggtcaccctgattcccctctgtcggacgtcttgcctgcagaaacagtcccattgggtggaaatcacagccctcattctgggcgcccaagctcttcctgtttatctgatgaccctcatgaagggggccagcagacgctcttggcccctgaatgagggaatcatggctgtgggcctggtctcccttctgggcagcgccctcctgaaaaacgacgtgcctctcgcggggcccatggttgccggaggcctgcttctggctgcctacgtgatgtctgggtccagcgctgatctgtccctcgaaaaggccgccaatgtccagtgggacgagatggctgatatcaccggaagctctcctattatcgaagtgaagcaggacgaggatggcagcttttccattcgggacgtggaggaaacaaacatgatcaccctgcttgttaaactggcgctcattacagtctctgggctgtaccccctcgccatcccgatcacgatgaccctgtggtatatgtggcaggtgaagacacaaagaagcggagctctttgggatgtgccttcccccgccgccacccagaaagctgccctgtctgagggcgtctaccgcattatgcagcggggcctgttcgggaagacacaggtgggagttggcatccacatggaaggggtgttccacaccatgtggcatgtcacgagaggaagcgtgatttgtcacgagaccggccgcctcgaaccttcctgggcggacgttcggaatgatatgatctcttatgggggaggctggagactgggcgacaaatgggatcgcgaggaggacgtgcaagtccttgctattgaacccgggaagaacccgaagcatgtgcagacaaaacctggactgtttaagaccctcacaggcgagatcggggccgttaccctggacttcaaacccggaacaagcggctcccctatcattaatcggaaggggaaagtgatcggcctctacggaaacggcgtcgtgacgaagagcggggattatgtgtctgccattacccaggctgaaagaatcggagagcccgactacgaggtcgatgaagacatttttcggaaaaagcgcctgacaatcatggatcttcaccccggcgccgggaagaccaaaagaattctgccttccatcgttcgggaggcgctgaagcgcagactccggaccctgatccttgctccgacaagagtggtggccgccgaaatggaggaagctctgcgcggactccccattcggtatcagacgcctgccgtcaaaagcgagcataccggcagagagatcgtggacctgatgtgccacgctacattcaccacacgcctcctgtcttccacccgggttcccaattacaaccttattgtgatggatgaagcccactttacggaccctagctccgtcgcggccagagggtacatctctacacgcgtggagatgggcgaagctgccgctattttcatgaccgccaccccccctggagccacagatccgtttccccaaagcaattcccctatcgaggacatcgaacgggagattcccgagagaagctggaacaccggcttcgattggatcacagactatcaggggaagaccgtttggtttgtgccttctattaaagctggaaatgacatcgcgaactgcctgcgcaagtccggcaagaaagtcattcagctgagcagaaagacgttcgatacagaataccccaaaaccaagctcacagactgggattttgtggtcaccacggacatctctgagatgggggccaacttccgggctggacgcgtgatcgatccgagacggtgtctgaaacctgttattcttaccgacggccccgaacgcgtgatcctggccgggcccattcctgtgacacccgccagcgctgcccaaagacggggcagaatcggacgcaatcctgcgcaggaggatgaccagtatgtcttctccggcgatccgctcaagaacgacgaagatcatgctcactggaccgaggccaagatgctgctggacaatatttacacacccgaggggatcattcctaccctctttggacccgaacgggagaaaacacaggccatcgatggcgaattcagacttcgcggggagcaacggaagacctttgttgagctgatgagacggggagacctgcctgtgtggctctcttataaagtggctagcgccggcatctcctacaaggaccgcgaatggtgcttcacgggcgagagaaacaatcagattctggaagagaacatggaagtcgagatctggacacgggagggggaaaaaaagaagcttcgccccaaatggctggatgcgagagtgtatgccgacccgatggctctcaaggattttaaagagttcgcctctggacggaagagcattaccctggacatcctgaccgaaattgcttccctccctacataccttagctctcgcgccaaactggctctggataatatcgttatgctccataccacagagagaggcgggcgggcctaccagcacgcgctgaacgaacttcccgagtccctggagacgctcatgctggtggccctgctcggagctatgaccgccggcatctttcttttctttatgcaggggaagggaattggcaagctgagcatgggcctgatcacaattgctgtcgcctccgggctcctgtgggtggccgaaatccaacctcagtggattgctgcgtctatcatccttgagttctttctgatggtcctcctgattcccgaacctgagaaacagcgcaccccccaggacaatcaactgatctatgtgattctcacaatccttaccattatcggactgattgccgctaacgaaatgggcctgatcgagaagacgaaaaccgatttcgggttttaccaggttaagacagagaccacaatcctcgacgtggatctgagaccggccagcgcctggaccctttatgctgtcgccacgacaattctgacccctatgctccggcacacaatcgaaaatacctccgcgaacctgtctctggccgctattgccaatcaggctgccgtgctcatgggacttggcaaagggtggcccctgcatagaatggacctgggagttcccctcctggcgatgggctgttacagccaggtgaaccctaccacacttacggcctccctggtcatgctcctggtgcactatgctatcattggcccggggctgcaagccaaggctacccgcgaggcccagaaacggacagctgccggaatcatgaagaatcccaccgtggatggcatcacagttattgacctcgaacctatcagctacgatcccaagttcgagaaacagcttgggcaagtcatgctgctggtgctctgcgcgggacagctgcttctgatgagaaccacgtgggccttctgtgaggtgctcacactggctaccggccctattctgaccctctgggaagggaaccccggacgcttttggaacacaaccatcgccgtctctacagctaatattttccggggctcctatcttgccggcgccgggctggcgtttagcctgatcaagaacgctcagacgcctagacgcggaaccggcacagccggggagaccctcggagaaaaatggaagcggcagctgaattctcttgacagaaaagagttcgaagagtacaagcgctccggcatcctggaggttgaccggacagaagctaagagcgccctcaaagatgggtctaagattaaacatgccgtgagcagaggatcctctaagatccgctggattgtggagcggggcatggtcaaaccgaagggcaaggtggttgacctggggtgcggaagaggcgggtggagctactatatggctaccctgaaaaacgtgacggaagtcaagggatacaccaaaggcgggcccggacacgaggaacctatccccatggccacatatggctggaatctcgtgaagcttcattccggcgttgatgtgttttacaaacctaccgagcaagtcgacacactgctgtgtgatattggggagagctcctctaaccccaccatcgaagagggacgcacactcagagtgctgaagatggtggaaccgtggcttagctccaagcctgagttctgcattaaagtcctgaatccctatatgcccaccgttatcgaagagctcgagaagctgcagcggaaacacggcgggaacctggtgcgctgtcctctctctagaaatagcacgcacgaaatgtactgggtgtccggagcgtctggcaacatcgtcagctccgtgaatacaaccagcaagatgcttctgaaccggtttaccacaagacatcggaaacccacgtatgagaaggacgttgatctgggggccggaacccgctctgtgtccacagaaattgagaaacctgacatgaccatcattggcagacggctccagcgcctgcaggaggaacacaaggagacatggcattacgatcaagaaaatccgtacagaacctgggcttatcacggcagctacgaggccccctctacagggtccgctagctctatggtcaacggagtggttaagcttctgaccaaaccttgggacgtgatccccatggtcacgcagctcgccatgaccgatacaacccctttcggccagcagcgggtgtttaaggaaaaagttgacacacgcaccccccaaccgaagcctgggacgagaatggtgatgacaaccacagcgaattggctgtgggccctgctcggaaaaaagaagaacccccggctgtgcacccgcgaggagttcatttccaaagtcagaagcaatgctgccatcggcgctgtgtttcaggaagagcaggggtggacgtccgccagcgaagctgtcaacgactctcggttctgggagcttgtggataaggaacgcgccctgcaccaagagggcaaatgtgagagctgcgtttataacatgatgggaaagagagaaaaaaagctcggcgagtttgggcgggcgaagggatcccgcgccatctggtacatgtggctgggcgctagattccttgaattcgaggccctggggtttctcaatgaagaccattggttcggacgggagaactcttggagcggcgtggagggggaaggcctgcacagactgggatatattctcgaggaaatcgataaaaaggacggcgatctgatgtacgctgacgataccgccgggtgggacacacgcattaccgaggatgaccttcagaatgaggaactgatcacagagcagatggcccctcatcacaaaattctcgcgaaggctatctttaaactgacctatcagaacaaggtcgtgaaggtgcttcggcccacacctagaggagccgttatggatatcatttcccgcaaagaccaacggggctctgggcaggtgggaacctacggcctgaatacgttcacaaacatggaagtccagctcatcagacagatggaggccgaaggggtgattacccaagatgacatgcagaatcccaagggcctgaaagagcgcgttgagaagtggctgcgggaatgcggagtggacagactcaaacgcatggctatcagcggcgatgactgtgtcgtgaagccgctggatgagcggtttgggacctcccttctgttcctcaacgacatgggaaaagtcagaaaggatattcctcagtgggaaccctctaagggctggaaaaattggcaggaggtgcccttttgcagccatcacttccacaagatctttatgaaagacgggcgctccctggttgtgccttgtcggaaccaagatgaacttatcggaagagcccggattagccagggcgctgggtggtctctgagagagacagcctgcctcggcaaggcgtacgcccagatgtggtccctgatgtatttccatcgccgggacctgagactcgctagcatggccatctgttctgctgtcccgaccgagtggtttcccacatcccgcacgacctggagcattcacgcccatcaccagtggatgacaaccgaagatatgctgaaagtgtggaatagagtttggatcgaggacaaccctaatatgattgataagacacccgtgcactcctgggaagacatcccttaccttggaaagcgggaggacctgtggtgcggctctctcattgggctgagctcccgcgcgacctgggccaaaaacatccatacggctatcacccaagtcagaaatcttattggaaaggaagagtatgtggattacatgagcgtgatgaaacggtattctgccccctccgagagcgaaggcgttctgtga

SEQ ID NO: 20957 - RNA, 9867 nt, synthetic construct
  misc_feature 1..9867: note = derived and/or modified CDS sequence (opt5) from DENV-4__KP188564__SS-prME
  source 1..9867: mol_type = other RNA
agcaccatcacactgctctgcctgattcccacggtgatggccttccacctttccaccagagacggcgagcctctgatgatcgtcgctaagcatgaacgggggcgcccgctcctgtttaaaacaaccgagggaattaacaagtgtacacttatcgccatggatctgggcgaaatgtgcgaggacaccgttacatacaaatgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggatccttagaaatcctggcttcgctctgctcgccggctttatggcttacatgatcgggcagacaggaattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatcgcccaggggaagcctaccctggattttgaactgacaaagacgaccgctaaagaggttgccctcctgcggacatactgtattgaagctcttatcagcaatattaccacagccacccgctgcccgacgcaaggagagccctatctgaaggaggaacaggaccagcagtacatctgtagacgggatgtggtggaccgcggctgggggaacggatgcggcctcttcgggaaaggaggcgtcgtgacatgcgcgaagttttcttgttccggcaaaattaccgggaatctggttcaaatcgagaaccttgaatataccgtggtcgtgacagttcataatggagatacccacgccgtgggcaacgacacaagcaatcacggggtcacggctaccatcacacctagatctccctccgtggaggtcaagctgcctgattacggagaactcaccctggactgcgagccccggagcggcattgacttcaacgagatgatcctgatgaagatgaaaaagaaaacatggctcgtgcataagcagtggtttctggatcttccgctgccttggaccacgggggccgacacctctgaagttcactggaattacaaagagagaatggtgacattcaaggtcccccatgctaaacgccaggatgtgaccgttctcggctcccaggaaggagccatgcacagcgccctggctggcgcgacagaggtggactccggggatggaaaccacatgtttgccggccatcttaagtgtaaggtccggatggaaaaactgagaattaaggggatgtcttataccatgtgcagcggaaaattctccatcgacaaggagatggctgagacgcaacacggcacaaccgtggtgaaaattaagtacgaaggggccggcgccccttgtaaggttcccatcgagatccgcgatgtcaataaagaaaaggtggtgggacgggtcattagcgctacacccctcgccgagaacaccaactctgtgaccaatatcgagctggaacctccgttcggcgactcctatattgttatcggggtgggaaacagcgcgctgacactccattggtttagaaaaggctctagcattgggaagatgttcgagtccacgtaccgcggagctaaacggatggccatcctgggcgaaaccgcctgggattttgggtctgtcggcggacttttcacaagcctgggcaaggctgtgcaccaggtttttgggtccgtgtataccacaatgttcggaggcgtcagctggatgatcagaattctcatcgggtttctggtgctgtggattggaaccaattctcgcaacacgtccatggccatgacatgcatcgctgttggcgggattacccttttcctcggctttaccgtgcaggccgacatgggatgtgtcgtgagctggtctggccgggagctgaagtgcgggtccggaatcttcgtggtcgataatgttcatacatggaccgaacaatacaaatttcagcccgagagccctgcgagactggcctccgctattctcaacgcccacaaggacggcgtgtgtgggatccgctctacaacgcggctggagaatgtgatgtggaaacagatcaccaacgaacttaattatgtcctgtgggagggaggccacgacctcacagtggttgctggcgatgtgaagggggtcctgaccaaaggaaagagagccctgacaccccctgcgagcgaccttaagtactcctggaaaacctggggcaaggccaaaattttcacgcccgaagctcggaactctacctttctcatcgatgggccggacacaagcgagtgccctaatgaacgcagagcctggaactccttcgaggtggaggattacggattcggcatgtttaccacaaatatttggatgaagttccgggaagggagctctgaggtttgtgaccatagactgatgtccgctgccatcaaagatcagaaggccgtgcacgctgacatgggatattggattgaaagctctaaaaaccaaacctggcagatcgagcgcgcgtccctgatcgaagtcaagacatgcctctggcccaagacccatacgctgtggagcaatggcgtgcttgagtctcagatgctgattcctaaaagctacgccggccccttttcccagcacaactatcggcaagggtacgctacacagaccgttggaccttggcacctcggcaagctggagatcgatttcggggaatgccccggaaccacagtgaccattcaggagaactgtgaccatagaggcccgagcctgcgcacgacaaccgcctctgggaaacttgtcacacagtggtgctgtagatcctgcaccatgcctcccctccggtttctgggagaagatggctgttggtatggcatggagatccgccccctgagcgagaaggaagagaatatggtgaaatcccaagtgacagccgggcagggaacctctgaaacgttcagcatgggcctcctgtgccttaccctgtttgtcgaggaatgtctcagacggcgcgttacaagaaagcacatgattctggctgtggtgatcaccctgtgcgccatcattcttgggggactcacatggatggacctgctgcgggcgctcatcatgctgggcgataccatgtccgggcgcattggaggccagacgcatcttgctatcatggccgtcttcaagatgtctcctggctacgtgctgggggtttttctcagaaaactgacaagccgggagaccgccctgatggtgattggaatggctatgacaaccaccctttccatcccgcacgacctgatggagctcatcgacggcatttctctggggctcatcctgcttaagattgtcacacagttcgataacacgcaagtgggaaccctggccctcagcctgacatttatccgctccaccatgagcctggttatggcgtggagaacaattatggctgtgcttttcgtcgtgaccctgatccccctctgtcggacgtcttgcctgcagaaacagtcccattgggtcgaaattacagccctcatcctgggcgcccaagctcttcctgtgtatctgatgaccctcatgaagggggccagcagacgctcttggcccctgaatgagggaatcatggctgttggcctggtgtcccttctgggcagcgccctcctgaaaaacgacgtccctctcgcggggcccatggtggccggaggcctgcttctggctgcctacgttatgtctgggtccagcgctgatctgtccctcgaaaaggccgccaatgtgcagtgggacgagatggctgatattaccggaagctctcctatcattgaagtcaagcaggacgaggatggcagcttttccatccgggacgtggaggaaacaaacatgattaccctgcttgtgaaactggcgctcatcacagtttctgggctgtaccccctcgccatcccgattacgatgaccctgtggtatatgtggcaggtcaagacacaaagaagcggagctctttgggatgtgccttcccccgccgccacccagaaagctgccctgtctgagggcgtgtaccgcatcatgcagcggggcctgttcgggaagacacaggtcggagtgggcattcacatggaaggggttttccacaccatgtggcatgtgacgagaggaagcgtcatctgtcacgagaccggccgcctcgaaccttcctgggcggacgtgcggaatgatatgatttcttatgggggaggctggagactgggcgacaaatgggataaggaggaggacgttcaagtgcttgctatcgaacccgggaagaacccgaaacatgtccagacaaagcctggactgtttaaaaccctcacaggcgagatcggggccgtgaccctggacttcaagcccggaacaagcggctcccctattatcaatcgcaaagggaaggttattggcctctacggaaacggcgtggtcacgaaaagcggggattatgtgtctgccatcacccaggctgaacggattggagagcccgactacgaggtggatgaagacatctttagaaagaagcggctgacaattatggatcttcaccccggcgccgggaaaaccaagcgcatcctgccttccatcgtcagagaggcgctgaaacggcgcctcagaaccctgattcttgctccgacacgggttgtggccgccgaaatggaggaagctctgagaggactccccatccgctatcagacgcctgccgtgaagagcgagcataccggccgggagattgtcgacctgatgtgccacgctacattcaccacaagactcctgtcttccacccgcgtgcccaattacaaccttatcgttatggatgaagcccactttacggaccctagctccgtggcggcccgggggtacatttctacaagagtcgagatgggcgaagctgccgctatcttcatgaccgccaccccccctggagccacagatccgtttccccaaagcaattcccctatcgaggacattgaacgcgagatccccgagcggagctggaacaccggcttcgattggattacagactatcaggggaaaaccgtgtggtttgttccttctatcaaggctggaaatgacattgcgaactgcctgagaaagtccggcaaaaaggtgatccagctgagccgcaaaacgttcgatacagaataccccaagaccaaactcacagactgggattttgtcgtgaccacggacatctctgagatgggggccaacttcagagctggacgggtcattgatccgcgcagatgtctgaagcctgtgatccttaccgacggccccgaacgggttattctggccgggcccatccctgtgacacccgccagcgctgcccaacgcagaggccggattggaagaaatcctgcgcaggaggatgaccagtatgtgttctccggcgatccgctcaagaacgacgaagatcatgctcactggaccgaggccaaaatgctgctggacaatatctacacacccgaggggattatccctaccctctttggacccgaacgcgagaagacacaggccatcgatggcgaattccggcttagaggggagcaacgcaaaacctttgtcgagctgatgcggagaggagacctgcctgtttggctctcttataaggtggctagcgccggcatttcctacaaagaccgggaatggtgcttcacgggcgagcgcaacaatcagatcctggaagagaacatggaagtggagatttggacaagagagggggaaaagaagaaacttcggcccaagtggctggatgcgcgcgtctatgccgacccgatggctctcaaagattttaaggagttcgcctctggaagaaaaagcatcaccctggacattctgaccgaaatcgcttccctccctacataccttagctctcgggccaagctggctctggataatatcgtgatgctccataccacagagcgcggcgggagagcctaccagcacgcgctgaacgaacttcccgagtccctggagacgctcatgctggttgccctgctcggagctatgaccgccggcatttttcttttctttatgcaggggaagggaatcggcaaactgagcatgggcctgattacaatcgctgtggcctccgggctcctgtgggtcgccgaaattcaacctcagtggatcgctgcgtctatcattcttgagttctttctgatggtgctcctgatccccgaacctgagaagcagcggaccccccaggacaatcaactgatttatgtcatcctcacaattcttaccatcattggactgatcgccgctaacgaaatgggcctgatcgagaaaacgaagaccgatttcgggttttaccaggtgaaaacagagaccacaattctcgacgttgatctgcgcccggccagcgcctggaccctttatgctgtggccacgacaatcctgacccctatgctcagacacacaattgaaaatacctccgcgaacctgtctctggccgctatcgccaatcaggctgccgtcctcatgggacttggcaaggggtggcccctgcatcggatggacctgggagtgcccctcctggcgatgggctgttacagccaggttaaccctaccacacttacggcctccctggtgatgctcctggtccactatgctattatcggcccggggctgcaagccaaagctaccagagaggcccagaagcgcacagctgccggaatcatgaagaatcccaccgtggatggcattacagtgatcgacctcgaacctattagctacgatcccaaattcgagaagcagcttgggcaagttatgctgctggtcctctgcgcgggacagctgcttctgatgcggaccacgtgggccttctgtgaggtgctcacactggctaccggccctaccctgacactctgggaagggaaccccggaagattttggaacaccacaatcgccgtgtctacggctaatattttccgcggctcctatcttgccggcgccgggctggcgtttagcctgatcaaaaacgctcagacccctcggagaggaacaggcaccgccggggagacactcggagaaaagtggaaacgccagctgaattctcttgaccggaaggagttcgaagagtacaagagatccggcatcctggaggtcgaccgcaccgaagctaaaagcgccctcaaggatgggtctaaaattaagcatgccgttagccggggatcctctaaaatcagatggattgtggagcgcggcatggtgaagccgaagggcaaagtcgtggacctggggtgcggacggggcgggtggagctactatatggctacgctgaagaacgttaccgaagtgaaaggatacacaaagggcgggcccggacacgaggaacctatccccatggccacctatggctggaatctcgtcaaacttcattccggcgtggatgttttttacaagcctacagagcaagtggacaccctgctgtgtgatattggggagagctcctctaaccccacaatcgaagagggaagaaccctccgcgtcctgaagatggtggaaccgtggcttagctccaaacctgagttctgcattaaggtgctgaatccctatatgcccacggtcatcgaagagctcgagaaactgcagagaaagcacggcgggaacctggttcggtgtcctctctctcgcaatagcacacacgaaatgtactgggtgtccggagcgtctggcaacatcgtgagctccgtcaataccaccagcaaaatgcttctgaacagatttacaacgcggcatagaaagcccacctatgagaaagacgtggatctgggggccggaacacggtctgtttccaccgaaacagagaagcctgacatgaccattatcggccgcagactccagcggctgcaggaggaacacaaggagacatggcattacgatcaagaaaatccgtaccgcacctgggcttatcacggcagctacgaggccccctctacggggtccgctagctctatggtgaacggagtcgtgaaacttctgaccaagccttgggacgttattcccatggtgacacagctcgccatgaccgatacaacccctttcggccagcagagagtctttaaagaaaaggtggacacgcggacaccccaaccgaaacctgggacccgcatggttatgacaaccacggcgaattggctgtgggccctgctcggaaagaagaaaaaccccagactgtgcacccgggaggagttcatctccaaggtgcgcagcaatgctgccattggcgctgtctttcaggaagagcaggggtggacatccgccaacgaagctgtgaacgacagcagattctgggagcttgtcgataaagaacgggccctgcaccaagagggcaagtgtgagtcttgcgtgtataatatgatgggaaaacgcgaaaagaagctcggcgagtttgggagagcgaaaggaagccgggccatctggtacatgtggctgggcgctcgcttccttgaattcgaggccctggggtttctcaacgaagaccattggttcggaagagagaattcctggtctggcgttgagggggaaggcctgcaccggctgggatatatcctcgaggaaattgataagaaagacggcgatctgatgtacgctgacgataccgccgggtgggacacaagaatcaccgaggatgaccttcagaacgaggaactgattacagagcagatggcccctcatcacaagatcctcgcgaaagctatttttaagctgacctatcagaataaggtggtcaaagtgcttcgccccacgcctcggggagccgtgatggatatcatcagcagaaaggaccaacgcggctccgggcaggttggaacatacggcctgaacaccttcaccaatatggaagtgcagctcattcggcagatggaggccgaaggggtcatcacacaagatgacatgcagaaccccaaaggcctgaaggagagagtggagaaatggctgcgcgaatgcggagttgaccggctcaagagaatggctatttctggcgatgactgtgtggtcaaaccgctggatgagcgctttgggaccagccttctgttcctcaatgacatgggaaaggtgcggaaggatatccctcagtgggaaccctccaaaggctggaagaactggcaggaggtccccttttgctctcatcacttccacaaaatttttatgaaggacgggagaagcctggtggttccttgtcgcaatcaagatgaacttatcggacgggccagaatctcccagggcgctgggtggagcctgcgggagacagcctgcctcggcaaagcgtacgcccagatgtggtctctgatgtatttccatagacgcgacctgcggctcgcttccatggccatttgtagcgctgtgccgacggagtggtttcccacctctagaacaacctggtccatccacgcccatcaccagtggatgacaaccgaagatatgctgaaggtctggaaccgcgtgtggattgaggacaatcctaacatgatcgataagacgcccgttcacagctgggaagacattccttaccttggaaaaagagaggacctgtggtgcggctccctcatcgggctgtctagccgggcgacctgggccaagaatattcatacagctatcacccaagtgcgcaaccttatcggaaaagaagagtatgtcgattacatgcccgtgatgaagagatattccgcccctagcgagtctgaaggcgtgctgtga

SEQ ID NO: 20958 - RNA, 9867 nt, synthetic construct
  misc_feature 1..9867: note = derived and/or modified CDS sequence (opt5) from DENV-4__JN983813__SS-prME
  source 1..9867: mol_type = other RNA
agcaccatcacactgctctgcctgattcccacggtgatggccttccacctttccaccagagacggcgagcctctgatgatcgtcgctaagcatgaacgggggcgcccgctcctgtttaaaacaaccgagggaattaacaagtgtacacttatcgccatggatctgggcgaaatgtgcgaggacaccgttacatacaaatgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggatccttagaaatcctggcttcgctctgctcgccggctttatggcttacatgatcgggcagacaggaattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctcttattagcaatatcaccacagccacccgctgcccgacgcaaggagagccctatctgaaggaggaacaggaccagcagtacatttgtagacgggatgtggtggaccgcggctgggggaacggatgcggcctcttcgggaaaggaggcgtcgtgacatgcgcgaagttttcttgttccggcaaaatcaccgggaatctggttcaaattgagaaccttgaatataccgtggtcgtgacagttcataatggagatacccacgccgtgggcaacgacacaagcaatcacggggtcacggctaccatcacacctagatctccctccgtggaggtcaagctgcctgattacggagaactcaccctggactgcgagccccggagcggcatcgacttcaacgagatgattctgatgaagatgaaaaagaaaacatggctcgtgcataagcagtggtttctggatcttccgctgccttggaccacgggggccgacacctctgaagttcactggaattacaaagagagaatggtgacattcaaggtcccccatgctaaacgccaggatgtgaccgttctcggctcccaggaaggagccatgcacagcgccctggctggcgcgacagaggtggactccggggatggaaaccacatgtttgccggccatcttaagtgtaaggtccggatggaaaaactgagaatcaaggggatgtcttataccatgtgcagcggaaaattctccattgacaaggagatggctgagacgcaacacggcacaaccgtggtgaaagttaagtacgaaggggccggcgccccttgtaaggtccccatcgagattcgcgatgtgaataaagaaaaggtggtcggacgggtgatcagcgctacacccctcgccgagaacaccaactctgttaccaatatcgagctggaacctccgttcggcgactcctatattgtgatcggggtcggaaacagcgcgctgacactccattggtttagaaaaggctctagcattgggaagatgttcgagtccacgtaccgcggagctaaacggatggccatcctgggcgaaaccgcctgggattttgggtctgtgggcggacttttcacaagcctgggcaaggctgttcaccaggtgtttgggtccgtctataccacaatgttcggaggcgtgagctggatgattagaatcctcatcgggtttctggttctgtggattggaaccaattctcgcaacacgtccatggccatgacatgcatcgctgtgggcgggattacccttttcctcggctttaccgtccaggccgacatgggatgtgtggtgagctggtctggccgggagctgaagtgcgggtccggaatcttcgtcgttgataatgtgcatacatggaccgaacaatacaaatttcagcccgagagccctgcgagactggcctccgctattctcaacgcccacaaggacggcgtgtgtgggatccgctctacaacgcggctggagaatgtcatgtggaaacagattaccaacgaacttaattatgtgctgtgggagggaggccacgacctcacagttgtggctggcgatgtcaagggggtgctgaccaaaggaaagagagccctgacaccccctgcgagcgaccttaagtactcctggaaaacctggggcaaggccaaaatcttcacgcccgaagctcggaactctacctttctcatcgatgggccggacacaagcgagtgccctaatgaacgcagagcctggaactccttcgaggttgaggattacggattcggcatgtttaccacaaatatttggatgaagttccgggaagggagctctgaggtgtgtgaccatagactgatgtccgctgccatcaaagatcagaaggccgtccacgctgacatgggatattggattgaaagctctaaaaaccaaacctggcagatcgagcgcgcgtccctgattgaagtgaagacatgcctctggcccaagacccatacgctgtggagcaatggcgttcttgagtctcagatgctgatccctaaaagctacgccggccccttttcccagcacaactatcggcaagggtacgctacacagaccgtgggaccttggcacctcggcaagctggagatcgatttcggggaatgccccggaaccacagtcaccattcaggagaactgtgaccatagaggcccgagcctgcgcacgacaaccgcctctgggaaacttgtgacacagtggtgctgtagatcctgcaccatgcctcccctccggtttctgggagaagatggctgttggtatggcatggagatccgccccctgagcgagaaggaagagaatatggtgaaatcccaagtcacagccgggcagggaacctctgaaacgttcagcatgggcctcctgtgccttaccctgtttgttgaggaatgtctcagacggcgcgtgacaagaaagcacatgattctggctgtggtcatcaccctgtgcgccattatccttgggggactcacatggatggacctgctgcgggcgctcatcatgctgggcgataccatgtccgggcgcattggaggccagacgcatcttgctatcatggccgtgttcaagatgtctcctggctacgttctgggggtgtttctcagaaaactgacaagccgggagaccgccctgatggtcattggaatggctatgacaaccaccctttccatcccgcacgacctgatggagctcattgacggcatctctctggggctcatcctgcttaagattgtgacacagttcgataacacgcaagttggaaccctggccctcagcctgacatttatccgctccaccatgagcctggtgatggcgtggagaacaattatggctgtccttttcgtggtcaccctgatccccctctgtcggacgtcttgcctgcagaaacagtcccattgggtggaaattacagccctcatcctgggcgcccaagctcttcctgtttatctgatgaccctcatgaagggggccagcagacgctcttggcccctgaatgagggaattatggctgtgggcctggtctcccttctgggcagcgccctcctgaaaaacgacgtgcctctcgcggggcccatggttgccggaggcctgcttctggctgcctacgtgatgtctgggtccagcgctgatctgtccctcgaaaaggccgccaatgtccagtgggacgagatggctgatatcaccggaagctctcctatcattgaagtgaagcaggacgaggatggcagcttttccatccgggacgtggaggaaacaaacatgattaccctgcttgttaaactggcgctcatcacagtctctgggctgtaccccctcgccattccgatcacgatgaccctgtggtatatgtggcaggtgaagacacaaagaagcggagctctttgggatgtgccttcccccgccgccacccagaaagctgccctgtctgagggcgtctaccgcatcatgcagcggggcctgttcgggaagacacaggtgggagttggcattcacatggaaggggtgttccacaccatgtggcatgtcacgagaggaagcgtgatctgtcacgagaccggccgcctcgaaccttcctgggcggacgttcggaatgatatgatttcttatgggggaggctggagactgggcgacaaatgggataaggaggaggacgtgcaagtccttgctatcgaacccgggaagaacccgaaacatgtgcagacaaagcctggactgtttaaaaccctcacaggcgagattggggccgttaccctggacttcaagcccggaacaagcggctcccctatcatcaatcgcaaagggaaggtgattggcctctacggaaacggcgtcgtgacgaaaagcggggattatatctctgccattacccaggctgaacggatcggagagcccgactacgaggtggatgaagacatttttagaaagaagcggctgacaatcatggatcttcaccccggcgccgggaaaaccaagcgcattctgccttccatcgtcagagaggcgctgaaacggcgcctcagaaccctgatccttgctccgacacgggttgtggccgccgaaatggaggaagctctgagaggactccccattcgctatcagacgcctgccgtgaagagcgagcataccggccgggagatcgtcgacctgatgtgccacgctacattcaccacaagactcctgtcttccacccgcgtgcccaattacaaccttattgttatggatgaagcccactttacggaccctagctccgtggcggcccgggggtacatctctacaagagtcgagatgggcgaagctgccgctattttcatgaccgccaccccccctggagccacagatccgtttccccaaagcaattcccctatcgaggacatcgaacgcgagattcccgagcggagctggaacaccggcttcgattggatcacagactatcaggggaaaaccgtgtggtttgttccttctattaaggctggaaatgacatcgcgaactgcctgagaaagtccggcaaaaaggtgattcagctgagccgcaaaacgttcgatacagaataccccaagaccaaactcacagactgggattttgtcgtgaccacggacatctctgagatgggggccaacttcagagctggacgggtcatcgatccgcgcagatgtctgaagcctgtgattcttaccgacggccccgaacgggttatcctggccgggcccattcctgtgacacccgccagcgctgcccaacgcagaggccggatcggaagaaatcctgcgcaggaggatgaccagtatgtgttctccggcgatccgctcaagaacgacgaagatcatgctcactggaccgaggccaaaatgctgctggacaatatttacacacccgaggggatcattcctaccctctttggacccgaacgcgagaagacacaggccatcgatggcgaattccggcttagaggggagcaacgcaaaacctttgtcgagctgatgcggagaggagacctgcctgtttggctctcttataaggtggctagcgccggcatctcctacaaagaccgggaatggtgcttcacgggcgagcgcaacaatcagattctggaagagaacatggaagtggagatctggacaagagagggggaaaagaagaaacttcggcccaagtggctggatgcgcgcgtctatgccgacccgatggctctcaaagattttaaggagttcgcctctggaagaaaaagcattaccctggacatcctgaccgaaattgcttccctccctacataccttagctctcgggccaagctggctctggataatatcgtgatgctccataccacagagcgcggcgggagagcctaccagcacgcgctgaacgaacttcccgagtccctggagacgctcatgctggttgccctgctcggagctatgaccgccggcatctttcttttctttatgcaggggaagggaattggcaaactgagcatgggcctgatcacaattgctgtggcctccgggctcctgtgggtcgccgaaatccaacctcagtggattgctgcgtctatcatccttgagttctttctgatggtgctcctgattcccgaacctgagaagcagcggaccccccaggacaatcaactgatctatgtcattctcacaatccttaccattatcggactgattgccgctaacgaaatgggcctgatcgagaaaacgaagaccgatttcgggttttaccaggtgaaaacagagaccacaatcctcgacgttgatctgcgcccggccagcgcctggaccctttatgctgtggccacgacaattctgacccctatgctcagacacacaatcgaaaatacctccgcgaacctgtctctggccgctattgccaatcaggctgccgtcctcatgggacttggcaaggggtggcccctgcatcggatggacctgggagtgcccctcctggcgatgggctgttacagccaggttaaccctaccacacttacggcctccctggtgatgctcctggtccactatgctatcattggcccggggctgcaagccaaagctaccagagaggcccagaagcgcacagctgccggaatcatgaagaatcccaccgtggatggcatcacagtgattgacctcgaacctatcagctacgatcccaaattcgagaagcagcttgggcaagttatgctgctggtcctctgcgcgggacagctgcttctgatgcggaccacgtgggccttctgtgaggtgctcacactggctaccggccctattctgaccctctgggaagggaaccccggaagattttggaacacaaccatcgccgtgtctacagctaatattttccgcggctcctatcttgccggcgccgggctggcgtttagcctgatcaaaaacgctcagacgcctcggagaggaaccggcacagccggggagaccctcggagaaaagtggaaacgccagctgaattctcttgaccggaaggagttcgaagagtacaagagatccggcatcctggaggtcgaccgcacagaagctaaaagcgccctcaaggatgggtctaaaattaagcatgccgttagccggggatcctctaaaatcagatggattgtggagcgcggcatggtgaagccgaagggcaaagtcgtggacctggggtgcggacggggcgggtggagctactatatggctaccctgaagaacgttacggaagtgaaaggatacaccaagggcgggcccggacacgaggaacctatccccatggccacatatggctggaatctcgtcaaacttcattccggcgtggatgttttttacaagcctaccgagcaagtggacacactgctgtgtgatattggggagagctcctctaaccccaccatcgaagagggaagaacactccgcgtcctgaagatggtggaaccgtggcttagctccaaacctgagttctgcattaaggtgctgaatccctatatgcccaccgtcatcgaagagctcgagaaactgcagagaaagcacggcgggaacctggttcggtgtcctctctctcgcaatagcacgcacgaaatgtactgggtgtccggagcgtctggcaacatcgtgagctccgtcaatacaaccagcaaaatgcttctgaacagatttaccacacggcatagaaagcccacgtatgagaaagacgtggatctgggggccggaacccggtctgtttccacagaaaccgagaagcctgacatgacaattatcggccgcagactccagcggctgcaggaggaacacaaggagacctggcattacgatcaagaaaatccgtaccgcacatgggcttatcacggcagctacgaggccccctctaccgggtccgctagctctatggtgaacggagtcgtgaaacttctgacgaagccttgggacgttattcccatggtgacccagctcgccatgacagataccacacctttcggccagcagagagtctttaaagaaaaggtggacacccggacgccccaaccgaaacctgggacacgcatggttatgaccacaaccgcgaattggctgtgggccctgctcggaaagaagaaaaaccccagactgtgcacgcgggaggagttcatctccaaggtgcgcagcaatgctgccattggcgctgtctttcaggaagagcaggggtggacctccgccagcgaagctgtgaacgactctagattctgggagcttgtcgataaagaacgggccctgcaccaagagggcaagtgtgagagctgcgtgtataacatgatgggaaaacgcgaaaagaagctcggcgagtttgggagagcgaaaggatcccgggccatctggtacatgtggctgggcgctcgcttccttgaattcgaggccctggggtttctcaatgaagaccattggttcggaagagagaactcttggagcggcgttgagggggaaggcctgcaccggctgggatatatcctcgaggaaattgataagaaagacggcgatctgatgtacgctgacgatacagccgggtgggacaccagaatcacagaggatgaccttcagaatgaggaactgattaccgagcagatggcccctcatcacaagatcctcgcgaaagctatttttaagctgacatatcagaacaaggtggtcaaagtgcttcgccccacccctcggggagccgtgatggatatcatctccagaaaggaccaacgcggctctgggcaggttggaacgtacggcctgaatacattcaccaacatggaagtgcagctcattcggcagatggaggccgaaggggtcatcacccaagatgacatgcagaatcccaaaggcctgaaggagagagtggagaaatggctgcgcgaatgcggagttgaccggctcaagagaatggctattagcggcgatgactgtgtggtcaaaccgctggatgagcgctttgggacatcccttctgttcctcaacgacatgggaaaggtgcggaaggatatccctcagtgggaaccctctaaaggctggaagaattggcaggaggtccccttttgcagccatcacttccacaaaatttttatgaaggacgggagatccctggtggttccttgtcgcaaccaagatgaacttatcggacgggccagaatcagccagggcgctgggtggtctctgcgggagaccgcctgcctcggcaaagcgtacgcccagatgtggtccctgatgtatttccatagacgcgacctgcggctcgctagcatggccatttgttctgctgtgccgacagagtggtttcccacgtccagaaccacatggagcatccacgcccatcaccagtggatgaccacagaagatatgctgaaggtctggaatcgcgtgtggattgaggacaaccctaatatgatcgataagacccccgttcactcctgggaagacattccttaccttggaaaaagagaggacctgtggtgcggctctctcatcgggctgagctcccgggcgacgtgggccaagaacattcataccgctatcacacaagtgcgcaatcttatcggaaaagaagagtatgtcgattacatgcccgtgatgaagagatatagcgccccttctgagtccgaaggcgtgctgtga

SEQ ID NO: 20959 - RNA, 9867 nt, synthetic construct
  misc_feature 1..9867: note = derived and/or modified CDS sequence (opt5) from DENV-4__KF041260__SS-prME
  source 1..9867: mol_type = other RNA
agcaccatcacactgctctgcctgattcccacggtgatggccttccacctttccaccagagacggcgagcctctgatgatcgtcgctaagcatgaacgggggcgcccgctcctgtttaaaacaaccgagggaattaacaagtgtacacttatcgccatggatctgggcgaaatgtgcgaggacaccgttacatacaaatgtcccctcctggtgaataccgaacctgaggatattgactgctggtgtaacctgacgtctgcgtgggtgatgtatgggacctgcacacagagcggagagagacggcgcgaaaagagatccgtcgctctcaccccccactctggcatggggctggagacacgggccgaaacctggatgagctccgagggagcctggaaacatgctcaacgcgtggagtcttggatccttagaaatcctggcttcgccctgctcgctggctttatggcctacatgatcgggcagacgggaattcagcggacagttttctttatcctgatgatgcttgtggcgcccagctatggcatgcgctgtgtcggggtgggaaacagagatttcgttgaaggcgtgtccgggggagcctgggtcgacctggtgctcgagcacggcggctgcgtgaccacaatggctcaggggaagcctaccctggattttgaactgattaagaccacagccaaagaggtcgctctcctgcggacgtactgtatcgaagccagcatttctaatatcaccacagcgacccgctgcccgacacaaggagagccctatcttaaggaggaacaggaccagcagtacatttgtagacgggatgttgtggaccgcggctgggggaacggatgcggcctgttcgggaaaggaggcgtggtcacctgcgccaagttttcctgtagcggcaaaatcacggggaatctcatccaaattgagaacctggaatatacagtggttgtgaccgtccataatggagatacccacgctgtgggcaacgacacatctaatcacggggttaccgccacagtgacgcctagatcccccagcgtcgaggtggaacttcctgattacggagagctgaccctcgactgcgagccccggtctggcatcgacttcaacgaaatgattctgatgaagatgaataagaaaacatggctggtccataagcagtggtttctcgatctgccgcttccttggaccgctggggccgacacatccgaggtgcactggaaccataaagaaagaatggttaccttcaaggtgccccacgccaaacgccaggatgtcacggtgctgggcagccaggagggagctatgcactccgcgctcaccggcgccacagaagttgactctggggatggaaatcatatgtttgctggccacctgaagtgtaaagtgcggatggagaagcttagaatcaaggggatgagctacaccatgtgctccggaaaattcagcattgacaaggagatggccgaaacacaacatggcaccacggtcgtgaaagtgaagtatgagggggccggcgctccttgtaaagttcccatcgaaatccgcgatgtcaacaaggagaaggtggtgggacggattatctcttccacacccttcgccgagaacaccaatagcgtcacaaacattgaactggagcctccgtttggcgactcttacatcgtgattggggttggagatagcgcgctcaccctgcactggttcagaaaaggctcctctatcgggaagatgtttgaaagcacctatcgcggagctaaacggatggccatcctgggcgagacagcctgggacttcgggtccgtgggcggactcctgacgagccttggcaaggctgtccatcaggtgtttgggtctgtttacaccacaatgttcggaggcgtgtcctggatggtcagaattctgatcgggtttctcgtgctgtggattggaaccaatagccgcaacacatctatggccatgtcctgcatcgctgttggcgggattaccctgttccttggctttacggtgcacgccgatatgggatgtgcggtcagctggtccggcaaagaactcaagtgcgggtctggaatcttcattatcgacaatgtgcacacatggaccgagcagtataagtttcaacccgagagccctgcccggctggcttccgccatcctgaacgctcataaagacggcgtgtgtgggattagatctaccacacgcctcgaaaatgtcatgtggaagcagatcaccaacgagctgaattacgttctttgggaaggaggccacgatctgacagtggtggccggcgacgtcaaaggggtgctcagcaagggaaaacgggcgctggccccccctgttaacgatctgaagtattcctggaagacgtggggcaaagctaagattttcacccccgagacaagaaatagcacctttcttatcgacgggccggatacatctgaatgccctaacgagcggcgcgcctggaatttcctcgaggtggaagactacggattcggcatgtttaccacgaacatttggatgaaattcagagaggggtccagcgaagtctgtgatcatcggctgatgtctgctgccatcaaggaccagaaagccgtgcacgctgatatgggatactggatcgagtccagcaagaatcagacctggcaaattgaaaaagcgtctctgatcgaggttaagacatgcctctggcccaagacccacacactgtggagcaacggcgtgcttgagtcccagatgctgattcctaaagcctatgctggcccctttagccagcataactacagacaggggtatgccacccaaacaatgggaccttggcacctcggcaagctggaaatcgacttcggggagtgccccggaaccacggtcacaattcaggaagattgtgaccatcgcggcccgtctctgcggaccaccacagcctccgggaaacttgtgacccagtggtgctgtagaagctgcacgatgcctcccctccgctttctgggagaggatggctgttggtacggcatggagatcagacccctgtccgaaaaggaggaaaatatggttaaatctcaggtgagcgctgggcaaggaacatccgagaccttctctatgggcctcctgtgccttacactgtttgtcgaagagtgtctccggcgcagagtgacccggaagcacatgatcctggtggtcgttacaaccctgtgcgccattatccttgggggactcacgtggatggacctgctgcgcgcgctcattatgctgggcaacaccatgagctccagaatggggggacagacacatcttgctatcatggccgtgttcaagatgtctcctggctatgtgctgggcatttttctccggaaactgaccagccgcgagacagccctgatggtcatcgggatggctatgaccacggtgctttccatcccgcacgacctgatggaattcattgatggaatcagcctcggcctgattctcctgaagatggttacacactttgacaatacccaggtggggacacttgccctgtctctcaccttcatcaaatccaccatgcccctggtcatggcgtggagaacaattatggctgtgctgtttgttgtgacgcttatccctctgtgtcggaccagctgcctccagaagcaatctcattgggtcgagattacagccctgatcctcggagcccaggctctgcccgtgtaccttatgaccctgatgaaaggcgcctccaagcgcagctggcctctcaacgaagggatcatggctgtcggactggtgtctctgcttggctccgccctgctcaagaatgatgttcccctggcgggccctatggtggccgggggactcctgcttgctgcctatgtcatgagcggctccagcgctgacctgtctctggagaaagccgccacagtgcagtgggatgaaatggctgacattaccgggagctcccccatcattgaggttaagcaagatgaggacggatctttcagcatcagagatgtggaagagacgaacatgattacactcctggtcaaacttgcgctgatcaccgtgtccggcctctacccgctggccatccctgtgaccatgacactctggtacatgtggcaggttaagacccagcggtctggggctctgtgggacgtccccagccctgccgccacacagaaagctacgcttaccgaaggagtgtatagaattatgcaacgcggcctgttcggcaagacacaggtgggggtcggaatccacatggagggcgtgtttcataccatgtggcacgttacacgggggtccgtgatttgtcatgaatctggaagactggagcccagctgggccgatgtcaagaatgacatgatctcctacggcgggggatggcgcctcggcgataaatgggacaaggaggaagacgtgcaggttctggcggtggagccgggcaaaaaccctaagcacgtccagaccaaacccgggcttttcaagacgctgaccggagaaattggcgctgtgacactcgattttaaacctgggaccagcggatctcccatcatcaatcggaagggcaaggttattgggctgtatggcaacggagtggtcacaaaatccggcgactacgtgagcgccatcacccaagccgagagaattggggagcccgattatgaagtggacgaggatatcttccgcaagaaacggctcacaattatggacctgcaccctggagctggcaagacgaaaagaatccttccgtctattgtccgcgaagccctgaagcggagactgcggaccctcatcctggcgcccacacgcgttgtggctgccgagatggaagaggcccttagagggctgcctatccggtaccagacccccgctgtgaagaccgagcatacaggacgcgaaattgtcgatctcatgtgccacgccacgtttaccacaagactgctctccagcacccgggtgcctaattataacctgatcgttatggacgaggctcatttcacagatccctcctctgtggccgcgagaggctacattagcacccgcgtcgaaatgggggaggccgctgccatctttatgacggctacacctccgggcaccaccgaccccttccctcagtccaatagccccattgaagatatcgagcgggagatccctgaaagatcttggaacacaggatttgactggattaccgactaccagggcaaaacagtgtggttcgttccctccatcaaggccgggaatgatattgccaactgccttcgcaaaagcggaaagaaagtggtccaactgtctcggaagacctttgacacggagtatccgaagacaaaactgaccgattgggacttcgtggtcacaaccgatatcagcgaaatgggcgctaacttcagagcggggcgcgtgattgaccctcggagatgtctcaagcccgttatcatcacggatggacccgagcgcgtgattctggccggccctatccccgtgacccctgcttccgccgcccagagacgggggcgcattggcagaaatccggctcaggaagacgatcaatacgtcttttctggagacccccttcggaacgatgaggaccacgcccactggacagaggcgaaaatgctgctcgataatatccatacccctgaaggcattatccccacactgttcgggcctgagcgcgaaaagacccaggctattgacggagagtttagactgcggggcgagcagagaaaaacattcgttgaactcatgcgccggggggaccttcccgtgtggctgagctataaggtggcctccgccggaatctcttacaaggatagagagtggtgctttaccggcgaacgcaacaatcagatcctggaggaaaacatggaggtcgagatttggacgcgggaaggcgagaaaaagaaactcagaccgaagtggctggacgctcgggtgtatgccgatcctgttgcgcttaaagacttcaaggaatttgccagcgggcgcaagtccatcacactggatattctcaccgagatcgctagcctgcccacctacctgtcttccagagccaaactcgctcttgacaatattgtgatgctgcacacaaccgaacggggaggcaaggcctatcaacatgctctgaacgagctccctgagagcctggaaacacttatgctggtcgccctcctgggggcgatgacggccggaatcttcctgtttttcatgcagggcaaagggatgggaaagctctccatgggccttatcgctattgccgtggcttctggcctgctgtgggtcgccgagatccagccccagtggattgccgctagcatcattctcgaatttttcctgatggcgcttctgatccctgagcccgaaaaacaacgcaccccgcaggataatcagctcatctacgtgattctgacaatcctgaccattatcgggctcgttgccgctaacgagatgggacttattgagaagacaaaaaccgactttggcttctaccaggtgaagacggaaaccacaatcctggatgtcgacctgagacctgcctccgcctggaccctctatgctgtggccacaaccattctgacgcccatgcttcggcacacaatcgagaatacctctgcgaacctgagcctcgccgctatcgccaatcaagctgccgttctgatggggctgggaaagggctggcccctccatcgcatggatcttggggtgcctctgctggcgatgggatgttactcccaggtcaacccgacaaccctcaccgccagcctggtgatgcttctggtgcactatgctattatcggccccggcctccaggccaaagctacaagagaagcccagaagcggacggctgccgggattatgaaaaatcctaccgttgacggaatcacagtcattgatctggagcccatctcttacgaccctaagttcgagaaacaactgggccaggtgatgctccttgtgctgtgcgcggggcagctgctcctgatgcgcaccacatgggccttttgtgaagtccttaccctggctacgggacccatcctcacactgtgggagggcaaccctgggagattctggaacaccaccattgccgtttccacagctaatatctttcggggaagctatctggccggcgccggcctcgcgttctctcttattaagaacacccaaacaccgagacgcgggacgggaaccacaggcgaaaccctgggggagaagtggaaacggcagctgaattccctcgacagaaaggaatttgaggagtacaaacgcagcggaatcctggaagtggatcggacagaggctaagtctgcccttaaagacggcagcaagattaagtatgctgtgtccagagggacctctaaaatccgctggatcgtcgaacggggaatggtgaagcccaaaggcaaggttgtggatctgggctgcgggagaggaggctggagctactacatggccacgctcaaaaacgtcaccgaggtgaaggggtatacaaagggaggccctgggcacgaagagcccattcctatggccacctacggatggaatctggttaaactgcattccggcgtggacgtcttctataagcccacagagcaggtggataccctcctttgtgacatcggcgaaagctcctctaacccgacaattgaggaagggcgcaccctgcgggtgctgaaaatggtcgagccttggctcagctccaagcccgaattttgcatcaaagttctgaatccctacatgcctacggtgattgaggagcttgaaaagctgcagagaaaacacggaggctctctcgtgcgctgtcccctgagccggaactccacacatgagatgtattgggtctctggggtgagcggaaatatcgtttccagcgtgaacaccacctctaagatgctgctcaatagattcacaacgcgctacagaaagcctacctatgaaaaagatgctgaccttggcgccgggacacggtccgtcagcaccgagacagagaagccggatatggcgattatcggacgcagactgcaacggctgcaggaagagcacaaagaaacctggcactacgaccaggagaacccctacagaacatgggcctatcatggctcttacgaagctccttccaccggcagcgcctcttccatggtgaatggggttgtgaagctcctgacgaaaccctgggatgtcatccctatggtgacccagcttgctatgacagacaccacaccctttggacaacagcgggttttcaaggagaaggtggacacccgcacgccgcagcctaaacccggcacaagaatgattatgaccacaaccgccaactggctgtgggcgctcctggggaagaaaaagaatcctcggctgtgcacgcgcgaggaatttatcagcaaagtcagatccaacgccgctattggagccgtgttccaggaggaacaaggctggaccagcgcttctgaggccgtcaatgatagccggttttgggaactcgtggacaaggagcgcgctctgcaccaggaggggaagtgtgaatcctgcgtttataacatgatgggcaaaagagagaagaaacttggagaattcggccgggccaaggggtctcgcgcgatctggtacatgtggctgggagccagattcctcgagtttgaagctctgggcttccttaacgaggatcattggtttgggcgggagaatagctggtccggagtggaaggcgaggggctgcaccgcctcggctatattctggaagacatcgataaaaaggacggagatctgatctacgccgacgatacagctggctgggacaccagaattacagaggatgacctcctgaacgaggaacttatcaccgagcagatggccccccatcacaagattctggccaaagcgatcttcaagctcacatatcaaaataaagtcgtgaaggtgctgcggcctacccccaaaggggctgttatggatattatctctcgcaaggaccagagaggaagcggccaggtggggacgtacggacttaacacatttaccaatatggaagtccagctgatccggcaaatggaggccgaaggcgtgattaccagagacgatatgcacaacccgaaagggctcaaggagcgcgttgagaagtggctgaaagaatgcggcgtggaccggctgaagagaatggccatctccggagatgactgtgtcgtgaaacctctcgatgagcgcttctctacaagcctgctttttctgaatgacatgggcaaggtccggaaagatattccccagtgggaaccctccaaggggtggaagaactggcaggaggtgcctttctgcagccatcactttcataaaatcttcatgaaggacggaagatctctcgttgtgccgtgtcgcaatcaggatgaactgattggccgggctagaatctcccaaggggccggatggagccttcgcgagaccgcttgcctgggcaaagcctacgcgcagatgtggtctctcatgtattttcaccggagagacctgcgcctggcctccatggctatctgtagcgccgtccccacagagtggttccctacgtcccggaccacatggtctattcacgctcatcaccagtggatgaccacagaagatatgctcaaggtgtggaacagagtttggatcgaggacaatcccaacatgaccgacaaaacgcctgtgcatagctgggaagatattccctacctggggaagcgggaggacctttggtgcggctccctgatcggactcagctctagagccacctgggcgaagaatattcacacagccatcacccaggtccgcaacctgattggcaaagaagagtatgtggattacatgcctgtgatgaagcggtattccgctccctttgagagcgaaggggttctttga

SEQ ID NO: 20960 - RNA, 9867 nt, synthetic construct
  misc_feature 1..9867: note = derived and/or modified CDS sequence (opt5) from DENV-4__FJ024476__SS-prME
  source 1..9867: mol_type = other RNA
agcacaatcacgctgctctgcctgattcccacggtgatggccttccacctttccacccgggacggagagcctctgatgatcgtcgctaagcatgaacgggggcgcccgctcctgtttaagacaaccgagggaattaacaagtgtacacttatcgccatggatctgggcgaaatgtgcgaggacaccgttacatacaaatgtcccctcctggtgaataccgaacctgaggatattgactgctggtgtaacctgacggcgacctgggtgatgtatgggacatgcacccagtctggagagagacggcgcgaaaagagaagcgtcgctctcacaccccactccggcatggggctggagacccgggccgaaacgtggatgtctagcgagggagcctggaaacatgctcaacgcgtggagtcctggatccttagaaatcctggcttcgccctgctcgctggctttatggcctacatgatcgggcagacaggcattcagcggaccgttttctttgtgctgatgatgcttgtcgcgccctcttatggcatgcgctgtgtgggggttggaaacagagatttcgtggaaggcgtcagcgggggagcctgggtggacctggtgctcgagcacggcggctgcgtcacaaccatggctcaggggaagcctaccctggattttgaactgacaaagacgaccgccaaagaggttgctctcctgcggacatactgtatcgaagcctccattagcaatatcaccacagcgacccgctgcccgacgcaaggagagccctatcttaaggaggaacaggaccagcagtacatttgtagacgggatgtggtggaccgcggctgggggaacggatgcggcctgttcgggaaaggaggcgtcgtgacatgcgccaagttttcttgttccggcaaaatcaccgggaatctcgttcaaattgagaacctggaatataccgtggtcgtgacagttcataatggagatacccacgctgtgggcaacgacacaagcaatcacggggtcacggccatgatcacccctagatctccctccgtggaggtcaaacttcctgattacggagaactgacactcgactgcgagccccggagcggcatcgacttcaacgagatgattctgatgaagatgaaaaagaaaacctggctggtgcataagcagtggtttctcgatctgccgcttccttggacagctggggccgacacctctgaagttcactggaattacaaagagagaatggtgacgttcaaggtcccccatgccaaacgccaggatgtgaccgttctgggctcccaggaaggagctatgcacagcgcgctcgccggcgctacagaggtggactccggggatggaaaccacatgtttgccggccatctgaagtgtaaggtccggatggaaaaacttagaatcaaggggatgtcttataccatgtgcagcggaaaattctccattgacaaggagatggccgagacacaacacggcaccacggtggtgaaagttaagtacgaaggggctggcgccccttgtaaggtccccatcgagattcgcgatgtgaataaagaaaaggtggtcggacggatcatcagctctacacccctggcggagaacaccaactccgtgacaaatattgagctcgaacctccgttcggcgacagctatatcgttattggggtgggaaactctgctctgaccctgcattggtttagaaaaggcagctccatcgggaagatgttcgagtctacctaccgcggagccaaacggatggccattctcggcgaaacagcttgggattttgggagcgtcggcggactgttcacgtcccttggcaaggccgtgcaccaggtttttgggagcgtgtataccacaatgttcggaggcgtctcttggatgatcagaatcctgattgggctcctggtgctgtggatcggaaccaattcccgcaacacaagcatggctatgacctgcattgccgttggcgggatcacgctttttctcggcttcacagtgcaggcggacatgggatgtgtcgtgtcttggtccggcaaggagctgaaatgcgggagcggaatttttgtggtcgataatgttcatacctggaccgaacaatacaagttccagcccgagtcccctgcccggctggcttctgccatcctcaacgctcacaaagacggcgtgtgtgggattagaagcacaacccgcctggagaatgtgatgtggaagcagatcacaaacgaacttaattatgtcctgtgggagggaggccacgacctcacggtggttgccggcgatgtgaaaggggtcctgaccaagggaaagcgggcgctgacaccccctgtgtccgaccttaaatactcttggaagacctggggcaaagccagaatctttacacccgaagctcggaacagcaccttcctcattgatgggccggacacgtccgagtgccctaatgaacgcagagcctggaacagcctggaggttgaggattacggatttggcatgttcaccacaaatatctggatgaagttccgggaagggtcttccgaggtgtgtgaccatagactgatgagcgctgccattaaagatcagaaggccgtccacgctgacatgggatattggatcgaatcttccaaaaaccaaacctggcagattgagcgcgcgagcctcatcgaagtgaagacatgcctgtggcccaagacccatacactttggtctaatggcgttctggagagccagatgctcatccctaaatcctacgccggcccctttagccagcacaactatcggcaagggtacgctacccagacgatgggaccttggcacctgggcaagctggagattgggttcggagaatgccccggcacaaccgtgaccatccaggaggattgtgaccatagagggccgtctcttcgcacaaccacggcctccggaaaactcgtcacacagtggtgctgtagaagctgcaccatgcctcccctgcggtttctgggcgaagatggctgttggtatgggatggagattcgccccctctccgagagagaagagaacatggtgaagtctcaagtgacagccggacagggcaccagcgaaacattctccatggggctgctttgcctgaccctctttgtcgaggaatgtctgcggcgcagagttacgcggaaacacatgatcctggtggtggtcattaccctttgcgctatcatcctcggaggcctgacatggatggacctgctccgcgccctgattatgcttggggataccatgtctggaagaatcggcggccagattcatctggcgatcatggctgtgttcaagatgagccctgggtacgttctcggagtgtttctgcggaagctgacatcccgcgagaccgcccttatggtcattggcatggccatgacgacagtgctgtctatcccgcacgacctcatggagctgatcgacgggattagcctcggactgatccttctgaaaattgttacccagttcgataatacacaagtgggcaccctcgctctgtccctgacctttatcagaagcacaatgccccttgtcatggcctggcggacgattatggcggtgctgttcgtcgtgaccctcatccctctgtgtagaacatcttgcctccagaagcagtcccattgggttgaaattaccgctctgatccttggggcccaagccctgcccgtgtatctcatgacactgatgaaaggagctagccgccggtcttggcctctgaacgagggcatcatggccgtcggccttgtgtccctgctcgggagcgctctgctcaagaatgacgttcccctggccggacctatggtggcgggcgggcttctgctggccgcttacgtcatgtctggatccagcgccgatctctccctggaaaaagctgccaacgtgcagtgggacgagatggccgatattaccggcagctctcccatcattgaagtgaagcaggacgaggatgggagcttttccatcagagacgttgaggaaacgaatatgattacacttctggtcaagctcgctctgatcaccgtgtctggactctacccgctggcgatccctgtgaccatgacactttggtatatgtggcaggtcaaaacccaacgcagcggcgccctgtgggatgtgccctcccctgctgccacacagaaggccgctctgtctgagggcgtttaccggattatgcagagaggactgttcggaaaaacacaggtgggcgtcgggatccacatggaaggagtgtttcacaccatgtggcatgttacacgcggcagcgtgatttgtcacgagaccgggcggctggaaccctcctgggccgacgtcagaaacgatatgatctcttatggaggcggctggcgccttggggacaagtgggataaagaggaggacgtgcaagttctggcgattgaaccgggaaagaatcctaagcatgtgcagacaaaacccggcctcttcaagaccctgacgggggagatcggagctgtcaccctcgacttcaaacctggcacaagcgggtcccccatcattaaccggaagggcaaagtgatcggactgtacggcaatggggtggtcaccaagagcggagattatgtttctgccattacacaggccgaaagaatcggcgagcccgactacgaggtggatgaagacatttttcggaaaaagcgccttaccatcatggatctgcaccctggggctggaaagacaaaacggattctgccgtccatcgtgagagaggccctcaagcgcagactgcggacgcttatcctggcgcccaccagagtcgtggctgccgaaatggaggaagccctccgcggcctgcctattcggtatcagacacccgctgttaaaagcgagcataccgggagagagatcgtggacctcatgtgccacgccaccttcacaacgcgcctgctttcttccacccgggtccctaactacaatctgattgtgatggatgaagctcactttacagaccccagctccgttgccgcgagaggctacatctctacccgcgtggagatgggagaagccgctgccattttcatgacagctacccctccgggcgccacggatccctttcctcaaagcaactcccccatcgaggacatcgaacgggagattcctgagagaagctggaatacagggttcgattggatcaccgactatcagggaaagaccgtctggtttgtgccctctattaaagccggcaacgacatcgctaattgcctgcgcaagtccgggaagaaagtcgtgcagctcagcagaaagacattcgataccgaatacccgaaaacaaagctgaccgactgggattttgttgtgacgacagacatttctgagatgggagcgaacttccgggccggccgcgtgatcgatcctagacggtgtcttaaacccgtcatcctgaccgacgggcccgaacgcgttattctcgctggccctatccccgtgacccctgccagcgccgctcaaagacggggaagaattggccgcaacccggcccaggaggatgaccagtatgtgttttccggggatcccctgaagaatgacgaagatcatgcgcactggaccgaggctaagatgctgctcgacaacatctacacgcctgagggaattatccccacccttttcggccctgaacgggagaaaacacaggccattgatggggagttcagactgcgcggagagcaacggaagacctttgtcgagctgatgagacggggcgacctccccgtgtggctgtcttataaagttgccagcgctggcatctcctacaaggaccgcgaatggtgcttcacaggggagagaaataaccagatccttgaagagaatatggaagtggagatttggacccgggagggagagaagaagaagctgcgcccgagatggctcgatgcccgggtctatgcggaccctatggccctgaaagattttaaggagttcgcttctggccgcaaaagcatcacactggacattctcaccgaaatcgcctcccttcccacgtacctgagctctagagctaagctggccctcgataacattgtgatgctgcatacaaccgagagaggcgggcgcgcttaccagcacgcccttaatgaactgcctgagtccctcgagaccctgatgctggtcgcgctccttggggccatgacagctgggatctttctgttctttatgcagggaaaaggcatcggcaagctgagcatggggctcattaccatcgccgtggcttccggactgctttgggttgccgaaattcaaccccagtggatcgccgcttctattatcctggagttctttctcatggtgctgctgatccctgaacccgagaagcagagaacaccgcaggacaaccaactcatttatgtcatccttacgattctgaccatcattggcctgatcgcggccaatgaaatggggctcattgagaaaacaaagaccgatttcggattttaccaggtgaaaacagagaccacgatcctggacgttgatcttcggcctgctagcgcctggaccctgtatgccgtggctacaaccatcctcacacccatgctgagacacaccattgaaaacacgtccgccaatctgtctctcgcggccatcgctaaccaggccgctgtccttatgggcctggggaagggatggcccctgcatcgcatggacctcggcgtgcctctgcttgccatgggctgttacagccaggtgaatccgacaaccctgacagcgtccctcgttatgctgctggtccactatgccattatcgggcccggactccaagctaaagccacccgggaggctcagaagagaaccgccgctggcattatgaaaaaccctacagtggatgggatcacggtgatcgaccttgaacccattagctacgatcctaagttcgagaagcagctgggacaagtcatgctgctcgttctgtgcgccggccagcttctgctcatgcgcaccacatgggcgttttgtgaggtgctgaccctggccacagggcccatcctcaccctttgggaaggaaatcctggccggttctggaacacgacaattgctgtgtctaccgccaacatcttcagaggctcctatctggctggggccggactggcctttagcctcattaaaaatgcgcagaccccgcgccggggcacagggaccacaggagagacgctgggcgaaaagtggaaaagacagcttaactctctggaccgcaaggagttcgaagagtacaaacggtccgggatcctcgaggtcgacagaaccgaagctaagagcgccctgaaggatggatctaaaatcaagcatgctgtgagccgcggctcctctaaaattcggtggatcgttgagagaggcatggtgaagcccaaagggaaggtcgtggacctgggatgcggccgcgggggatggagctactatatggccacactcaagaatgttaccgaagtgaaaggctacacaaaagggggacctggccacgaggaacccattcctatggccacctatggctggaaccttgtcaaactgcattccggggtggatgtgttttacaagcccacggagcaagtcgacaccctgctctgtgatatcggagagagctcctctaatccgacaattgaagagggcagaaccctgcgggttcttaaaatggtggaaccttggctgagctccaagcccgagttctgcatcaaggtgctcaacccctatatgcctacagtcattgaggaactggagaaactgcagcgcaagcacgggggaaatctcgtgagatgtcccctttctcggaacagcacccacgaaatgtactgggtttccggcgcttctgggaatatcgtgagctccgtcaacacaaccagcaaaatgctgctgaatagatttacgacacggcatcgcaagcctacctatgagaaagacgtggatctcggagccggcaccagatctgtttccacagaaacggagaagccggacatgaccatcattggccggcgcctgcagagacttcaggaggaacacaaagagacatggcattacgatcaagaaaacccctaccggacctgggcgtatcacgggagctacgaggccccttctacaggatccgctagctctatggtgaatggcgtcgtgaagctgctcaccaagccctgggacgttatccctatggtgacacagctggccatgaccgatacgacccccttcgggcagcagcgcgtctttaaagaaaaggtggacacaagaaccccgcaacctaaacccggaacacggatggtcatgaccacgacagctaactggctgtgggccctcctgggcaagaaaaagaatcctcgcctttgcaccagagaggagttcatttccaaggtgcggagcaacgcggccatcggggctgtttttcaggaagaacagggctggacatccgccagcgaagctgtgaatgactctcgcttctgggagctggtcgataaagaaagagccctccaccaagagggaaagtgtgagagctgcgtgtataacatgatgggcaaacgggaaaagaaactgggggagtttggacgcgctaagggctccagagccatttggtacatgtggcttggggcgcggttcctggaatttgaggccctcggattcctgaacgaagaccattggttcggcagagaaaattcttggagcggggtggagggcgaaggactgcaccgcctcggctatatcctggaggaaatcgataagaaagacggggatcttatgtacgctgacgataccgccggatgggacacgcggattaccgaggatgacctgcagaacgaggaactcatcacagagcagatggctccccatcacaagattctggccaaagccatctttaaacttacctatcagaataaagttgtgaaggtcctgagacctacaccccgcggcgcggtgatggatattatctcccggaaggaccaaagagggtctggacaggttggcacctacgggctcaacacattcaccaatatggaagtgcagctgatccgccagatggaggctgaaggcgtcattacgcaagatgacatgcagaacccgaaaggactgcgggagagagtggagaagtggctcaaagaatgcggcgtcgaccgcctgaagcggatggccatcagcggggatgactgtgtggttaaacctcttgatgagagatttggaacatccctcctcttcctgaatgacatgggcaaggtgcgcaaagatattccccagtgggaaccctctaaggggtggaagaactggcaggaggtccctttttgcagccatcacttccacaaaatctttatgaaggacggacggtcccttgtggttccgtgtagaaatcaagatgaactgattggccgggccagaatcagccagggggctggctggtctctccgcgagaccgcctgcctgggaaaggcttacgcccagatgtggtccctgatgtatttccatcggagagacctccgcctggcgagcatggccatctgttctgctgtgcccaccgagtggtttcctacatccagaaccacatggagcattcacgcccatcaccagtggatgacgaccgaagatatgcttaaggtctggaaccgggtgtggatcgaggacaatcccaacatgacagataaaacccctgtgcactcctgggaagacattccctacctgggcaagcgcgaggacctctggtgcgggtctctgatcggacttagctccagagctacatgggccaagaatattcataccgcgatcacgcaagttcggaacctgattggcaaagaagagtatgtcgattacatgcctgtgatgaagcgctatagcgccccctctgagtccgaaggggtgctctga

SEQ ID NO: 20961 - RNA, 9867 nt, synthetic construct
  misc_feature 1..9867: note = derived and/or modified CDS sequence (opt5) from DENV-4__GQ868579__SS-prME
  source 1..9867: mol_type = other RNA
tccaccatcaccctgctctgcctgattcccacgatcatggcgttccacctttccaccagagacggagagcctctgatgattgtggctaagcatgaacgggggcgcccgctcctgtttaaaaccaccgagggaatcaacaagtgtacccttattgccatggatctgggagaaatgtgcgaggacaccgtcacctacaaatgtcccctcctgatcaataccgaacctgaggatatcgactgctggtgtaacctgacgtctacctgggttatgtatgggacgtgcacccagagcggagagagacggcgcgaaaagagatccgtggcgctcacaccccactctggaatggggctggagacccgggctgaaacgtggatgagctccgagggagcctggaaacatgcccaacgcgtggagtcttggattcttagaaatcctggcttcgctctgctcgccggctttatggcttacatgatcgggcagacagggattcaacggaccgtcttctttatcctgatgatgcttgtggcccccagctatggcatgcgctgtgttggggtgggaaacagagatttcgtcgaaggcgtgtccgggggagcgtgggttgacctggtgctcgagcacggcggctgcgtcacaaccatggcccaggggaagcctaccctggattttgaactgacaaagacgaccgctaaagaggtggccctcctgcggacatactgtattgaagctcttatcagcaatattaccacagccacccgctgcccgacgcaaggagagccctatctgaaggaggaacaggaccagcagtacatctgtagacgggatgtggtcgaccgcggctgggggaacggatgcggcctcttcgggaaaggaggcgttgtgacatgcgcgaagttttcttgttccggcaaaatcaccgggaatctggtgcaaattgagaaccttgaatataccgtcgtggttacagtgcataatggagatacccacgccgtcggcaacgacacaagcaatcacggggtgacggctaccatcacacctagatctccctccgttgaggtgaagctgcctgattacggagaactcaccctggactgcgagccccggagcggcattgacttcaacgagatgatcctgatgaagatgaaaaagaaaacatggctcgtccataagcagtggtttctggatcttccgctgccttggaccgccggggctgacacgtctgaagtgcactggaattacaaagagagaatggtcaccttcaaggtgccccatgccaaacgccaggatgttacagtgctcggctcccaggaaggagccatgcacagcgctctggcgggcgccaccgaggtcgactccggggatggaaaccacatgtttgctggccatcttaagtgtaaggtgcggatggaaaaactgagaattaaggggatgtcttatacaatgtgcagcggaaaattctccatcgacaaggagatggccgagacccaacacggcacgacagttgtgaaagtcaagtacgaaggggccggcgctccttgtaaggtgcccatcgagattcgcgatgtgaataaagaaaaggttgtcggacgggtgatcagctctacacccctcgccgagaacacaaactccgtgaccaatattgagctggaacctccgttcggcgacagctatatcgtcattggggtgggaaactctgcgctgaccctccattggtttagaaaaggcagctccatcgggaagatgttcgagtctacataccgcggagctaaacggatggccatcctgggcgaaacggcctgggattttgggagcgttggcggacttttcacctccctgggcaaggctgtgcaccaggtctttgggagcgtgtatacaaccatgttcggaggcgtttcttggatgattagaatcctcattgggtttctggtgctgtggatcggaacaaattcccgcaacaccagcatggccatgacgtgcattgctgtcggcgggatcacacttttcctcggctttaccgtgcgggccgacatgggatgtgttgtgtcttggtccggcagagagctgaagtgcgggagcggaattttcgtcgtggataatgtgcatacctggacagaacagtacaaatttcaacccgagtcccctgcgcgcctggcctctgctatcctcaacgcccacaaggacggcgtctgtgggatccggagcaccacaagactggagaatgttatgtggaaacagattacgaacgaacttaattatgtgctgtgggagggaggccacgacctcaccgtggtcgctggcgatgtgaagggggttctgacaaaaggaaagcgggccctgacaccccctgtgtccgaccttaagtactcttggaaaacatggggcaaggcgaaaatcttcacccccgaagcccgcaacagcacgtttctcattgatgggccggacacctccgagtgccctaatgaaagacgggcttggaacagcctggaggtcgaggattacggattcggcatgttcacaaccaatatctggatgaagtttagagaagggtcttccgaggtgtgtgaccatcgcctgatgagcgccgctattaaagatcagaaggccgttcacgccgacatgggatattggatcgaatcttccaaaaaccagacatggcaaatcgagcgggctagcctcattgaagtgaagacctgcctgtggcccaagacacataccctttggtctaatggcgtcctggagagccagatgctcatccctaaatcctacgcgggccccttcagccagcacaactatagacaggggtacgccacgcaaacagtgggaccttggcacctgggcaagctggagattgattttggggaatgccccggaaccaccgttacaatccaggaggactgtgatcatcgcggcccgtctcttagaaccacgacagcttccgggaaactcgtgacccagtggtgctgtcggagctgcacaatgcctcccctgcgcttcctgggagaagacggctgttggtatggcatggagattagacccctctccgagaaggaagagaacatggtcaaatctcaggtgaccgccgggcaaagcacatccgaaaccttttctatgggactgctttgcctgacactcttcgtggaggaatgtctgcggcgcagagtcacccggaagcacatgatcctggccgttgtgatcacactttgcgctattatcctcggcgggctgacctggatggatctgctccgcgccctgattatgcttggagacacaatgagcggcagaatcgggggacagacccatctggcgattatggctgtgtttaagatgtcccctggctacgtcctcggcgtgttcctgcggaaactgacgtctcgcgagacagcccttatggttatcgggatggccatgaccacaaccctgagcatcccgcacgacctcatggagctgattgatggaatctccctcggcctgattcttctgaagatcgtgacccagtttgacaatacacaggtcgggacgctcgctctgagcctgaccttcattagatctacaatgtcccttgtgatggcctggcggaccatcatggcggttctgtttgtggtcacactcattcccctgtgtagaaccagctgcctccaaaaacagtctcattgggtggaaatcacggctctgatccttggagcccaggccctgcctgtctatctcatgacactgatgaagggcgcttcccgccggagctggcccctgaacgaggggattatggccgtgggacttgtttctctgctcggctccgctctgctcaaaaatgatgtgcctctggccggccccatggtcgccgggggacttctgctggccgcttacgtgatgagcggctccagcgccgacctctctctggaaaaggctgccaacgttcaatgggatgagatggccgacatcaccgggagctcccctattatcgaagtgaagcaggatgaggacggatctttcagcattagagatgtcgaggaaaccaatatgatcacacttctggtgaaactcgctctgatcaccgtgtccggcctctaccccctggcgattccggttacaatgacgctttggtatatgtggcaggtcaagacccagcgctctggggccctgtgggacgtgcctagccccgctgccacacaaaaagccgctctgtccgagggagtgtaccggatcatgcagagaggcctctttggcaagacccaggtcggggtgggcattcacatggaaggcgttttccacacaatgtggcatgtgacccgcgggtctgtcatctgtcacgagacgggacggctggaacctagctgggccgatgtgagaaacgacatgatttcctatggcgggggatggcgccttggcgataaatgggaccgggaggaggacgttcaggtgctggcgatcgaacccggcaagaatccgaagcatgtccaaaccaaacctggactcttcaagacactgaccggagagatcggcgctgtgacactcgattttaaacccgggaccagcggatctcctattatcaacaagaaaggcaaggttattgggctgtacggcaatggagtggtcacaaaatccggcgactatgtgagcgccatcacgcaggccgaaagaattggggagcccgattacgaggtggacgaagatatcttccggaagaagcgccttaccattatggacctgcaccccggagctggcaaaacaaagagaatcctgccttctatcgtccgggaggccctcaaacgcagactgcggacccttattctggcgccgaccagagttgtggctgccgaaatggaggaagccctccgcgggctgcccatccggtatcagacccctgctgtgaagtccgagcatacgggaagagagattgtcgatctcatgtgccacgccacctttacaacccgcctgcttagctccacacgggtgcccaactacaatctgatcgttatggacgaagctcacttcaccgatccttctagcgtggccgcgagaggctacatttccacgcgcgtcgagatgggggaagccgctgccatctttatgacagctacaccccctggcgccaccgacccgttcccccagagcaactctcctatcgaggatattgaacgggagatccccgagagatcctggaatacaggatttgactggattaccgactatcaaggcaaaacagtgtggttcgttcctagcatcaaggccgggaacgatattgctaattgcctgcgcaagtctggcaaaaaggtgatccagctcagcagaaaaacctttgacacggaataccccaagacaaaactgaccgattgggacttcgtcgtgacaaccgatatctccgagatgggcgcgaactttcgggccgggcgcgtcattgacccgagacggtgtcttaagcctgtgatcctgacggatggacccgaacgcgttattctcgctggccccatccctgtgacccccgcctctgccgctcagagacgggggagaattggccgcaaccctgcccaagaggacgatcagtatgtgttcagcggagacccgctgaagaatgatgaagaccatgcgcactggacagaggctaaaatgctgctcgataacatctacacccccgagggcattatccctacacttttcgggcccgaacgggagaagacccaggccatcgacggagaatttagactgcgcggcgagcagcggaaaacattcgtcgagctgatgagaagaggggacctccctgtttggctgtcctataaggtggcctctgctggaattagctacaaagatcgcgaatggtgctttaccggcgagagaaataaccaaatccttgaagagaatatggaagtggagatttggacgcgggagggcgaaaagaagaaactgcgccccagatggctcgacgcccgggtctatgcggatccgatggccctgaaggacttcaaagagtttgcttccgggcgcaagagcatcacactggatattctcaccgaaatcgcctctcttcctacctacctgtccagcagagctaaactggccctcgacaacatcgtgatgctgcatacaaccgagcggggaggccgcgcttaccagcacgcccttaatgaactgcccgagtccctcgagacactgatgctggttgcgctccttggggccatgacggctggaaccttcctgtttttcatgcagggcaaggggattggaaagctgtctatgggcctcatcacaattgccatggctagcggcctgctttggatcgccgaaattcagcctcaatggatcgccgcttccatcattctggagtttttcctcatggtgctgctgatccccgaacctgagaaacagagaacaccccaggataaccagctcatttatgtcatccttacaattctggcgatcattgggctgatcgccgctaatgaaatgggactcatcgagaagaccaaaacggactttggcttctaccaagtgaagaccgagacaaccattctggatgtcgaccttcggccggcctctgcctggacactgtatgctgtggccaccacgatcctcacacctatgctgagacacaccattgaaaacacaagcgcgaatctgtccctcgccgctatcgccaaccaggctgccgttcttatggggctgggaaaaggctggcccctgcatcgcatggatctcggggtgcccctgcttgcgatgggatgttacagccaggtcaatcctaccaccctgacagcctctctcgtgatgctgctggttcactatgctattatcggcccgggcctccaggccaaggctacgcgggaggcccagaaacggaccgctgccgggatcatgaagaaccccacagtggacggaattaccgtcatcgatcttgaacctatttcctacgaccccaagtttgagaaacagctgggccaggtgatgctgctcgtgctgtgcgcggggcaacttctgctcatgcgcacaacctgggccttctgtgaggttctgacgctggctacaggacctatcctcaccctttgggaaggcaatcccgggcggttctggaacaccacaattgccgtcagcaccgctaacatctttagaggatcttatctggccggcgccggcctggcgttctccctcatcaagaatgctcaggcccctcgccgggggacaggaacgaccggcgagacactgggggaaaaatggaagagacagcttaacagcctggaccgcaaagagtttgaagagtacaagcggtctggcattctcgaggtggatagaaccgaagctaagagcgccctgaaagacggctccaagatcaaacatgccgtgtctcgcgggagctccaagattcggtggatcgtcgagagaggaatggttaaaccgaagggcaaggtggtggatctgggctgcgggcgcggaggctggagctactatatggctacactcaaaaatgtcaccgaagtgaaggggtacacgaaaggaggccccgggcacgaggaacctattcccatggccacctatggatggaaccttgttaagctgcattccggcgtggacgtcttctacaaacctacagaacaggtggataccctgctctgtgacatcggcgagtctagctccaatcccacaattgaagaggggagaaccctgcgggttcttaagatggtggaaccgtggctgtctagcaagcctgagttttgcatcaaagtcctcaacccctatatgcccacagtgatcgaagaactggagaagctgcaacgcaaacacggaggcaatctcgtgagatgtcctctttcccggaactctacccacgaaatgtactgggtcagcggggcgtccggaaatattgttagctctgtgaacacgacatccaagatgctgctgaatagattcaccacccggcatcgcaaacccacatatgagaaggatgtggacctcggcgccgggacgagaagcgtctctaccgaaacagagaaacctgatatgaccatcattggacggcgcctgcagagacttcaggaggaacacaaggagacatggcattacgaccaggaaaacccgtaccggacctgggcttatcacggctcctacgaggcccccagcacaggctctgcttccagcatggtgaatggggttgtgaagctgctcaccaaaccttgggatgtcatccccatggtgacgcaactggccatgaccgacacaaccccttttggacagcagcgcgttttcaaggaaaaagtggacacaagaacaccccagccgaagcctggcacgcggatggtcatgacaaccacagcgaactggctgtgggccctcctggggaaaaagaaaagcccccgcctttgcaccagagaggagtttattagcaaggtgcggtctaatgctgccatcggagctgttttccaagaggaacagggctggacgagcgcctccgaagctgtgaacgattctcgcttttgggagctggtcgacaaggaaagagccctccaccaggaggggaaatgtgagagctgcgtgtataatatgatgggcaagcgggagaaaaagctgggagagttcggccgcgcgaaggggtccagagccatctggtacatgtggcttggagctcggtttctggagttcgaggccctcggcttcctgaacgaagatcattggtttgggagagagaactcttggagcggagtcgagggcgaagggctgcaccgcctcggctatattctggaggaaatcgacaaaaaggatggagaccttatgtacgctgatgacaccgccggctgggatacacggattaccgaggacgatctgcaaaatgaggaactcatcacagagcagatggcccctcatcacaaaattctggcgaaggctatcttcaaacttacctatcagaacaaggtggttaaggtgctgagacccacacctcgcggggccgtcatggacatcatttcccggaaagatcagagaggatctggccaagtggggacctacggactcaatacgtttacaaacatggaagtgcagctgatccgccagatggaggccgaaggcgttattacccaggacgacatgcaaaatcccaaggggctgaaagagcgggtggagaactggctcagagaatgcggcgtcgatcgcctgaagcggatggctatcagcggagacgattgtgtggttaaaccgcttgacgagagattcggcacctccctgctctttctgaatgatatggggaaggtgcgcaaagacattcctcagtgggaacccagcaagggatggaagaactggcaggaggtccccttctgctctcatcactttcacaaaatcttcatgaaggatggccggtcccttgtggtcccttgtagaaatcaggacgaactgatcgggcgggccagaattagccaaggagctggctggtctctccgcgagacagcctgcctggggaaagcgtacgcccagatgtggtccctgatgtattttcatcggagagatctccgcctggctagcatggccatctgttccgctgtgccgaccgagtggttccccacatctagaacgacctggagcattcacgcccatcaccagtggatgacaaccgaagacatgcttaaggtttggaaccgggtgtggatcgaggataatcctaacatgattgacaaaacacccgtccactcctgggaagacatcccttacctgggcaagcgcgaggatctctggtgcggaagcctgattggcctttcttccagagcgacctgggccaagaatatccatacggctatcacccaggtgcggaacctgattgggaaagaagagtatgttgactacatgcccgtgatgaagcgctatagcgccccttctgagagcgaaggagtcctctga

SEQ ID NO: 20962 - RNA, 9867 nt, synthetic construct
  misc_feature 1..9867: note = derived and/or modified CDS sequence (opt5) from DENV-4__GQ868580__SS-prME
  source 1..9867: mol_type = other RNA
agcaccatcacgctgctctgcctgattcccacgatcatggcgttccacctttccacccgggacggagagcctctgatgattgtggctaagcatgaacgggggcgcccgctcctgtttaaaaccaccgagggaatcaacaagtgtacccttattgccatggatctgggagaaatgtgcgaggacaccgtcacatacaaatgtcccctcctgatcaataccgaacctgaggatatcgactgctggtgtaacctgacgtctacctgggttatgtatgggacatgcacccagagcggagagcggcggcgcgaaaagagatccgtggcgctcacaccccactctggcatggggctggagacccgggctgaaacgtggatgagctccgagggagcctggaaacatgcccaacgcgtggagtcttggattcttagaaatcctggcttcgctctgctcgccggctttatggcttacatgatcgggcagacaggcattcagcggaccgtcttctttgtgctgatgatgcttgttgcccccagctatggcatgcgctgtgtgggggtcggaaacagagatttcgtggaaggcgtttccgggggagcgtgggtggacctggtcctcgagcacggcggctgcgtgacaaccatggcccaggggaagcctaccctggattttgaactgacaaagacgaccgctaaagaggtggccctcctgcggacatactgtatcgaagctcttattagcaatatcaccacagccacccgctgcccgacgcaaggagagccctatctgaaggaggaacaggaccagcagtacatttgtagacgggatgtcgttgaccgcggctgggggaacggatgcggcctcttcgggaaaggaggcgtggtgacatgcgcgaagttttcttgttccggcaaaatcaccgggaatctggtccaaatcgagaaccttgaatataccgtggttgtgacagtccataatggagatacccacgccgtgggcaacgacacaagcaatcacggggttacggctaccattacacctagatctccctccgtggaggtcaagctgcctgattacggagaactcaccctggactgcgagccccggagcggcatcgacttcaacgagatgattctgatgaagatgaaaaagaaaacatggctcgtgcataagcagtggtttctggatcttccgctgccttggaccgccggggctgacacgtctgaagtccactggaattacaaagagagaatggtgaccttcaaggttccccatgccaaacgccaggatgtgacagtcctcggctcccaggaaggagccatgcacagcgctctggcgggcgccaccgaggtggactccggggatggaaaccacatgtttgctggccatcttaagtgtaaggttcggatggaaaaactgagaatcaaggggatgtcttatacaatgtgcagcggaaaattctccattgacaaggagatggccgagacccaacacggcacgacagtggtcaaagtgaagtacgaaggggccggcgctccttgtaaggtgcccatcgagatccgcgatgttaataaagaaaaggtcgtgggacggattatcagctctacacccctcgccgagaacacaaactccgtgaccaatattgagctggaacctccgttcggcgacagctatatcgtcattggggtgggaaactctgcgctgaccctccattggtttagaaaaggcagctccatcgggaagatgttcgagtctacataccgcggagctaaacggatggccatcctgggcgaaacggcctgggattttgggagcgttggcggacttttcacctccctgggcaaggctgtgcaccaggtctttgggagcgtgtatacaaccatgttcggaggcgtttcttggatgattagaatcctcattgggtttctggtgctgtggatcggaacaaattcccgcaacaccagcatggccatgacgtgcattgctgtcggcgggatcacacttttcctcggctttaccgtgcaggccgacatgggatgtgttgtgtcttggtccggccgggagctgaagtgcgggagcggaattttcgtcgtggataatgtgcatacctggacagaacaatacaaatttcagcccgagtcccctgcgagactggcctctgctatcctcaacgcccacaaggacggcgtctgtgggatccgcagcaccacacggctggagaatgttatgtggaaacagattacgaacgaacttaattatgtgctgtgggagggaggccacgacctcaccgtggtcgctggcgatgtgaagggggttctgacaaaaggaaagagagccctgacaccccctgtgtccgaccttaagtactcttggaaaacatggggcaaggcgaaaatcttcacccccgaagcccggaacagcacgtttctcattgatgggccggacacctccgagtgccctaatgaacgcagagcttggaacagcctggaggtcgaggattacggattcggcatgttcacaaccaatatctggatgaagtttcgggaagggtcttccgaggtgtgtgaccatagactgatgagcgccgctattaaagatcagaaggccgttcacgccgacatgggatattggatcgaatcttccaaaaaccaaacatggcagatcgagcgcgctagcctcattgaagtgaagacctgcctgtggcccaagacacataccctttggtctaatggcgtcctggagagccagatgctcatccctaaatcctacgcgggccccttcagccagcacaactatcggcaagggtacgccacgcagacagtgggaccttggcacctgggcaagctggagattgattttggggaatgccccggaaccaccgttacaatccaggaggactgtgatcatagaggcccgtctcttcgcaccacgacagcttccgggaaactcgtgacccagtggtgctgtagaagctgcacaatgcctcccctgcggttcctgggagaagacggctgttggtatggcatggagattcgccccctcaacgagaaggaagagaatatggtcaaatcccaagtgaccgccgggcagtctacaagcgaaaccttttccatgggactgctttgcctgacactcttcgtggaggaatgtctgagacggcgcgtcaccagaaagcacatgatcctggccgttgtgatcacactttgcgctattatcctcggcgggctgacctggatggatctgctccgggccctgattatgcttggagacacaatgtctggccgcatcgggggacagacccatctggcgattatggctgtgtttaagatgagccctggctacgtcctcggcgtgttcctgagaaaactgacgtcccgggagacagcccttatggttatcgggatggccatgaccacaaccttttctatcccgcacgacctgatggagctcattgatggaatcagcctgggcctcattctgcttaagatcgtgacccagttcgacaacacacaagtcgggacgctggctctctccctgacctttattcgcagcacaatgtctctggtgatggcctggagaaccatcatggcggttcttttcgtggtcacactgattcccctctgtcggacctcctgcctgcagaaacagagccattgggtggaaatcacggctctcatcctgggagcccaagcccttcctgtctatctgatgacactcatgaagggcgcttctagacgctcctggcccctgaatgaggggattatggccgtgggactggttagccttctgggctctgctctcctgaaaaacgatgtgcctctcgccggccccatggtcgccggcgggctgcttctggccgcttacgtgatgtccgggagctccgccgacctgagcctcgaaaaggctgccaatgttcagtgggatgagatggccgacatcaccgggtctagccctattatcgaagtgaagcaggatgaggacggatccttttctattcgggatgtcgaggaaaccaacatgatcacactgcttgtgaaactggctctcatcaccgtgagcggcctgtaccccctcgcgattccggttacaatgacgctgtggtatatgtggcaggtcaagacccaaagatccggggccctttgggacgtgccttctcccgctgccacacagaaagccgctctgagcgagggagtgtaccgcatcatgcagcggggcctgctcggcaagacccaggtcggggtgggcattcacatggaaggcgttttccacacaatgtggcatgtgaccagagggtccgtcatctgtcacgagacgggacgcctggaaccttcttgggccgatgtgcggaatgacatgattagctatggcgggggatggagacttggcgataaatgggaccgcgaggaggacgttcaagtgctggcgatcgaacccggcaagaacccgaagcatgtccagaccaaacctggactcttcaagacactgaccggagagatcggcgctgtgacactcgattttaaacccgggacctccggaagccctattatcaatcggaagggcaaagttattgggctgtacggcaacggagtggtcacaaagtctggcgactatgtgtccgccatcacgcaggccgaaagaattggggagcccgattacgaggtggacgaagatatcttccggaaaaagcgccttaccattatggacctgcaccccggagctggcaagacaaaaagaatcctgcctagcatcgtccgggaggccctcaagcgcagactgcggacccttattctggcgccgaccagagttgtggctgccgaaatggaggaagccctccgcgggctgcccatccggtatcagacccctgctgtgaaatctgagcatacgggaagagagattgtcgatctcatgtgccacgccacctttacaacccgcctgctttccagcacacgggtgcccaattacaacctgatcgttatggacgaagctcacttcaccgatccttcctctgtggccgcgagaggctacattagcacgcgcgtcgagatgggggaagccgctgccatctttatgacagctacaccccctggcgccaccgacccgttcccccaatccaatagccctatcgaggatattgaacgggagatccccgagagatcttggaacacaggatttgactggattaccgactatcagggcaagacagtgtggttcgttccttccatcaaagccgggaatgatattgctaactgcctgcgcaagagcggaaagaaagtgatccagctctctagaaagacctttgacacggaataccccaaaacaaagctgaccgattgggacttcgtcgtgacaaccgatatcagcgagatgggcgcgaactttcgggccgggcgcgtcattgacccgagacggtgtcttaaacctgtgatcctgacggatggacccgaacgcgttattctcgctggccccatccctgtgacccccgcctccgccgctcaaagacgggggagaattggccgcaatcctgcccaggaggacgatcagtatgtgttctctggagacccgctgaagaacgatgaagaccatgcgcactggacagaggctaagatgctgctcgataatatctacacccccgagggcattatccctacacttttcgggcccgaacgggagaaaacccaggccatcgacggagaatttagactgcgcggcgagcaacggaagacattcgtcgagctgatgagaagaggggacctccctgtttggctgagctataaagtggcctccgctggaatttcttacaaggatcgcgaatggtgctttaccggcgagagaaacaatcagatccttgaagagaacatggaagtggagatttggacgcgggagggcgagaagaagaagctgcgccccagatggctcgacgcccgggtctatgcggatccgatggccctgaaagacttcaaggagtttgctagcgggcgcaaatccatcacactggatattctcaccgaaatcgccagccttcctacctacctgtcttccagagctaagctggccctcgacaatatcgtgatgctgcatacaaccgagcggggaggccgcgcttaccagcacgcccttaacgaactgcccgagagcctcgagacactgatgctggttgcgctccttggggccatgacggctggaattttcctgtttttcatgcagggcaaagggatcggaaagctgtccatgggcctcattaccatcgccatggcttctggcctgctttggattgccgaaatccaacctcagtggatcgccgctagcattatcctggagtttttcctcatggtgctgctgattcccgaacctgagaagcagagaacaccccaggataatcaactcatctatgtcattcttaccatcctgacaattatcgggctgatcgcggccaacgaaatgggactcattgagaaaaccaagacggactttggcttctaccaggtgaaaaccgagacaaccatcctggatgtcgaccttcggccggcttccgcctggacactgtatgccgtggctaccacgattctcacacctatgctgagacacaccatcgaaaatacatctgccaacctgagcctcgcggccattgctaatcaggccgctgttcttatggggctgggaaagggctggcccctgcatcgcatggatctcggggtgcccctgcttgccatgggatgttactcccaggtcaaccctaccaccctgacagcgagcctcgtgatgctgctggttcactatgccatcatcggcccgggcctccaagctaaagccacgcgggaggctcagaagagaaccgccgctgggattatgaaaaatcccacagtggacggaatcaccgtcattgatcttgaacctatctcttacgaccccaagtttgagaagcagctgggccaagtgatgctgctcgtgctgtgcgccgggcagcttctgctcatgcgcacaacctgggcgttctgtgaggttctgacgctggccacaggacctattctcaccctttgggaaggcaaccccgggcggttctggaacaccacaatcgctgtctccaccgccaatatctttagaggaagctatctggctggcgccggcctggccttctctctcattaaaaacgcgcagacacctcgccgggggacgggaaccacaggcgagaccctgggggaaaagtggaaaagacagcttaattccctggaccgcaaggagtttgaagagtacaaacggagcggaatcctcgaggtggatagaacagaagctaagtctgccctgaaggacggcagcaaaattaagcatgctgtgtcccgcgggtctagcaaaatccggtggattgtcgagagaggaatggttaagccgaaaggcaaggtggtggatctgggctgcgggcgcggaggctggtcctactatatggccaccctcaagaacgtcacggaagtgaaagggtacaccaagggaggccccgggcacgaggaacctatccccatggccacatatggatggaatcttgttaaactgcatagcggcgtggacgtcttctacaagcctaccgagcaagtggatacactgctctgtgacattggcgagtcctctagcaaccccaccatcgaagaggggagaacactgcgggttcttaaaatggtggaaccgtggctgtcctctaagcctgagttttgcatcaaggtcctcaatccctatatgcccaccgtgattgaagaactggagaaactgcagcgcaagcacggaggcaacctcgtgagatgtcctcttagcagaaattccacgcacgaaatgtactgggtctctggggctagcggaaacatcgtttccagcgtgaatacaacctctaaaatgctgctgaacagattcaccacacggcatcgcaagcccacgtatgagaaagatgtggacctcggcgccgggaccagatccgtcagcacagaaaccgagaagcctgatatgacaattatcggacggcgcctgcagagacttcaggaggaacacaaagagacctggcattacgaccaagaaaatccgtaccggacatgggcgtatcacggctcttacgaggccccctccaccggcagcgcttcttccatggtgaacggggttgtgaagctgctcacgaagccttgggatgtcattcccatggtgacccagctggccatgacagacaccacaccttttggacagcagcgcgttttcaaagaaaaggtggacaccagaacgccccaaccgaaacctggcacacggatggtcatgaccacaaccgctaattggctgtgggccctcctggggaagaaaaagagcccccgcctttgcacgagagaggagtttatctccaaggtgcggagcaacgcggccatcggagctgttttccaggaagaacagggctggacctctgccagcgaagctgtgtccgattctcgcttttgggagctggtcgacaaagaaagagccctccaccaagaggggaagtgtgagagctgcgtgtataatatgatgggcaaacgggaaaagaaactgggagagttcggccgcgctaaggggtccagagccatttggtacatgtggcttggagcgcggtttctggagttcgaggccctcggcttcctgaacgaagatcattggtttgggagagagaactcttggagcggagtcgagggcgaagggctgcaccgcctcggctatatcctggaggaaattgacaagaaagatggagaccttatgtacgctgatgacacagccggctgggatacccggatcacagaggacgatctgcagaatgaggaactcattaccgagcagatggctcctcatcacaagatcctggccaaagccatcttcaaacttacatatcagaacaaagtggttaaggtgctgagacccacccctcgcggggcggtcatggacattatctcccggaaggatcaaagaggatctggccaggtggggacgtacagcctcaatacatttaccaacatggaagtgcagctgattcgccagatggaggctgaaggagttatcacccaagacgacatgcagaatcccaaaggcctgaaggagcgggtggagaactggctcagagaatgcggggtcgatcgcctgaaacggatggccatttccggcgacgattgtgtggttaagccgcttgacgagagattcggaacaagcctgctctttctgaatgatatgggcaaagtgcgcaaggacatccctcagtgggaaccctctaaagggtggaagaactggcaggaggtccccttctgctcccatcactttcacaagatcttcatgaaagatggacggagccttgtggtcccttgtagaaatcaagacgaactgattggccgggccagaatctctcagggggctggatggtccctccgcgagaccgcctgcctgggcaaggcttacgcccagatgtggagcctgatgtattttcatcggagagatctccgcctggcgtccatggccatttgttctgctgtgccgacagagtggttccccacgagcagaaccacatggtccatccacgcccatcaccagtggatgaccacagaagacatgcttaaagtttggaaccgggtgtggattgaggataatcctaacatgatcgacaagacccccgtccacagctgggaagacattccttacctggggaaacgcgaggatctctggtgcggctctctgatcggactttccagcagagctacgtgggccaagaatatccataccgcgattacacaagtgcggaacctgatcggcaaggaagagtatgttgactacatgcccgtgatgaaacgctattctgcccctagcgagtccgaaggggtcctctga

SEQ ID NO: 20963 - RNA, 9867 nt, synthetic construct
  misc_feature 1..9867: note = derived and/or modified CDS sequence (opt5) from DENV-4__GQ868583__SS-prME
  source 1..9867: mol_type = other RNA
agcaccatcaccctgctctgcctgattcccacggtgatggccttccacctttccaccagagacggagaacctctgatgatcgtcgctaagcatgaacgggggcgcccgctcctgtttaaaacaaccgaggggattaacaagtgtacacttatcgccatggatctgggagaaatgtgcgaggacaccgttacatacaaatgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggatccttagaaatcctggcttcgctctgctcgccggctttatggcttacatgatcgggcagacaggcattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctcttattagcaatatcaccacagccacccgctgcccgacgcaaggagagccctatctgaaggaggaacaggaccagcagtacatttgtagacgggatgtggtggaccgcggctgggggaacggatgcggcctcttcgggaaaggaggcgtcgtgacatgcgcgaagttttcttgttccggcaaaatcaccgggaatctggttcaaattgagaaccttgaatataccgtggtcgtgacagttcataatggagatacccacgccgtgggcaacgacacaagcaatcacggggtcacggctaccatcacacctagatctccctccgtggaggtcaagctgcctgattacggagaactcaccctggactgcgagccccggagcggcatcgacttcaacgagatgattctgatgaagatgaaaaagaaaacatggctcgtgcataagcagtggtttctggatcttccgctgccttggaccacgggggccgacacctctgaagttcactggaattacaaagagagaatggtgacattcaaggtcccccatgctaaacgccaggatgtgaccgttctcggctcccaggaaggagccatgcacagcgccctggctggcgcgacagaggtggactccggggatggaaaccacatgtttgccggccatcttaagtgtaaggtccggatggaaaaactgagaatcaaggggatgtcttataccatgtgcagcggaaaattctccattgacaaggagatggctgagacgcaacacggcacaaccgtggtgaaagttaagtacgaaggggccggcgccccttgtaaggtccccatcgagattcgcgatgtgaataaagaaaaggtggtcggacgggtgatcagcgctacacccctcgccgagaacaccaactctgttaccaatatcgagctggaacctccgttcggcgactcctatattatgatcggggtgggaaacagcgcgctgacactccattggtttagaaaaggctctagcattgggaagatgttcgagtccacgtaccgcggagctaaacggatggccatcctgggcgaaaccgcctgggattttgggtctgtcggcggacttttcacaagcctgggcaaggctgtgcaccaggtttttgggtccgtgtataccacaatgttcggaggcgtcagctggatgattagaatcctcatcgggtttctggtgctgtggattggaaccaattctcgcaacacgtccatggccatgacatgcatcgctgttggcgggattacccttttcctcggctttaccgtgcaggccgacatgggatgtgtcgtgagctggtctggccgggagctgaagtgcgggtccggaatcttcgtggtcgataatgttcatacatggaccgaacaatacaaatttcagcccgagagccctgcgagactggcctccgctattctcaacgcccacaaggacggcgtgtgtgggatccgctctacaacgcggctggagaatgtgatgtggaaacagattaccaacgaacttaattatgtcctgtgggagggaggccacgacctcacagtggttgctggcgatgtgaagggggtcctgaccaaaggaaagagagccctggcgccccctgccagcgaccttaagtactcctggaaaacatggggcaaggctaaaatcttcacccccgaagcccggaactctacgtttctcatcgatgggccggacaccagcgagtgccctaatgaacgcagagcttggaactccttcgaggtggaggattacggattcggcatgtttacaaccaatatttggatgaagttccgggaagggagctctgaggtttgtgaccatagactgatgtccgccgccatcaaagatcagaaggctgtgcacgcggacatgggatattggattgaaagctctaaaaaccaaacatggcagatcgagcgcgcctccctgattgaagtcaagacctgcctctggcccaagacacataccctgtggagcaatggcgtgcttgagtctcagatgctgatccctaaaagctacgctggccccttttcccagcacaactatcggcaagggtacgccacgcagacagttggaccttggcacctcggcaagctggagatcgatttcggggaatgccccggaaccaccgtgacaattcaggaggactgtgatcatagaggcccgagcctgcgcaccacgacagcctctgggaaacttgtcacccagtggtgctgtagatcctgcacaatgcctcccctccggtttctgggagaagacggctgttggtatggcatggagatccgccccctgagcgagaaggaagagaacatggtgaaatcccaagtgaccgctgggcagggaacatctgaaaccttcagcatgggcctcctgtgccttacgctgtttgtcgaggaatgtctcagacggcgcgttaccagaaagcacatgattctggccgtggtgatcacactgtgcgcgattatccttgggggactcacctggatggatctgctgcgggctctcatcatgctgggcgacacaatgtccgggcgcattggaggccagacccatcttgccatcatggccgtcttcaagatgtctcctggctacgtgctgggggtttttctcagaaaactgacgagccgggagacagctctgatggtgattggaatggccatgaccacaaccctttccatcccgcacgacctgatggagctcattgatggcatctctctggggctcatcctgcttaagattgtcacccagttcgacaatacacaagtgggaacgctggcgctcagcctgacctttatccgctccacaatgagcctggttatggcttggagaaccattatggccgtgcttttcgtcgtgacactgatccccctctgtcggacctcttgcctgcagaaacagtcccattgggtcgaaattacggccctcatcctgggcgctcaagcccttcctgtgtatctgatgacactcatgaagggggctagcagacgctcttggcccctgaacgagggaattatggccgttggcctggtgtcccttctgggcagcgcgctcctgaaaaatgatgtccctctcgccgggcccatggtggctggaggcctgcttctggccgcttacgttatgtctgggtccagcgccgacctgtccctcgaaaaggccgctaacgtgcagtgggatgagatggcggacatcaccggaagctctcctatcattgaagtcaagcaggatgaggacggcagcttttccatccgggatgtggaggaaaccaatatgattacactgcttgtgaaactggccctcatcaccgtttctgggctgtaccccctcgctattccggtcacaatgacgctgtggtatatgtggcaagtgaagacccaaagaagcggagccctttgggacgtgccttcccccgccgctacacagaaagccgcgctgtctgagggcgtctaccgcatcatgcagcggggcctgttcgggaagacccaggtgggagttggcatccacatggaaggggtgttccacacaatgtggcatgtcaccagaggaagcgtgatttgtcacgagacgggccgcctcgaaccttcctgggctgatgttcggaacgacatgatctcttatgggggaggctggagactgggcgataaatgggacaaggaggaggacgtgcaagtccttgccattgaacccgggaagaatccgaaacatgtgcagaccaagcctggactgtttaaaacactcaccggcgagatcggggccgttacactggatttcaagcccggaaccagcggctcccctattatcaaccgcaaagggaaggtgatcggcctctacggaaatggcgtcgtgacaaaaagcggggactatgtgtctgctattacgcaggccgaacggatcggagagcccgattacgaggtcgacgaagatatttttagaaagaagcggctgaccatcatggaccttcaccccggcgcggggaaaacaaagcgcattctgccttccatcgttagagaggctctgaaacggcgcctcagaaccctgattcttgccccgacccgggtggtggccgctgaaatggaggaagccctgagaggactccccatccgctatcagacgcctgctgtcaagagcgagcatacaggccgggagatcgtggatctgatgtgccacgccaccttcacaaccagactcctgtcttccacacgcgttcccaactacaatcttattgtgatggacgaagcgcactttaccgatcctagctccgtcgccgctcgggggtacatctctacgagagtggagatgggcgaagccgctgccattttcatgacagccacaccccctggagctaccgacccgtttccccaaagcaactcccctatcgaggatattgaacgcgagatccccgagcggagctggaatacaggcttcgactggatcaccgactatcaggggaaaacagtttggtttgtgccttctattaaggcgggaaacgatatcgccaattgcctgagaaagtccggcaaaaaggtcattcagctgagccgcaaaaccttcgacacggaataccccaagacaaaactcaccgattgggactttgtggtcacaaccgatatctctgagatgggggctaacttcagagccggacgggtgattgacccgcgcagatgtctgaagcctgttatccttacggatggccccgaacgggtgatcctggccgggcccattcctgtgacccccgctagcgccgcgcaacgcagaggccggatcggaagaaaccctgctcaggaggacgatcagtatgtcttctccggcgacccgctcaagaatgatgaagaccatgcccactggacagaggccaaaatgctgctggataacatttacacccccgaggggatcattcctacactctttggacccgaacgcgagaagacccaggctatcgacggcgagttccggcttagaggggagcaacgcaaaacatttgttgagctgatgcggagaggagacctgcctgtgtggctctcttataaggtggccagcgcgggcatttcctacaaagatcgggaatggtgcttcaccggcgagcgcaataaccagatcctggaagagaatatggaagtcgagatctggacgagagagggggaaaagaagaaacttcggcccaagtggctggacgcccgcgtgtatgctgatccgatggccctccaggactttaaagagttcgcttctggaagaaagagcattacactggatatcctgaccgaaattgcctccctccctacctaccttagctctcgggctaaactggccctggacaacatcgttatgctccatacaaccgagcgcggcgggagagcgtaccagcacgccctgaatgaacttcccgagtccctggagacactcatgctggtggctctgctcggagccatgacggctggcatttttcttttctttatgcaagggaagggaatcggcaagctgagcatgggcctgatcaccattgccgtcgcctccgggctcctgtgggtggctgaaatccagcctcagtggattgcggcctctatcattcttgagttctttctgatggtcctcctgatccccgaacctgagaaacagcggacaccccaagataaccagctgatctatgtgattctcaccatccttacaattatcggactgattgctgccaatgaaatgggcctgatcgagaagaccaaaacggacttcgggttttaccaggttaagaccgagacaaccattctcgatgtggacctgcgcccggccagcgcttggacactttatgccgtcgcgaccacgatcctgacacctatgctcagacacaccatcgaaaacacatccgccaatctgtctctggctgccattgctaaccaggccgcggtgctcatgggacttggcaaagggtggcccctgcatcggatggatctgggagttcccctcctggccatgggctgttacagccaagtgaatcctaccacccttacagcttccctggtcatgctcctggtgcactatgccatcattggcccggggctgcaggctaaggccacgagagaggctcagaaacgcaccgccgcgggaatcatgaagaaccccacagtggacggcattaccgttatcgatctcgaacctatcagctacgaccccaagttcgagaaacaacttgggcaggtcatgctgctggtgctctgcgccggacagctgcttctgatgcggacaacctgggctttctgtgaggtgctcacgctggccacaggccctattctgaccctctgggaagggaatcccggaagattttggaacaccacaatcgctgtctctaccgccaacattttccgcggctcctatcttgccggcgcggggctggcttttagcctgatcaagaatgcccagacacctcggagaggaacgggcaccacaggggagaccctcggagaaaaatggaagcgccaactgaactctcttgaccggaaagagttcgaagagtacaagagatccggcattctggaggttgatcgcacagaagctaagagcgccctcaaagacgggtctaagatcaaacatgccgtgagccggggatcctctaagatcagatggattgtggagcgcggcatggtcaaaccgaagggcaaggtggttgatctggggtgcggacggggcgggtggagctactatatggctaccctgaaaaatgtgacggaagtcaagggatacaccaaaggcgggcccggacacgaggaacctatccccatggccacatatggctggaacctcgtgaaacttcattccggcgttgacgtgttttacaaacctaccgagcaggtcgatacactgctgtgtgacattggggagagctcctctaatcccaccatcgaagagggaagaacactccgcgtgctgaagatggtggaaccgtggcttagctccaagcctgagttctgcattaaagtcctgaacccctatatgcccaccgttatcgaagaactcgagaagctgcagagaaaacacggcgggaatctggtgcggtgtcctctctctcgcaacagcacgcacgaaatgtactgggtgtccggagcgtctggcaatattgtcagctccgtgaacacaaccagcaagatgcttctgaatagatttaccacacggcatagaaaacccacgtatgagaaggatgttgacctgggggccggaacccggtctgtgtccacagaaaccgagaaacctgatatgacaatcatcggccgcagactccagcggctgcaagaggaacacaaggagacctggcattacgaccaggaaaacccgtaccgcacatgggcttatcacggcagctacgaggccccctctaccgggtccgctagctctatggtcaatggagtggttaaacttctgacgaaaccttgggatgtgattcccatggtcacccagctcgccatgacagacaccacacctttcggccagcaaagagtgtttaaggaaaaagttgacacccggacgccccagccgaagcctgggacacgcatggtgatgaccacaaccgcgaactggctgtgggccctgctcggcaagaagaagaatcccagactgtgcacgcgggaggagttcatctccaaagtccgcagcaacgctgccattggcgctgtgtttcaggaagaacaggggtggacctccgccagcgaagctgtctctgatagcagattctgggagcttgtggacaaggaacgggccctgcaccaggagggcaaatgtgagtcctgcgtttataatatgatgggaaagcgcgagaagaagctcggcgagtttgggagagcgaagggatctcgggccatctggtacatgtggctgggcgctcgcttccttgagttcgaggccctggggtttctcaacgaagatcattggttcggaagagagaacagctggtccggcgtggagggggaaggcctgcaccggctgggatatattctcgaggaaatcgacaaaaaggatggcgacctgatgtacgctgatgacacagccgggtgggataccagaatcacagaggacgatcttcagaatgaggaactgattaccgagcagatggcccctcatcacaaaatcctcgcgaaggctatttttaaactgacatatcaaaacaaggtcgtgaaggtgcttcgccccacccctcggggagccgttatggacatcatttctagaaaagatcagcgcggcagcggacaggtgggaacgtacggcctgaatacattcaccaacatggaagtccagctcatccggcaaatggaggccgaaggggtgatcacccaggacgacatgcagaatcccaagggcctgaaagagagagttgagaagtggctgcgcgaatgcggagtggatcggctcaaaagaatggctatttccggcgacgattgtgtcgtgaagccgctggacgagcgctttgggacatctcttctgttcctcaacgatatgggaaaagtccggaaggacatccctcagtgggaacccagcaagggctggaaaaattggcaagaggtgcccttttgctcccatcacttccacaagatttttatgaaagatgggagaagcctggttgtgccttgtcgcaaccaggacgaacttatcggacgggccagaatttctcagggcgctgggtggtccctgcgggagaccgcctgcctcggcaaggcgtacgcccagatgtggagcctgatgtatttccatagacgcgatctgcggctcgcttctatggccatctgttccgctgtcccgacagagtggtttcccacgagcagaaccacatggtccatccacgcccatcaccaatggatgaccacagaagacatgctgaaagtgtggaatcgcgtttggattgaggataaccctaatatgatcgacaagacccccgtgcactcttgggaagacattccttaccttggaaagagagaggatctgtggtgcggcagcctcatcgggctgtccagccgggcgacgtgggccaaaaacattcataccgctatcacacaggtccgcaatcttattggaaaggaagagtatgtggactacatgcccgtgatgaaaagatattctgccccttccgagagcgaaggcgttctgtga

SEQ ID NO: 20964 - RNA, 9867 nt, synthetic construct
  misc_feature 1..9867: note = derived and/or modified CDS sequence (opt5) from DENV-4__GQ868584__SS-prME
  source 1..9867: mol_type = other RNA
agcaccatcaccctgctctgcctgattcccacggtgatggccttccacctttccaccagagacggagagcctctgatgatcgtcgctaagcatgaacgggggagaccgctcctgtttaaaacaaccgagggaattaacaagtgtacacttatcgccatggatctgggagaaatgtgcgaggacaccgttacatacaaatgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccagcgcgtggagtcttggatccttagaaatcctggcttcgctctgctcgccggctttatggcttacatgatcgggcagacaggcattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctcttattagcaatatcaccacagccacccgctgcccgacgcaaggagagccctatctgaaggaggaacaggacagacagtacatttgtcggcgcgatgtggtggacagaggctgggggaacggatgcggcctcttcgggaaaggaggcgtcgtgacatgcgcgaagttttcttgttccggcaaaatcaccgggaatctggttcagattgagaaccttgaatataccgtggtcgtgacagttcataatggagatacccacgccgtgggcaacgacacaagcaatcacggggtcacggctaccatcacacctcggtctccctccgtggaggtcaagctgcctgattacggagaactcaccctggactgcgagcccagaagcggcatcgacttcaacgagatgattctgatgaagatgaaaaagaaaacatggctcgtgcataagcaatggtttctggatcttccgctgccttggaccacgggggccgacacctctgaagttcactggaattacaaagagcgcatggtgacattcaaggtcccccatgctaaacggcaggatgtgaccgttctcggctcccaggaaggagccatgcacagcgccctggctggcgcgacagaggtggactccggggatggaaaccacatgtttgccggccatcttaagtgtaaggtcagaatggaaaaactgcgcatcaaggggatgtcttataccatgtgcagcggaaaattctccattgacaaggagatggctgagacgcagcacggcacaaccgtggtgaaagttaagtacgaaggggccggcgccccttgtaaggtccccatcgagattcgggatgtgaataaagaaaaggtggtcggaagagtgatcagcgctacacccctcgccgagaacaccaactctgttaccaatatcgagctggaacctccgttcggcgactcctatattatgatcggggtgggaaacagcgcgctgacactccattggtttcgcaaaggctctagcattgggaagatgttcgagtccacgtaccggggagctaaaagaatggccatcctgggcgaaaccgcctgggattttgggtctgtcggcggacttttcacaagcctgggcaaggctgtgcaccaagtttttgggtccgtgtataccacaatgttcggaggcgtcagctggatgattcgcatcctcatcgggtttctggtgctgtggattggaaccaattctcggaacacgtccatggccatgacatgcatcgctgttggcgggattacccttttcctcggctttaccgtgcaggccgacatgggatgtgtcgtgagctggtctggcagagagctgaagtgcgggtccggaatcttcgtggtcgataatgttcatacatggaccgaacagtacaaatttcaacccgagagccctgcgcgcctggcctccgctattctcaacgcccacaaggacggcgtgtgtgggatccggtctacaacgagactggagaatgtgatgtggaaacagattaccaacgaacttaattatgtcctgtgggagggaggccacgacctcacagtggttgctggcgatgtgaagggggtcctgaccaaaggaaagcgggccctggcgccccctgccagcgaccttaagtactcctggaaaacatggggcaaggctaaaatcttcacccccgaagcccgcaactctacgtttctcatcgatgggccggacaccagcgagtgccctaatgaaagacgggcttggaactccttcgaggtggaggattacggattcggcatgtttacaaccaatatttggatgaagttcagagaagggagctctgaggtttgtgaccatcgcctgatgtccgccgccatcaaagatcagaaggctgtgcacgcggacatgggatattggattgaaagctctaaaaaccagacatggcaaatcgagcgggcctccctgattgaagtcaagacctgcctctggcccaagacacataccctgtggagcaatggcgtgcttgagtctcagatgctgatccctaaaagctacgctggccccttttcccagcacaactatagacaggggtacgccacgcaaacagttggaccttggcacctcggcaagctggagatcgatttcggggaatgccccggaaccaccgtgacaattcaggaggactgtgatcatcgcggcccgagcctgagaaccacgacagcctctgggaaacttgtcacccagtggtgctgtcggtcctgcacaatgcctcccctccgctttctgggagaagacggctgttggtatggcatggagatcagacccctgagcgagaaggaagagaacatggtgaaatcccaggtgaccgctgggcaaggaacatctgaaaccttcagcatgggcctcctgtgccttacgctgtttgtcgaggaatgtctccggcgcagagttacccggaagcacatgattctggccgtggtgatcacactgtgcgcgattatccttgggggactcacctggatggatctgctgcgcgctctcatcatgctgggcgacacaatgtccgggagaattggaggccagacccatcttgccatcatggccgtcttcaagatgtctcctggctacgtgctgggggtttttctccggaaactgacgagccgcgagacagctctgatggtgattggaatggccatgaccacaaccctttccatcccgcacgacctgatggagctcattgatggcatctctctggggctcatcctgcttaagattgtcacccagttcgacaatacacaggtgggaacgctggcgctcagcctgacctttatcagatccacaatgagcctggttatggcttggcggaccattatggccgtgcttttcgtcgtgacactgatccccctctgtagaacctcttgcctgcaaaaacagtcccattgggtcgaaattacggccctcatcctgggcgctcaggcccttcctgtgtatctgatgacactcatgaagggggctagccgccggtcttggcccctgaacgagggaattatggccgttggcctggtgtcccttctgggcagcgcgctcctgaaaaatgatgtccctctcgccgggcccatggtggctggaggcctgcttctggccgcttacgttatgtctgggtccagcgccgacctgtccctcgaaaaggccgctaacgtgcaatgggatgagatggcggacatcaccggaagctctcctatcattgaagtcaagcaggatgaggacggcagcttttccatcagagatgtggaggaaaccaatatgattacactgcttgtgaaactggccctcatcaccgtttctgggctgtaccccctcgctattccggtcacaatgacgctgtggtatatgtggcaagtgaagacccagcgcagcggagccctttgggacgtgccttcccccgccgctacacaaaaagccgcgctgtctgagggcgtctaccggatcatgcagagaggcctgttcgggaagacccaggtgggagttggcatccacatggaaggggtgttccacacaatgtggcatgtcacccgcggaagcgtgatttgtcacgagacgggccggctcgaaccttcctgggctgatgttagaaacgacatgatctcttatgggggaggctggcgcctgggcgataaatgggacaaggaggaggacgtgcaggtccttgccattgaacccgggaagaatccgaaacatgtgcaaaccaagcctggactgtttaaaacactcaccggcgagatcggggccgttacactggatttcaagcccggaaccagcggctcccctattatcaaccggaaagggaaggtgatcggcctctacggaaatggcgtcgtgacaaaaagcggggactatgtgtctgctattacgcaggccgaaagaatcggagagcccgattacgaggtcgacgaagatatttttcggaagaagcgcctgaccatcatggaccttcaccccggcgcggggaaaacaaagcgcattctgccttccatcgttcgggaggctctgaaacgcagactccggaccctgattcttgccccgaccagagtggtggccgctgaaatggaggaagccctgcgcggactccccatccggtatcagacgcctgctgtcaagagcgagcatacaggcagagagatcgtggatctgatgtgccacgccaccttcacaacccgcctcctgtcttccacacgggttcccaactacaatcttattgtgatggacgaagcgcactttaccgatcctagctccgtcgccgctagagggtacatctctacgcgcgtggagatgggcgaagccgctgccattttcatgacagccacaccccctggagctaccgacccgtttccccagagcaactcccctatcgaggatattgaacgggagatccccgagagaagctggaatacaggcttcgactggatcaccgactatcaagggaaaacagtttggtttgtgccttctattaaggcgggaaacgatatcgccaattgcctgcgcaagtccggcaaaaaggtcattcagctgagcagaaaaaccttcgacacggaataccccaagacaaaactcaccgattgggactttgtggtcacaaccgatatctctgagatgggggctaacttccgggccggacgcgtgattgacccgagacggtgtctgaagcctgttatccttacggatggccccgaacgcgtgatcctggccgggcccattcctgtgacccccgctagcgccgcgcagagacggggcagaatcggacgcaaccctgctcaagaggacgatcagtatgtcttctccggcgacccgctcaagaatgatgaagaccatgcccactggacagaggccaaaatgctgctggataacatttacacccccgaggggatcattcctacactctttggacccgaacgggagaagacccaggctatcgacggcgagttcagacttcgcggggagcagcggaaaacatttgttgagctgatgagacggggagacctgcctgtgtggctctcttataaggtggccagcgcgggcatttcctacaaagatcgcgaatggtgcttcaccggcgagagaaataaccaaatcctggaagagaatatggaagtcgagatctggacgcgggagggggaaaagaagaaacttcgccccaagtggctggacgccagagtgtatgctgatccgatggccctcaaagactttaaggagttcgcttctggacggaaaagcattacactggatatcctgaccgaaattgcctccctccctacctaccttagctctcgcgctaagctggccctggacaacatcgttatgctccatacaaccgagagaggcgggcgggcgtaccagcacgccctgaatgaacttcccgagtccctggagacactcatgctggtggctctgctcggagccatgacggctggcatttttcttttctttatgcaggggaagggaatcggcaaactgagcatgggcctgatcaccattgccgtcgcctccgggctcctgtgggtggctgaaatccagcctcaatggattgcggcctctatcattcttgagttctttctgatggtcctcctgatccccgaacctgagaagcagcgcacaccccaggataaccagctgatctatgtgattctcaccatccttacaattatcggactgattgctgccaatgaaatgggcctgatcgagaaaaccaagacggacttcgggttttaccaagttaaaaccgagacaaccattctcgatgtggacctgagaccggccagcgcttggacactttatgccgtcgcgaccacgatcctgacacctatgctccggcacaccatcgaaaacacatccgccaatctgtctctggctgccattgctaaccaggccgcggtgctcatgggacttggcaaggggtggcccctgcatagaatggatctgggagttcccctcctggccatgggctgttacagccaggtgaatcctaccacccttacagcttccctggtcatgctcctggtgcactatgccatcattggcccggggctgcaggctaaagccacgcgcgaggctcaaaagcggaccgccgcgggaatcatgaagaaccccacagtggacggcattaccgttatcgatctcgaacctatcagctacgaccccaaattcgagaagcagcttgggcaggtcatgctgctggtgctctgcgccggacaactgcttctgatgagaacaacctgggctttctgtgaggtgctcacgctggccacaggccctattctgaccctctgggaagggaatcccggacgcttttggaacaccacaatcgctgtctctaccgccaacattttccggggctcctatcttgccggcgcggggctggcttttagcctgatcaaaaatgcccagacacctagacgcggaacgggcaccacaggggagaccctcggagaaaagtggaaacggcagctgaactctcttgacagaaaggagttcgaagagtacaagcgctccggcattctggaggttgatcggacagaagctaaaagcgccctcaaggacgggtctaaaatcaagcatgccgtgagcagaggatcctctaaaatccgctggattgtggagcggggcatggtcaagccgaagggcaaagtggttgatctggggtgcggaagaggcgggtggagctactatatggctaccctgaagaatgtgacggaagtcaaaggatacaccaagggcgggcccggacacgaggaacctatccccatggccacatatggctggaacctcgtgaaacttcattccggcgttgacgtgttttacaagcctaccgagcaggtcgatacactgctgtgtgacattggggagagctcctctaatcccaccatcgaagagggacgcacactcagagtgctgaagatggtggaaccgtggcttagctccaaacctgagttctgcattaaggtcctgaacccctatatgcccaccgttatcgaagaactcgagaaactgcaacggaagcacggcgggaatctggtgcgctgtcctctctctagaaacagcacgcacgaaatgtactgggtgtccggagcgtctggcaatattgtcagctccgtgaacacaaccagcaaaatgcttctgaatcggtttaccacaagacatcggaagcccacgtatgagaaagatgttgacctgggggccggaacccgctctgtgtccacagaaaccgagaagcctgatatgacaatcatcggcagacggctccagcgcctgcaggaggaacacaaggagacctggcattacgaccaggaaaacccgtacagaacatgggcttatcacggcagctacgaggccccctctaccgggtccgctagctctatggtcaatggagtggttaaacttctgacgaagccttgggatgtgattcccatggtcacccaactcgccatgacagacaccacacctttcggccagcagcgggtgtttaaagaaaaggttgacacccgcacgccccagccgaaacctgggacaagaatggtgatgaccacaaccgcgaactggctgtgggccctgctcggaaagaagaaaaatccccggctgtgcacgcgcgaggagttcatctccaaggtcagaagcaacgctgccattggcgctgtgtttcaagaagaacaggggtggacctccgccagcgaagctgtctctgatagccggttctgggagcttgtggacaaagaacgcgccctgcaccaggagggcaagtgtgagtcctgcgtttataatatgatgggaaaaagagaaaagaagctcggcgagtttgggcgggcgaaaggatctcgcgccatctggtacatgtggctgggcgctagattccttgagttcgaggccctggggtttctcaacgaagatcattggttcggacgggagaacagctggtccggcgtggagggggaaggcctgcacagactgggatatattctcgaggaaatcgacaagaaagatggcgacctgatgtacgctgatgacacagccgggtgggatacccgcatcacagaggacgatcttcaaaatgaggaactgattaccgagcagatggcccctcatcacaagatcctcgcgaaagctatttttaagctgacatatcagaacaaggtcgtgaaagtgcttcggcccacccctagaggagccgttatggacatcatttctcgcaaggatcagcggggcagcgggcaagtgggaacgtacggcctgaatacattcaccaacatggaagtccagctcatcagacagatggaggccgaaggggtgatcacccaggacgacatgcaaaatcccaaaggcctgaaggagcgcgttgagaaatggctgcgggaatgcggagtggatagactcaagcgcatggctatttccggcgacgattgtgtcgtgaaaccgctggacgagcggtttgggacatctcttctgttcctcaacgatatgggaaaggtcagaaaggacatccctcagtgggaacccagcaaaggctggaagaattggcaggaggtgcccttttgctcccatcacttccacaaaatttttatgaaggatgggcgcagcctggttgtgccttgtcggaaccaggacgaacttatcggcagagcccggatttctcaaggcgctgggtggtccctgagagagaccgcctgcctcggcaaagcgtacgcccagatgtggagcctgatgtatttccatcgccgggatctgagactcgcttctatggccatctgttccgctgtcccgacagagtggtttcccacgagccgcaccacatggtccatccacgcccatcaccagtggatgaccacagaagacatgctgaaggtgtggaatagagtttggattgaggataaccctaatatgatcgacaagacccccgtgcactcttgggaagacattccttaccttggaaaacgggaggatctgtggtgcggcagcctcatcgggctgtccagccgcgcgacgtgggccaagaacattcataccgctatcacacaggtcagaaatcttattggaaaagaagagtatgtggactacatgcccgtgatgaagcggtattctgccccttccgagagcgaaggcgttctgtga

SEQ ID NO: 20965 - RNA, 9867 nt, synthetic construct
  misc_feature 1..9867: note = derived and/or modified CDS sequence (opt5) from DENV-4__GQ868585__SS-prME
  source 1..9867: mol_type = other RNA
agcaccatcaccctgctgtgcctgattcccacggtgatggctttccacctttccacccgggacggagaacctctgatgatcgttgctaagcatgaacgggggcgcccgctcctgtttaaaaccaccgaaggaattaacaagtgtacacttatcgccatggatctgggagaaatgtgcgaggacaccgttacatacaaatgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggaatggggctggagacccgggctgaaacgtggatgagctccgagggagcctggaaacatgcccagcgcgtggagtcttggatccttagaaatcctggcttcgctctgctcgccggctttatggcttacatgatcgggcagacaggcattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctcttattagcaatatcaccacagccacccgctgcccgacgcaaggagagccctatctgaaggaggaacaggaccagcagtacatttgtagacgggatgtggtggaccgcggctgggggaacggatgcggcctcttcgggaaaggaggcgtcgtgacatgcgcgaagttttcttgttccggcaaaatcaccgggaatctggttcaaattgagaaccttgaatataccgtggtcgtgacagttcataatggagatacccacgccgtgggcaacgacacaagcaatcacggggtcacggctaccatcacacctagatctccctccgtggaggtcaagctgcctgattacggagaactcaccctggactgcgagccccggagcggcatcgacttcaacgagatgattctgatgaagatgaaaaagaaaacatggctcgtgcataagcagtggtttctggatcttccgctgccttggaccacgggggccgacacctctgaagttcactggaattacaaagagagaatggtgacattcaaggtcccccatgctaaacgccaggatgtgaccgttctcggctcccaggaaggagccatgcacagcgccctggctggcgcgacagaggtggactccggggatgaaaaccacatgtttgccggacatcttaagtgtaaggtccggatggagaaactgagaatcaagggcatgtcttataccatgtgcagcgggaaattctccattgacaaggagatggctgaaacgcaacacggaacaaccgtggtgaaagttaagtacgagggcgccggggccccttgtaaggtccccatcgaaattcgcgatgtgaataaagagaaggtggtcggccgggtgatcagcgctacacccctcgccgagaacaccaactctgttaccaatatcgaactggagcctccgttcggagactcctatattgtgatcggcgtcgggaacagcgcgctgacactccattggtttagaaaaggatctagcattggcaagatgttcgaatccacgtaccgcggggctaaacggatggccatcctgggagagaccgcctgggattttggctctgttgggggacttttcacaagcctgggaaaggctgtgcaccaggtgtttggctccgtctataccacaatgttcgggggagtgagctggatgattagaatcctcatcggctttctggttctgtggattgggaccaattctcgcaacacgtccatggccatgacatgcatcgctgtgggaggcattacccttttcctcgggtttaccgtccaggccgacatgggctgtgtggtgagctggtctggacgggaactgaagtgcggctccgggatcttcgtcgttgataatgtgcatacatggaccgagcaatacaaatttcagcccgagagccctgcgagactggcctccgctattctcaacgcccacaaggacggagtgtgtggcatccgctctacaacgcggctggaaaatgtcatgtggaaacagattaccaacgagcttaattatgtgctgtgggaagggggacacgacctcacagttgtggctggcgatgtcaagggcgtgctgaccaaagggaagagagccctgacaccccctgcgagcgaccttaagtactcctggaaaacctggggaaaggccaaaatcttcacgcccgaggctcggaactctacctttctcatcgatggcccggacacaagcgaatgccctaatgagcgcagagcctggaactccttcgaggttgaagattacgggttcggaatgtttaccacaaatatttggatgaagttccgggagggcagctctgaagtgtgtgaccatagactgatgtccgctgccatcaaagatcagaaggccgtccacgctgacatggggtattggattgagagctctaaaaaccaaacctggcagatcgaacgcgcgtccctgattgaggtgaagacatgcctctggcccaagacccatacgctgtggagcaatggagttcttgagtctcagatgctgatccctaaaagctacgccggccccttttcccagcacaactatcggcaaggctacgctacacagaccgtggggccttggcacctcggaaagctggaaatcgatttcggcgagtgccccgggaccacagtcaccattcaggaaaactgtgaccatagaggaccgagcctgcgcacgacaaccgcctctggcaaacttgtgacacagtggtgctgtagatcctgcaccatgcctcccctccggtttctgggggaggatggatgttggtatggcatggagatccgccccctgagcgaaaaggaggaaaatatggtgaaatcccaagtcacagccggccaggggacctctgagacgttcagcatgggactcctgtgccttaccctgtttgttgaagagtgtctcagacggcgcgtgacaagaaagcacatgattctggctgtggtcatcaccctgtgcgccattatccttggcgggctcacatggatggacctgctgcgggcgctcatcatgctgggagataccatgtccggccgcattgggggacagacgcatcttgctatcatggccgtgttcaagatgtctcctggctacgttctgggcgtgtttctcagaaaactgacaagccgggagaccgccctgatggtcattgggatggctatgacaaccaccctttccatcccgcacgacctgatggaactcattgacggaatctctctgggcctcatcctgcttaagattgtgacacagttcgataacacgcaagttgggaccctggccctcagcctgacatttatccgctccaccatgagcctggtgatggcgtggagaacaattatggctgtccttttcgtggtcaccctgatccccctctgtcggacgtcttgcctgcagaaacagtcccattgggtggagattacagccctcatcctgggagcccaagcccttcctgtttatctgatgaccctcatgaagggcgccagcagacgctcttggcccctgaatgaagggattatggctgtgggactggtctcccttctgggcagcgccctcctgaaaaacgacgtgcctctcgcgggccccatggttgccgggggactgcttctggctgcctacgtgatgtctggctccagcgctgatctgtccctcgagaaggccgccaatgtccagtgggacgaaatggctgatatcaccgggagctctcctatcattgaggtgaagcaggacgaggatggcagcttttccatccgggacgtggaagagacaaacatgattaccctgcttgttaaactggcgctcatcacagtctctggcctgtaccccctcgccattccgatcacgatgaccctgtggtatatgtggcaagtgaagacacaaagaagcggggctctttgggatgtgccttcccccgccgccacccagaaagctgccctgtctgaaggagtctaccgcatcatgcagcggggcctgttcggcaagacacaggtgggggttggcattcacatggagggcgtgttccacaccatgtggcatgtcacgagagggagcgtgatctgtcacgaaaccggacgcctcgagccttcctgggcggacgttcggaatgatatgatttcttatggcgggggatggagactgggcgacaaatgggataaggaggaagacgtgcaagtccttgctatcgagcccggcaagaacccgaaacatgtgcagacaaagcctgggctgtttaaaaccctcacaggagaaattggcgccgttaccctggacttcaagcccgggacaagcggatcccctatcatcaatcgcaaaggcaaggtgattgggctctacggcaacggagtcgtgacgaaaagcggcgattatgtgtctgccatcacccaggctgagcggattggggagcccgactacgaagtcgatgaggacatctttagaaagaagcggctgacaattatggatcttcaccccggagccggcaaaaccaagcgcatcctgccttccattgttagagaagcgctgaaacggcgcctcagaaccctgatccttgctccgacacgggtggtggccgccgagatggaagaggctctgagagggctccccatccgctatcagacgcctgccgtcaagagcgagcataccggacgggaaattgtggacctgatgtgccacgctacattcaccacaagactcctgtcttccacccgcgttcccaattacaaccttatcgtgatggatgaggcccactttacggaccctagctccgtcgcggcccggggctacatttctacaagagtggaaatgggggaggctgccgctatcttcatgaccgccacaccccctggcgccacagatccgtttccccaaagcaattcccctattgaagacatcgagcgcgagatccccgaacggagctggaacaccggattcgattggattacagactatcagggcaaaaccgtttggtttgtgccttctatcaaggctgggaatgacattgcgaactgcctgagaaagtccggcaaaaaggtcatccagctgagccgcaaaacgttcgatacagagtaccccaagaccaaactcacagactgggattttgtggtcaccacggacatttctgaaatgggcgccaacttcagagctgggcgggtgatcgatccgcgcagatgtctgaagcctgttatccttaccgacggacccgagcgggtgattctggccggccccatccctgtgacacccgccagcgctgcccaacgcagagggcggattggcagaaatcctgcgcaggaagatgaccagtatgtcttctccggagatccgctcaagaacgacgaggatcatgctcactggaccgaggccaaaatgctgctggacaatatctacacacccgaaggcattatccctaccctctttgggcccgagcgcgaaaagacacaggccattgatggagagttccggcttagaggcgagcaacgcaaaacctttgttgaactgatgcggagaggggacctgcctgtgtggctctcttataaggtggctagcgccggaatctcctacaaagaccgggagtggtgcttcacgggcgaacgcaacaatcagatcctggaggaaaacatggaggtcgagatttggacaagagaaggcgagaagaagaaacttcggcccaagtggctggatgcgcgcgtgtatgccgacccgatggctctcaaagattttaaggagttcgcctctgggagaaaaagcatcaccctggacattctgaccgagatcgcttccctccctacataccttagctctcgggccaagctggctctggataatattgttatgctccataccacagaacgcggaggcagagcctaccagcacgcgctgaacgagcttcccgagtccctggaaacgctcatgctggtggccctgctcggggctatgaccgccggaatctttcttttctttatgcagggcaaggggatcggaaaactgagcatgggcctgattacaatcgctgtcgcctccggcctcctgtgggtggccgagattcaacctcagtggatcgctgcgtctattatccttgagttctttctgatggtcctcctgatccccgagcctgaaaagcagcggacaccccaggacaatcaactgatttatgtgatcctcacaattcttaccatcattgggctgatcgccgctaacgagatgggactgattgagaaaacgaagaccgatttcggcttttaccaggttaaaacagaaaccacaatcctcgacgtggatctgcgcccggccagcgcctggaccctttatgctgtcgccacgacaatcctgacccctatgctcagacacacaattgagaatacctccgcgaacctgtctctggccgctatcgccaatcaggctgccgtgctcatggggcttggaaagggctggcccctgcatcggatggacctgggggttcccctcctggcgatgggatgttacagccaggtgaaccctaccacacttacggcctccctggtcatgctcctggtgcactatgctattatcggcccgggcctgcaagccaaagctaccagagaagcccagaagcgcacagctgccgggattatgaagaatcccaccgtggatggaatcacagttatcgacctcgagcctattagctacgatcccaaattcgagaagcagcttggccaagtcatgctgctggtgctctgcgcggggcagctgcttctgatgcggaccacgtgggccttctgtgaagtgctcacactggctaccggacctatcctgaccctctgggagggcaaccccgggagattttggaacacaaccattgccgtctctacagctaatatcttccgcggatcctatcttgccggcgccggcctggcgtttagcctgattaaaaacgctcagacgcctcggagagggaccggaacaaccggcgaaacactcggggagaagtggaaacgccagctcaattctcttgaccggaaggagttcgaggagtacaagagatccggaatcctggaagttgaccgcaccgaggccaaaagcgctctcaaggatggctctaaaatcaagcatgccgtgagccgggggtcctctaaaattagatggatcgtggaacgcggaatggtcaagccgaagggcaaagtgattgacctgggctgcgggcggggaggctggagctactatatggccacgctgaagaacgttaccgaggtgaaagggtacacaaagggaggccccgggcacgaagaacctatccccatggctacctatggatggaatctcgtcaaacttcattccggcgtggatgtcttttacaagcctacagagcaagtggacaccctgctgtgtgatattggcgaaagctcctctaaccccacaatcgaggaagggagaaccctccgcgtcctgaagatggtggagccgtggcttagctccaaacctgagttctgcattaaggtgctgaatccctatatgcccacggtcatcgaggagctcgaaaaactgcagagaaagcacggaggcaacctggttcggtgtcctctctctcgcaatagcacacacgagatgtactgggtgtccggggcctctggaaacatcgtgagctccgtcaataccaccagcaaaatgcttctgaacagatttacaacgcggcatagaaagcccacctatgaaaaagacgtggatctgggcgcggggacacggtctgtttccaccgagacagagaagcctgacatgaccattatcggacgcagactccagcggctgcaggaagaacacaaggaaacatggcattacgatcaagagaatccgtaccgcacctgggcctatcacggcagctacgaagctccctctacgggctccgccagctctatggtgaacggggtcgtgaaacttctgaccaagccttgggacgttattcccatggtgacacagctcgctatgaccgatacaacccctttcggacagcagagagtctttaaagagaaggtggacacgcggacaccccaaccgaaacctggcacccgcatggttatgacaaccacggccaattggctgtgggcgctgctcgggaagaagaaaaaccccagactgtgcacccgggaggagttcatctccaaggtgcgcagcaatgccgctattggagccgtctttcaggaggaacagggctggacatccgctagcgaggccgtgaacgactctagattctgggaacttgtcgataaagagcgggctctgcaccaagaggggaagtgtgaaagctgcgtgtataacatgatgggcaaacgcgagaagaagctcggagaatttggcagagccaaagggtcccgggcgatctggtacatgtggctgggagcccgcttccttgagttcgaagctctgggctttctcaatgaggaccattggttcgggagagagaactcttggagcggagttgaaggcgaggggctgcaccggctgggctatatcctcgaagagattgataagaaagacggagatctgatgtacgccgacgataccgctggctgggacacaagaatcaccgaggatgaccttcagaatgaagaactgattacagaacagatggcccctcatcacaagatcctcgccaaagcgatttttaagctgacctatcagaacaaggtggtcaaagtgcttcgccccacgcctagaggggctgtgatggatatcatctccagaaaggaccaacgcggatctggccaggttgggacatacggactgaataccttcaccaacatggaggtgcagctcattcggcagatggaagccgagggcgtcatcacacaagatgacatgcagaatcccaaagggctgaaggagagagtggaaaaatggctgcgcgagtgcggcgttgaccggctcaagagaatggccattagcggagatgactgtgtggtcaaaccgctggatgaacgctttggcacctcccttctgttcctcaacgacatggggaaggtgcggaaggatatccctcagtgggagccctctaaaggatggaagaattggcaggaagtccccttttgcagccatcacttccacaaaatttttatgaaggacggcagatccctggtggttccttgtcgcaaccaagatgagcttatcgggcgggctagaatcagccagggagccggctggtctctgcgggagacagcttgcctcgggaaagcctacgcgcagatgtggtccctgatgtatttccatagacgcgacctgcggctcgccagcatggctatttgttctgccgtgccgacggaatggtttcccacctccagaacaacctggagcatccacgctcatcaccagtggatgacaaccgaggatatgctgaaggtctggaatcgcgtgtggattgaagacaaccctaatatgatcgataagacgcccgttcactcctgggaggacattccttaccttggcaaaagagaagacctgtggtgcggatctctcatcggcctgagctcccgggccacctgggcgaagaacattcatacagccatcacccaagtgcgcaatcttatcgggaaagaggagtatgtcgattacatgcccgtgatgaagagatatagcgctccttctgaatccgagggagtgctgtga

SEQ ID NO: 20966 - RNA, 9867 nt, synthetic construct
  misc_feature 1..9867: note = derived and/or modified CDS sequence (opt5) from DENV-4__JQ922560__SS-prME
  source 1..9867: mol_type = other RNA
agcaccatcacactgctctgcctgattcccacggtgatggccttccacctttccaccagagacggcgagcctctgatgatcgtcgctaagcatgaacgggggcgcagactcctgtttaaaacaaccgagggaattaacaagtgtacacttatcgccatggatctgggcgaaatgtgcgaggacaccgttacatacaaatgtccgctcctggtgaataccgaacccgaggatattgactgctggtgtaacctgacgtctgcgtgggtgatgtatgggacctgcacacagagcggagagcggcgcagagaaaagcggtccgtcgctctcacccctcactctggcatggggctggagacacgcgccgaaacctggatgagctccgagggagcctggaaacatgctcaaagagtggagtcttggatccttcggaatcccggcttcgccctgctcgctggctttatggcctacatgatcgggcagacgggaattcagcgcacagttttctttatcctgatgatgcttgtggcgcctagctatggcatgagatgtgtcggggtgggaaaccgggatttcgttgaaggcgtgtccgggggagcctgggtcgacctggtgctcgagcacggcggctgcgtgaccacaatggctcaggggaagcccaccctggattttgaactgattaagaccacagccaaagaggtcgctctcctgcgcacgtactgtatcgaagccagcatttctaatatcaccacagcgaccagatgccctacacaaggagagccgtatcttaaggaggaacaggaccagcagtacatttgtcggcgcgatgttgtggacagaggctgggggaacggatgcggcctgttcgggaaaggaggcgtggtcacctgcgccaagttttcctgtacgggcaaaatcacagggaatctcatccaaattgagaacctggaatataccgtggttgtgaccgtccataatggagatacacacgctgtgggcaacgacaccagcaatcacggggttacagccacgatcaccccccggtctccttccgtggaggtcgaacttcccgattacggagagctgacactcgactgcgagcctagaagcggcattgacttcaacgaaatgatcctgatgaagatgaataagaaaacctggctggtgcataagcagtggtttctcgatctgccccttccgtgggctgccggggccgacacatctgaggtccactggaaccataaagaacgcatggtgaccttcaaggttcctcacgctaaacggcaggatgtgacggtcctgggctcccaggagggagcgatgcacagcgccctcaccggcgctacagaagtgtactccggggacggaaatctgatgtttgccggccatcttaagtgtaaagttagaatggagaagctgcgcattaaggggatgtcttataccatgtgcagcggaaaattctccatcgataaggagatggccgaaacacaacacggcaccacggtggtcaaagtgaagtacgagggggctggcgccccctgtaaagtgcctatcgaaattcgggacgttaacaaggagaaggtcgtgggaagagtgatcagctctacacccttcgcggagaacaccaattccgtcacaaacattgaactcgagcccccttttggcgatagctatatcgtgattggggttggagactctgctctgaccctgcattggttcaccaaaggcagctccatcgggaagatgtttgaatctacataccgcggagccaaacggatggccatcctcggcgagacggcttgggatttcgggagcgtgggcggactgcttacctccctgggcaaggccgtccaccaggtgtttgggagcgtttatacaaccatgttcggaggcgtgtcttggatggtcagaattctcatcgggtttctggtgctgtggattggaacaaattcccgcaacaccagcatggctatgtcttgcatcgccgttggcgggattacgcttttcctcggctttacagtgcatgcggacatgggatgtgccgtctcctggagcggcaaagaactgaagtgcgggtccggaatcttcattatcgataatgtgcacacctggaccgagcagtacaagtttcaaccggagtctcccgctcggctggccagcgctatcctcaacgcccacaaagacggcgtgtgtgggattagatccacaacccgcctggaaaatgtcatgtggaagcagatcacaaacgagcttaattatgttctgtgggaaggaggccatgacctcacggtggtggcgggcgatgtcaaaggggtgctgtctaagggaaaacgggccctggctcctcccgttaacgaccttaagtacagctggaagacctggggcaaagccaagattttcacacctgagaccagaaattccacatttctcatcgatgggcccgacaccagcgaatgcccgaacgagcggcgcgcttggaatttcctggaggtggaagattacggattcggcatgtttacgaccaacatttggatgaaattcagagaggggtcttccgaaatgtgtgaccaccggctgatgagcgccgccatcaaggatcagaaagctgtccatgcggacatgggatattggatcgagtcttccaagaatcagacatggcaaattgaaaaagccagcctcatcgaggtgaagacctgcctgtggcctaagacacacaccctttggtctaacggcgttctggagagccagatgctcattcccaaagcttacgccggccctttttcccagcacaactatagacaggggtacgccacacaaaccgtgggaccctggcatctgggcaagctggaaatcgatttcggggagtgccctggaacgacagtcaccattcaggaagactgtgatcaccgcggccccagccttcggaccacaaccgcttctgggaaactcgtgacgcagtggtgctgtagatcctgcacaatgccgcctctgcgctttctgggagaggacggctgttggtatggcatggagatcagacccctcagcgaaaaggaggaaaatatggttaaatcccaggtgtctgccgggcaaggaaccagcgagacattctccatgggcctgctttgcctgaccctctttgtcgaagagtgtctgcggcgcagagtgacacggaagcatatgatcctggtggtcgttaccacgctttgcgcgattatcctcgggggactgacctggatggatctgctccgcgctctgattatgcttggcaacacaatgtctagcagaatggggggacagatccacctggccattatggccgtgttcaagatgtcccccggctacgtgctcggcatctttctgcggaaactgacctctcgcgagacagctcttatggtcatcgggatggccatgaccacggtgctgagcattcctcatgacctcatggaattcgttgacggaatctccctgggcctcattctgcttaagatggtgacacactttgataatacccaggtcgggacactggcgctcagcctgaccttcatcaaatctaccatgccgctggtgatggcttggagaacaattatggccgttctttttgtggtcacgctgatccccctctgtcggacctcctgcctgcagaagcaaagccactgggtggagattacagccctcatcctgggagctcaggcccttcctgtctatctgatgaccctcatgaaaggcgcttctaagcgctcctggcccctgaacgaagggatcatggccgtgggactggttagccttctgggctctgcgctcctgaagaatgacgtgcctctcgccggccccatggtcgctgggggactgcttctggccgcttacgtgatgtccggcagctccgccgatctgagcctcgagaaagccgctacagttcagtgggacgaaatggcggatattaccgggtctagccctatcattgaggtgaagcaagacgaggatggatccttctctatcagagacgtcgaagagacgaacatgattacactgcttgtgaaactggccctcatcaccgtgagcggcctgtaccccctcgctatcccggttaccatgacactgtggtatatgtggcaggtcaagacccagcggtccggggccctttgggatgtgccttctcccgccgctgcccagaaagcgacactgacggaaggagtgtacagaattatgcaacgcggcctgttcggcaagacccaggtcggggtgggaatccatatggagggcgtttttcacacaatgtggcatgtgacccgggggagcgtcatttgtcacgaatccggaagactcgagccttcttgggctgacgtgcgcaatgatatgatcagctatggcgggggatggcggctgggcgacaagtgggataaagaggaagacgttcaggtgcttgccgtcgagcccggcaagaacccgaaacatgtgcagacaaagcctgggctgttcaaaaccctcacgggagaaattggcgccgttaccctggactttaagcccgggacatccggaagccctatcatcaatagaaaaggcaaggtgattgggctctacggcaacggagtcgtgaccaagtctggcgattatgtgtccgctatcacacaagccgagcgcattggggagcccgactacgaagtcgatgaggacatcttccggaaaaagagactgaccattatggatcttcaccccggagcgggcaaaacaaagcgcatcctgcctagcattgttcgggaagctctgaaaagacggctccgcacgctgatccttgccccgaccagagtggtggccgctgagatggaagaggccctgcgggggctccccatccgctatcagacacctgctgtcaagtctgagcacaccggaagagaaattgtggacctgatgtgccatgccacctttacaacgcggctcctgtccagcaccagagttcccaattacaaccttatcgtgatggatgaggcgcacttcacagacccttcctctgtcgccgctcgcggctacattagcacccgggtggaaatgggggaggccgctgccatctttatgacagccaccccccctggcacgacagatccgttcccccagtccaatagccctattgaagacatcgagagagagatccccgaacgctcttggaacaccggatttgattggattaccgactatcagggcaagacagtttggttcgtgccttccatcaaagctgggaatgacattgcgaactgcctgcggaagagcggaaaaaaggtcgtgcaactgtctagaaaaacctttgatacagagtaccccaagaccaagctcacggactgggatttcgtcgtgacaaccgacatcagcgaaatgggcgccaacttccgcgctgggcgggttattgatccgagacgctgtctgaaacctgtgatcatcacagacggacccgagagagtgattcttgccggccccatccctgtcacccccgcctccgctgcccagcggcgcgggagaattggccggaatcctgcgcaggaagatgaccaatatgttttttctggagatccgctgcgcaacgacgaggatcatgctcactggacggaggccaagatgctcctggacaatatctacacccccgaaggcattatccctacactgttcgggcccgagagagaaaaaacccaggccattgatggagagtttcggctcagaggcgagcagcgcaagacattcgtggaacttatgcggagaggggacctgcctgtgtggctgagctataaagtcgcttccgccggaatctcttacaaggaccgcgagtggtgctttaccggcgaacggaacaatcagatcctcgaggaaaacatggaggtggagatttggacaagagaaggcgagaagaaaaagctgcggcccaaatggcttgatgcgcgcgtttatgccgacccggtggctctgaaggatttcaaagaatttgccagcgggagaaagtccatcaccctcgacattctgacggagatcgctagcctgcctacatacctctcttcccgggccaagcttgctctggataatattgtcatgctgcacaccaccgaacgcggaggcaaagcctaccaacatgcgctcaacgagctgcccgagagccttgaaacactgatgctcatcgccctgctgggggctatgaccgccggaatcttcctctttttcatgcagggcaaggggatgggaaaactttccatgggcctgattgctatcgccgtggcctctggcctgctctgggtcgctgagattcagcctcagtggatcgcggccagcattatcctggaatttttccttatggctctgctcatccccgagcctgaaaagcaaagaacaccccaggacaatcagctgatttatgtgatcctgacgattctcaccatcattgggcttgttgccgccaacgagatgggactgatcgagaaaacaaagaccgattttggcttctaccaggaaaaaacagagaccacgattctggacgtggatctccggccggcttccgcctggaccctgtatgcggtcgccacaaccatccttacacctatgctgcgccacaccatcgaaaatacgtctgctaacctcagcctggccgctattgccaatcaagcggccgtgctgatggggctcggaaagggctggccccttcatagaatggacctgggggttcccctgctcgctatgggatgttactcccaggtgaaccctacaaccctgacagccagccttgtcatgctgctcgtgcactatgctatcattggcccgggcctgcaggccaaggctacccgggaggcccagaaacgcaccgcggccgggatcatgaagaatcccacagtggatggaattacggttatcgacctggagcctatctcttacgatcccaaattcgaaaagcaactcggccaggtcatgcttctggtgctgtgcgctgggcagctcctgcttatgagaaccacatgggccttttgtgaggtgctgaccctcgctacaggacctattctgaccctgtgggaaggcaaccccgggcggttctggaacacgacaatcgccgtctccaccgccaatatttttagaggaagctatctcgcgggcgctggccttgccttctctctgatcaaaaacacccaaacacctcgccgggggaccggaacaacgggcgagaccctgggggaaaagtggaagagacagctcaattccctggaccgcaaagagtttgaggaatacaagcggagcggaattcttgaggttgacagaacagaagctaaatctgccctgaaggatggcagcaaaatcaagtacgccgtgtcccgcgggacctctaagatccggtggattgtggagagaggaatggtcaaaccgaagggcaaagtggttgacctcggctgcgggcgcggaggctggagctattacatggctacactgaagaacgtgaccgaagtcaaagggtatacgaagggaggccccgggcatgaggagcctatccccatggccacctacggatggaatctggtgaagctccactccggcgttgatgtgttctataaacctacagaacaggtcgacacccttctgtgtgatattggcgagagctcctctaaccccacaatcgaagaggggcggaccctgagagtgctcaagatggtggaaccgtggctgagctccaaacctgagttttgcattaaggtccttaatccctacatgcccacagttatcgaggaactggagaaactccagcgcaagcacggaggctctctggtgcggtgtcctctgagcagaaactccacccatgaaatgtattgggtgtctggggtcagccgcaatattgtgtccagcgttaacacgacatctaaaatgctccttaatagattcaccacccggtaccgcaagcccacatacgagaaggacgcggatctgggagccggcacgagatccgtgagcaccgagacagaaaaacctgacatggctatcatcgggcggagactgcaacggctccaggaggaacacaaggagacctggcattatgatcaggaaaacccgtaccgcacatgggcctatcacggatcttacgaggctccctccaccggcagcgcctcttccatggtcaatggcgtggttaaactgcttacaaagccttgggacgtggtccccatggtgacccagctggcgatgacggataccacaccttttgggcaacagagagttttcaaagagaaggtggacacccggacaccccagccgaagcctggaacccgcatgattatgacgacaaccgccaactggctctgggctctgctgggcaaaaagaaaaatcccagactctgcacacgggaagagtttatcagcaaggtccgctccaacgccgctattggggccgtgagccaggaagagcaaggatggacctctgctagcgaagccgtcaatgactccagattctgggagctggtggataaagagcgggcgcttcaccaggaaggcaagtgtgagtcttgcgtttataacatgatggggaagcgcgaaaaaaagctgggcgagtttggaagagccaaaggcagccgggctatctggtacatgtggctcggggcccgcttcctggaattcgaggctcttggatttctgaacgaggaccattggttcggcagagaaaattcctggtctggggtggagggagaaggcctccaccggctggggtatattctggaggatatcgacaagaaagatggcgacctcatctacgccgatgacacggccggatgggatacccgcattacagaggacgatctgcttaacgaagagctgatcaccgaacagatggcgcctcatcacaagattctcgctaaggccatctttaaactgacataccaaaataaggtcgtgaaagtgcttagacccacccctaagggcgccgttatggacattatcagccggaaagatcagagagggtccggacaggtgggcacatatgggctgaacaccttcacgaatatggaggtccagctcatccgccaaatggaagctgagggagtgattacacgggacgacatgcataaccccaagggcctgaaagagagagttgaaaagtggctgaaggagtgcggggtggatcgcctcaaacggatggccatctctggcgacgattgtgtcgtgaagccgctggacgaaagatttagcacctcccttctgttcctcaatgatatgggaaaagtccgcaaggacattcctcagtgggagcccagcaaaggctggaagaactggcaggaagtgcccttttgctctcaccacttccataagatctttatgaaagatgggcggtccctggttgtgccttgtagaaatcaggacgagcttattggacgcgctcggatcagccaaggcgccgggtggtctctgagagagaccgcgtgcctcggaaaggcctacgctcagatgtggtccctgatgtatttccaccgccgggatctgagactcgccagcatggctatctgttccgccgtcccgacagaatggtttcccacctctcggacaacgtggagcattcatgcgcaccaccagtggatgaccacagaggacatgctgaaagtgtggaacagagtttggatcgaagataatcctaacatgaccgacaagacacccgtgcattcctgggaggacattccttaccttggcaaacgcgaagatctgtggtgcgggagcctcatcggcctgtcttcccgggccacctgggctaagaatattcacacggccatcacccaggtcagaaaccttattggaatcgaggagtatgtggactacatgcccgtgatgaagcgctatagcgctcctttcgaatctgagggcgttctgtga

SEQ ID NO: 20967 - RNA, 9867 nt, synthetic construct
  misc_feature 1..9867: note = derived and/or modified CDS sequence (opt5) from DENV-4__JQ922558__SS-prME
  source 1..9867: mol_type = other RNA
agcaccctgacactcctgtgccttatccccacggtgatggccttccacctgtccaccagagacggcgagcctctcatgattgtcgctaagcatgaacgggggcgcccgctgctttttaaaacaaccgagggaatcaacaagtgtacactgattgccatggatctcggcgaaatgtgcgaggacaccgttacatacaaatgtcccctgctggtgaataccgaacctgaggatatcgactgctggtgtaacctcacgtctacctgggtgatgtatgggacatgcacccagagcggagagagacggcgcgaaaagagatccgtcgcgctgacaccccactctggcatggggcttgagacccgggctgaaacgtggatgagctccgagggagcctggaaacatgcccaacgcgtggagtcttggattctgagaaatcctggcttcgctctcctggccggctttatggcttacatgatcgggcagacaggaatccagcggaccgttttctttgtgcttatgatgctggtcgcccccagctatggcatgcgctgtgtgggggttggaaacagagatttcgtggaaggcgtctccgggggagcgtgggtggacctcgtgctggagcacggcggctgcgtcacaaccatggcccaggggaagcctaccctggattttgaactcattaagacaacggctaaagaggttgccctgcttcggacctactgtatcgaagctagcatttctaatatcacaaccgccacacgctgcccgacccaaggagagccctatctgaaggaggaacaggaccagcagtacatttgtagacgggatgtggtggaccgcggctgggggaacggatgcggcctcttcgggaaaggaggcgtcgtgacgtgcgcgaagtttctgtgtcttggcaaaatcacagggaatctggttcaaattgagaacctcgaatataccgtggtcgtgaccgttcataatggagatacacacgccgtgggcaacgacatctccaatcacggggtcaccgctacaatcacgcctagaagcccctctgtggaggtcaagctgcctgattacggagaactgaccctcgactgcgagccccggtccggcattgacttcaacgagatgatcctgatgaagatgaaaaagaaaacatggcttgtgcataagcagtgggttctggatctcccgctgccttgggccgctggggccgacaccagcaaagtgcagtggaattacaaggaaagaatggtcacatttaaagtgccccacgccaagcgccaggatgttaccgtgcttggctctcaagagggagctatgcattccgcgctgacgggcgccaccgaagtcgacagcggggatggaaaccacatgttcgctggccacctcaagtgtaaagtgcggatggagaagctgagaattaaagggatgtcctatacaatgtgctctggaaagtttagcatcgacaaagaaatggccgagacccagcatggcacaaccgtggttaaggtcaagtacgagggggccggcgctccttgtaaagtgcccattgaaatccgcgatgtgaataaggagaaagtcgtgggacggatcatttccagcacgcccttcgccgaacacacaaactctgttaccaacatcgagctggagcctccgttcggcgactcctatattgtgatcggggtcggagatagcgcgctcacactgcattggtttagaaagggctctagcattgggaaaatgttcgaatccacctaccgcggagctaagcggatggccatccttggcgagaccgcctgggactttgggtctgtgggcggactgttcacaagcctcggcaaggctgttcaccaggtgtttgggtccgtctatacgaccatgttcggaggcgtgagctggatggttagaatcctgattgggctgcttgtgctctggatcggaacaaattctcgcaacacctccatggccatgacatgcattgctatcggcgggattaccctgtttctgggcttcacggtccatgccgatatgggatgtgcggtgagctggtctggcaaagaactcaagtgcgggtccggaatctttgtggtcgacaatgttcacacatggaccgagcaatacaaattccagcccgaaagccctgcccggctggcttccgccattcttaacgctcacaaggacggcgtgtgtgggatcagatctaccacacgcctggagaatgtgatgtggaaacagatcaccaacgagctcaattatgtcctgtgggaaggaggccatgatctgacagtggttgccggcgacgtgaagggggtccttacgaagggaaaacgggcgctcaccccccctgtgaacgatctgaagtacagctggaaaacatggggcaaggccaaaatttttacccccgaggctagaaattccacattcctgatcgacgggccggatacctctgaatgccctaacgagcggcgcgcctggaattttctcgaagttgaggactacggattcggcatgttcacgaccaacatttggatgaagtttagagaggggagctccgaagtgtgtgatcaccggctgatgagcgctgccatcaaagaccagaaggccgtccatgctgatatgggatattggattgagtcttccaagaatcaaccctggcagatcggcaacgcgagccttatcgaagtgaaaacatgcctgtggcctaagacccacacactctggtctaatggcgttctggagtcccagatgctgattcccaaagcctacgctgggcctttcagccagcacaactatagacaaggatacgccacccagacaatcggcccctggcatcttgggaagctcgaaattgactttggagagtgcccgggcaccacggtgacaatccaggaggattgtaaccaccgcgggccttctctgcggaccaccacagccagcggaaaactggtcacccagtggtgctgtagatcctgcacgatgccccccctccgcttcctgggcgaagacggctgttggtatgggatggagattagacctcttagcgaaaaggaggagaatatggtgaagtctcaagtgtccgctggacagggcacaagcgaaaccttttccatggggctgctctgcctgacactgttcgtcgaggaatgtcttcggcgcagagttacccggaaacatatgatcctcgtggtggtcacaaccctgtgcgccatcattctgggaggcctcacgtggatggatctgcttcgcgcgctgatcatgctcggggacaccatgtctggaagaatgggcggccagattcacctgacaatcatggctgtgtttaagatgagcccggggtacgttctgggagtgttccttcggaaactgacctcccgcgagacagccctcattgtcatcggcatggccatgaccacggtgctgtctatcccccatgacctcatggaatttattgatgggatcagcctgggacttattctgctcaagatggttgctcacttcgacaacacacaggtgggcaccctggccctgtcccttacatttatcagatctaccatgcctctggtcatggcgtggcggaccattatggctgtgctcttcgtcgtgacactgatccccctctgtcgcacgagctgcctgcaaaaacagtcccactgggttgagattaccgcccttatcctgggggcccaggctctccctgtgtatctgatgacactgatgaagggagccagcaagagatcttggccccttaatgagggcatcatggctgtcggcctggtgtccctcctggggagcgccctcctgaaaaacgatgttcctcttgcgggacccatggtggccggcgggctgctgctcgctgcctacgtcatgtctggatccagcgctgacctgtctcttgaaaaggccgccaatgtgcattgggatgagatggctgacattaccggctccagcccgatcattgaagtgaaacaagatgaggacgggtcctttagcatccgggatgttgaagagacaaacatgattaccctgctcgtcaagctggcgctcatcacggtgtctggactgtaccctcttgccatccccgtgacaatgaccctgtggtatatgtggcaggtcaaaacccagagaagcggcgctctgtgggacgtgccttcccccgccgccgctcagaaggccacactcaccgagggcgtttaccgcattatgcaacgggggctgttcggaaagacacaggtgggcgtcgggatccacatggaaggagtgttccatacgatgtggcacgttaccagaggctctgtgatttgtcatgagacagggcgccttgaaccgagctgggcggatgtccggaatgacatgatctcctatggaggcggctggagactgggggataaatgggacaaggaggaagacgtgcaggttctcgctattgagcctggaaaaaaccccaagcacgtgcagaccaaacctggcctgtttaagacactcaccggggagatcggagccgtcacgctggatttcaaacccggcacctctgggagccccatcattaataagaagggcaaagtgatcggactttacggcaacggggtggtcacaaagtccggagactatgtttctgccattacccaagctgaacgcatcggcgatcctgactacgaggtggatgaagacatttttcggaaaaagagactgacaatcatggatctgcacccgggggccggaaaaaccaagcgcattctccccagcatcgtgcgggaggcgctgaagagacggcttcgcacactgatcctcgctcctacgagagtcgtggccgccgagatggaagaggctctgcggggcctccccattcgctatcagacccctgccgttaaatccgaacatacagggagagagatcgtggacctgatgtgccacgctaccttcaccgccaatccccttagctctacacgggtccctaactacaatctgattgtgatggatgaagcgcatctgcaggacctctccatcgttgccgctagaggctacattagcacgcgcgtggagatgggagaggccgctgccatctttatgaccgccacaccgcccggcgctaccgatcctttcccccagtctaactcccctatcgaagacattgagcgggaaatccccgagagaagctggaatacagggtttgactggattaccgattatcaaggaaagacggtctggttcgtgccgtccatcaaagcgggcaacgacattgccaactgcctgcgcaagtctgggaaaaaggtcatccagcttagccggaagacatttgataccgaataccctaaaaccaagctgacagactgggatttcgtggttaccacagacatctccgagatgggagctaattttagagcccgccgggtgattgatcccagacgctgtctcaaacccgtgatcctgaccgacggccctgagagagtcattctggccgggcccatccctgttacgccggctagcgccgcgcagcggcgcggcagaattggacggaaccccgctcaagaagatgaccagtatgtgttctctggcgatcctctcaagaatgacgaggatcacgcccactggacagaagccaaaatgcttctggacaacatctacacccccgaggggattatccctacactgttcggacccgaacgcgagaagatccaggctattgacggcgagtttagactccggggggaacagagaaagaccttcgtggagctgatgcgccggggagatcttccggtctggctgtcctataaagtggccagcgcgggcatctcttacaaggacagagaatggtgctttacgggcgagcgcaataaccaaattctcgaggaaaatatggaggttgaaatctggacccgggagggggaaaaaaagaaactgagacctaagtggctggatgcccgggtgtatgctgaccccatggccctcaaggatttcaaagagtttgctagcggacgcaagtccattacacttgacatcctgaccgagatcgcctctctgcctacatacctcagctccagagctaaactggcccttgataacattgtcatgctgcataccacagaacggggcgggcgcgcgtaccagcacgccctcaatgagctgcccgaatctctggagaccctcatgcttgtggctctgctgggagccatgacggctggcatcttcctctttttcatgcaggggaagggaattggcaaactgagcatgggccttatggccatcgccgtcgcttccgggctgctctgggtggcggaaattcagcctcaatggatcgccgctagcatcattctggagtttttctctatggccctgctcatccccgagccggaaaagcagagaacacctcaggacaaccagcttatttatgttatcctgaccattctgaccatcattggactcatcgccgctaatgagatgggcctgatcgaaaaaacaaagaccgattttgggttctaccaagtgaagacagagacgaccattcttgacgtcgatctgcggcccgcctccgcgtggacactctatgccgtggctaccacaatcctgacccccatgctgcgccatacgattgaaaacaccagcgccaatctctcccttgctgccatcgcgaaccaggccgctgttctgatgggactgggcaaagggtggcctctccacagaatggacctgggagtgccgcttctggccatgggctgttactctcaggtcaatcccacaaccctcacagctagcctggtgatgctgtccgtgcattatgccattatcggccctgggctccaggctaaggccacccgggaggcgcaaaaacgctctgccgctggaatcatgaagaaccccacggttgatggcattacagtcatcgaccttgagcctattagctacgaccccaaatttgaaaagcagctggggcaggtgatgctgctcgccctgtgcgctggacaacttctgctcatgagaaccacatgggccttctgtgaggtgctgaccctggccaccggccctatcctcacactttgggaagggaacccgggacggttctggaatacgaccattcccgtctccacagcgaacatctttagaggcagctatctggctggcgccgggctggctttctctctcatcaagaatgcccagacccctcgccggggaacaggcaccacgggggagacactgggagagaaatggaagagacagcttaactccctggatcgcaaagaatttgaggaatacaagcggagcggcattttcgaggttgacagacacgaaatcaaatacaccctcaaggatgggtctaagattaatcacgccatgtccaccggaagcatcaaaattcgcggcatcgacgagcggggcatggtgaagcccaaagggaaggtggtcgatcagggatgcggcagagggggatggtctcattatacagctaccgccaaaaaggtgacagaggttaagggctacacgaaagggggacctggccacgaagagcccattccgatggcgacctatggctggaacctggtgaagctgcatagcggggtcgacgtgttttacaaacctacagaacaagttgataccctcctttgtgacatcggagagtcctctagcaatcccacaatcgaagagggccgcaccctgcgggtgctgaagatggtcgagccctggctctccagcaaacctgaattctgcattaaggtgctgaacccctatatgcctacggtgatcgaggaacttgagaaactgcagagaaagcacgggggatccctcgtccgctgtccgctgtctcggaatagcacccacgaaatgtactgggtttccggcgtgtctgggaacattgtgagctccgtcaatacaacctctaagatgctgctcaacagatttacaacccgccatagaaaacccacatatgagaaggatgtggaccttggagccggcacccggagcgtttccatcgagacggaaaaacctgatatgacaattatcggccgcagactgcagcggctgagagaggaacacaaggagacctggcattacgaccaggagaatccctaccggacctgggcttatcacgggagctacgaagccccttctacaggatccgctagctctatggtgaacggcgtcgtgaaactcctgacgaagccctgggacgttatcccgatggtgacccaacttgccatgacagataccacacctttcgggcagcagcgcgagtttaaggaaaaagtctatacctccacaccccatcctaagccctggaccagaatggtgatgacgaccacagcgaattggctgtgggccctcggaggcaaaaagaaaagccctcggctgtgcacctgggaggaattcatttctaaggttcgctccaacgctgccatcggggctgtgtttcaggaggagcaaggctggacaagcgcctccgaagctgtcaatgacagcagattctgggagctggtggataaggaacgggccctccaccaggagggaaaatgtgaatcttgcgtctacaacatgatgggcaagcgcgagaaaaagctgggggagtttggaagagcgaaaggcagccgggccatttggtatatgtggcttggggctcgcttcctggaattcgaggccctcggatttctgaacgaagaccactggttcggcagagagaattcctggtctggggtggaaggcgagggacttcatcggctgggctacatcctcgaggatattgacaagaaggatggggacctgatctatgctgatgacaccgccggatgggatacgcgcatcacagaagacgatctgctcaacgaggaactgattaccgagcagatggccccccaccatagaatccttgcgaaagctatttttaagctgacataccacagcaaagttatgaaggtgctccggccgacccctaaaggcgccgtcatggacatcatttcccgcaaggaccaaagagggtctggacaggtgggcacgtacgggctgaataccttcacaaacatggaggtgcagcttatccggcagatggaagccgagggcgttatcacccaagatgacatgcagaatcccaaaggactgaaggaaagagtggagaagtggctcaaagaatgcggcgtcgatcgcctgaagcggatggctattagcggggacgattgtgtggttaaacccctggacgagagattttccacatctctcctgttccttaacgatatgggaaaggtgcgcaaagacatccctcagtgggagccgagcaagggctggaagaattggcaggaagtccccttttgctcccaccatttccacaaaatttttatgaaggatgggcggagcctggtggtcccttgtagaaaccaagacgagctcatcggacgcgcccggatttctcagggcgctgggtggtccctgagagaaaccgcctgccttggcaaagcgtatgcccagatgtggagcctgatgtacttccatcgccgggatctcagactggcttctatggccatctgttccgctgtgcccacagagtggtttcctaccagccgcacgacatggtccattcacgcccatcaccagtggatgaccaccgaagacatgctgaaggtttggaatcgggtgtggatcgaggacaaccccaatatgacagataaaacccctgtccactcttgggaggacgtgccctatctcggaaagagagaagatctgtggtgcggcagccttatcgggctgtccagccgggcgacatgggccaagaacattcatacggctatcacccaagttagaaatctcattggaaaagaggaatacgtggactatatgccggtcatgaagcgctactctgcccctatcgagtccgaaggcgtgctgtga

SEQ ID NO: 20968 - RNA, 9867 nt, synthetic construct
  misc_feature 1..9867: note = derived and/or modified CDS sequence (opt5) from DENV-4__JQ922559__SS-prME
  source 1..9867: mol_type = other RNA
agcaccatcacactgctctgcctgattcccacggtgatggccttccacctttccaccagagacggcgagcctctgatgatcgtcgctaagcatgaacgggggcgcccgctcctgtttaaaacaaccgagggaattaacaagtgtacacttatcgccatggatctgggcgaaatgtgcgaggacaccgttacatacaaatgtcccctcctggtgaataccgaacctgaggatattgactgctggtgtaacctgacgtctgcgtgggtgatgtatgggacctgcacacagagcggagagagacggcgcgaaaagagatccgtcgctctcaccccccactctggcatggggctggagacacgggccgaaacctggatgagctccgagggagcctggaaacatgctcaacgcgtggagtcttggatccttagaaatcctggcttcgccctgctcgctggctttatggcctacatgatcgggcagacgggaattcagcggacagttttctttatcctgatgatgcttgtggcgcccagctatggcatgcgctgtgtcggggtgggaaacagagatttcgttgaaggcgtgtccgggggagcctgggtcgacctggtgctcgagcacggcggctgcgtgaccacaatggctcaggggaagcctaccctggattttgaactgattaagaccacagccaaagaggtcgctctcctgcggacgtactgtatcgaagccagcatttctaatatcaccacagcgacccgctgcccgacacaaggagagccctatcttaaggaggaacaggaccagcagtacatttgtagacgggatgttgtggaccgcggctgggggaacggatgcggcctgttcgggaaaggaggcgtggtcacctgcgccaagtttctctgttccggcaaaatcacggggaatctggtgcaaatcgagaaccttgaatatacagttgtggtcaccgtgcataatggagatacccacgctgttggcaacgacattagcatccacggggtgacagccaccattacacctagatctccctccgtcgaggtgaagctgcctgattacggagaactcacgctggactgcgagccccggagcggcatcgacttcaatgagatgattctgatgaagatgaaaaagaaaacctggctcgtccataagcagtggtttctggatcttccgctgccttggacagctggggccgacacctctgaagtgcagtggaactacaaagagagaatggttacattcaaggtgccccacgccaaacgccaggatgtcaccgtgctcggctcccaagaaggagctatgcatagcgcgctgacgggcgccaccgaggttgactccggggatggaaatcacatgtttgctggccaccttaagtgtaaggtgcggatggaaaaactgagaatcaaggggatgtcttatacaatgtgcagcggaaaattctccatcgacaaggagatggccgagacccagcatggcacaaccgtcgtgaaagtgaagtacgaaggggccggcgctccttgtaaggttcccattgagatccgcgatgtcaacaaagaaaaggtggtgggacggattatcagctctacgcccttcgccgagaatacatattccgtcaccaacattgagctcgaacctccgtttggcgacagctacatcatcattggggtgggagattctgcgctgacactgcactggttcagaaaaggcagctccatcgggaagatgtttgagtctacctatcgcggagctaaacggatggccattctcggcgaaaccgcctgggacttcgggagcgttggcggactgcttacatccctgggcaaggctgtgcatcaggtctttgggagcgtgtacacgaccatgttcggaggcgtttcttggatggtgagaatcctcattgggctgctggtcctttggatcggaacaaactcccgcaataccagcatggccatgtcttgcattgctgtgggcgggatcacactctttctgggcttcaccgttcacgccgatatgggatgtgcggtgtcctggagcggcaaggagctgaaatgcgggtccggaatctttgtcattgacaacgtgcatacgtggacagaacaatataagttccagcccgagtctcctgcccggctcgctagcgccatcctgaatgctcacaaagacggcgtgtgtgggattagatccaccacccgccttgagaacgtcatgtggaagcagatcacaaatgaactgaactacgttctctgggagggaggccacgatctgaccattgtggccggcgacgtgaaaggggtcctgtctaagggaaagcgggcgcttgccccccctgtgaatgatctcaaatacagctggaagacatggggcaaagctaagatctttacgcccgaaaccagaaactccacattcctgatcgacgggccggataccagcgagtgccctaatgaacggcgcgcctggaactttctggaggttgaggactatggattcggcatgttcacaaccaatatttggatgaaatttagagaagggtcttccgaggtgtgtgatcatcggctcatgagcgctgccatcaaggaccagaaagccgtccacgctgatatgggatactggattgaatcttccaagaaccaaacgtggcagatcgagaaggcgagcctgattgaagtgaaaacctgcctttggcccaagacacataccctgtggtctaatggcgttctcgagagccagatgctgatccctaaagcctatgctggccccttctcccagcacaactacagacaagggtatgccacacagaccgtgggaccttggcacctgggcaagcttgagatcgactttggggaatgccccggaacaaccgtcacgattcaggaggattgtgaccatcgcggcccgagcctccggacaaccaccgcctctgggaaactggtgacacagtggtgctgtagatcctgcaccatgcctcccctgcgcttcctcggagaagatggctgttggtacggcatggagatcagacccctgagcgagcgggaagagaatatggttaagtcccaagtgtctgctgggcagggaacgagcgaaacattttccatgggccttctgtgcctcaccctgttcgtcgaggaatgtctgcgcagacgggtgacacgcaagcacatgattcttgtggtcgttaccacactctgcgccatcattctggggggactgacctggatggacctcctgagagcgcttatcatgctgggcgacacgatgtctagccggatggggggacagatccatctcgctattatggccgtgtttaaaatgtcccctggctatgtgctgggcatcttcctgcgcaagcttacctctagagagacagccctgatggtcattgggatggctatgaccacagtgctcagcatcccgcacgatctgatggagtttattgacggaatctccctcggcctgattcttctgaaaatggttacccatttcgataacacgcagatggggacactcgccctgagcctgacctttatcaagtctacaatgccccttgtgatggcgtggcggaccatcatggctgtcctgttcgtggttaccctcattcctctgtgtcgcacatcctgcctccaaaaacagagccactgggtggaaatcacggccctgattcttggagcccaggctctgcccgtctacctcatgaccctgatgaagggcgcctctaagagatcctggcctctgaacgaggggatcatggctgtgggacttgtcagcctgctcggctctgccctgctcaaaaatgacgtgcccctggcgggccctatggttgccgggggacttctgctggctgcctacgtgatgtccggcagctccgctgatctcagcctggaaaaggccgccaacgtccaatgggacgagatggctgatattacagggtctagccccatcatcgaagtgaaacaggacgaggatggatccttttctattcgggacgttgaggaaaccaatatgatcacacttctggtgaagctcgcgctgattaccgtcagcggcctctatccgctggccatccctgtgacgatgacactttggtacatgtggcaggtgaaaacccagagatccggggctctgtgggatgttccctctcctgccgccgctcaaaaggccaccctgacagagggagtctatcgcattatgcagcggggcctcttcggcaagacccaggtgggggtgggaatccacatggaaggcgtcttccatacaatgtggcacgtgacgagagggagcgttatctgtcatgagtccggacgcctggaaccctcttgggcggacgtgcggaacgatatgattagctacggcgggggatggagacttggcgacaaatgggacaaggaggaggatgtccaggtgctggctatcgaaccgggcaaaaatcctaagcacgttcaaaccaaacccgggctctttaagacactgaccggagagattggcgccgtgacactcgacttcaaacctgggacctccggaagccccatcattaaccgcaagggcaaggtcatcgggctgtatggcaatggagtggttacgaaatctggcgattacgtgtccgccattacccaggctgaacggatcggggagcccgactatgaggtcgatgaagacatctttagaaagaaacgccttacaattatggatctgcatcctggagccggcaagaccaaacggatcctgccgagcattgtgagagaggcgctcaagcggcgcctgagaacacttatcctggctcccacccgggtggtcgccgccgaaatggaggaagctctccgcgggctgcctattagataccagacacccgccgttctctctgagcacacgggacgggagatcgtggacctgatgtgccacgctaccttcacaaccagacttctgtccagcacccgcgtgcctaactacaatctgatcgtcatggatgaagcccattttacagacccctcctctgtggcggcccggggctatattagcacgagagttgagatgggggaagctgccgctatcttcatgaccgccacacctccgggcaccacagatccctttcctcagtccaacagccccattgaggacatcgaacgcgagattcctgagcggtcttggaataccggattcgactggatcacggattaccaaggcaagacagtgtggtttgtcccctccatcaaagccgggaacgacattgctaattgcctcagaaagagcggaaaaaaggtgatccagctgtctcgcaaaaccttcgataccgaatatccgaagacaaagcttaccgactgggattttgttgtgacaaccgacattagcgtcatgggcgcgaacttccgggccgggagagtgatcgatcctcgcagatgtctgaaacccgtcattatcacggacggacccgagcgggtgattctcgctggccctatccccgttacacctgcctccgccgctcagcgcagagggcggatcggccgcaatccggcccaagaagatgaccagtacgtgttctctggagatcccctgagaaacgacgaggatcacgcgcattggaccgaagctaagatgctgctcgacaacatttatacacctgagggcatcattcccaccctttttgggcctgagcgggaaaaaacgcaggccatcgacggagagttcagactgcgcggcgaacagcggaagacctttgtggagctgatgagacgcggggatctccccgtctggctgagctacaaagttgcctccgctggaatttcttataaggaccgggagtggtgcttcacaggcgaaagaaataaccaaatccttgaggaaaatatggaggtggaaatctggacccgggagggcgagaagaaaaagctgcgcccgaaatggctcgatgccagagtgtacgcggaccctatggccctgaaggattttaaagaattcgctagcgggcggaagtccattacactggacatcctcaccgagattgccagccttcccacatacctgtcttcccgcgctaagctggccctcgataacatcgtcatgctgcacaccacggaaagaggaggcaaagcttatcagcacgcccttaatgagctgcctgaaagcctcgagacactgatgctggtggcgctccttggggccatgaccgctggaatttttctgttctttatgcagggcaaggggatcggagagctgtccatgggcctcatcgccattgctggcgcctctgggctgctttggggaaccaaaacaccccctccctggggcgccgctagcaacatcctggaattctttctcatggttctgctgattccggagcctgaaaagcagcggaccccccaagacaatcagctcatctacgtgattcttacaatcctgacgattatcgggctggtcgcggccaacgagatgggactcatcgaaaaaaccaagacagatttcggcttttatcaggtgaaaaccgagacaaccattctggacgtcgatcttcgccccgcttccgcctggacgctgtacgccgtggctaccacaatcctcacccctatgctgagacatacaattgagaatacctctgccaacctgagcctcgcggccatcgctaatcaggccgctgttcttatggggctgggaaagggctggccgctgcaccggatggacctcggcgtgcccctgcttgccatggggtgttattcccaagtcaaccctacgacactgattgcgagcctcgtgatgctgctggttcattacgccatcatcggacccggcctccaggctaaggccacccgcgaagctcagaaaagaacagccgctgggattatgaagaatcctaccgtggatggaatcaccgtcattgaccttgagcccatctcttatgaccctaaattcgaaaagcagctgggccaagtgatgctgctcgtgctgtgcgccgggcagcttctgctcatgcggacaacgtgggcgttctgtgaggttctgaccctggccacaggaccgattctcaccctttgggagggcaaccccggcagattttggaatacaaccatcgctgtctccacggccaacatcttccgcgggagctacctggctggagccggcctggccttttctctcattaaaaacgcgcagacacctcggagagggaccggagtgaccggcgaaacactgggggagaagtggaagcgccaacttaattccctggatcggaaagaattcgaggaatacaagagaagcggaatcctcgaggtggaccgcaccgaggctaaatctgccctgaaggatggcagcaaaattaagcaggctgtctcccggggcacatctaagatcagatggattgttgaacgcgggatggtgaaacccaagggaaaagtggtcgacctgggctgcgggcggggaggctggagctattacatggccacgctcaagaacgtgaccgaggttaaagggtatacaaagggaggccctggccacgaagagcccatcccgatggccacctacgggtggaatcttgtgaagctgcattccagagtcgatgtgttttataaacctacagaacaggttgacaccctgctctgtgatattggagagagctcctctaaccccacgatcgaggaaggccgcaccctgcgggtgcttaagatggtcgagccctggctgagctccaaacctgaattctgcatcaaggtgctcaatccctacatgcctacagtgattgaggaactggagaaactgcagagaaagcacgggggatctctcgtccgctgtccgcttagcagaaactccacccacgagatgtattgggtttctggcgtgagcgggaatatcgtgtccagcgtcaacacaacctctaaaatgctgctgaatcggtttacaaccaagcatcgcaagcccacgtacgaaaaagacgctgatctcggagccggcacaagatccgtgagcaccgagaccgaaaagcctgacatgacaattatcggccggagactgcaacggcttcaggaggagcaccaggaaacgtggcattacgatcaggagaacccctatcgcacctgggcgtaccacgggggatatgaagccccttctacaggctccgctagctctatggttaatggggtggtcaaactgctcaccaagccctgggacgtgattccgatggttacacaactggccatgaccgacacaacccctttcggacagcagagagtgtttaaagagaaggtcgatacgcggaccccccagcctaagcccggcacacgcatggtgatgaccacaaccgctaactggctgtgggccctcctggggaaaaagaaaaatcctagactttgcacgcgggaagagttcatctccaaggttcgcagcaacgcggccatcggcgctgtgtcccaagaggaacagggatggacaagctcttttgaggccgtcaatgacagcagattctgggaactggtggataaagagcgggctctccaccaggaaggcaagtgtgagtcctgcgtctacaacatgatggggaagcgcgagaaaaagctgggagaatttggcagagccaaagggtctcgggctatttggtatatgtggcttggagcccgcttcctggagttcgaagcgctcggctttctgaatgaggaccattggttcgggagagaaaacagctggtccggcgtggagggagagggcctgcaccggctcgggtacatcctggaagatcttgacaagcgcgatagatctctggtttttgccgacgataccgctggatgggacacaaaaattcccgaggatgacctcctgaaggaaaagccgatccctggccccatggccccccatcaacggattcctgctagagccatcttcaaacttacctatcagaacaaggtggtcaaagtgctgcgcctcaagctgaaaggggccgtgatggatatcattagccggaaggagcagagaggatccggccaggttgggacgtacggcctgaatacctttacaaacatggaggtgcaactcatccgccagatggaagcggagggagtcattacccgggacgacatgcacaatccgaaaggcctgaaggaaagagtggagaagtggcttaaagaatgcggggttgatcgcctggagcggatggctatctctggagacgattgtgtggtcaagcccctcgacgagagattcagcacatccctgctttttctgaacgatatgggcaaagtgcgcaaggacattcctcagtgggaacccagcaaagggtggaagaattggcaggaggtccctttctgctctcatcactttcacaagatcttcatgaaagatggacggtccctcgtggttccctgtagaaaccaagacgaactgatcggccgcgcccggattagccagggggccggctggtctctgagagagaccgcttgcctcggaaaggcctacgctcagatgtggtccctgatgtattttcatcggagagatcttcgcctggccagcatggcgatctgttccgccgtgcctacagaatggttccccacctctcggacgacatggagcattcacgctcatcaccagtggatgaccaccgaggacatgctcaaagtctggaatagagtgtggatcgaggataacccgaatatgacagacaagacccctgttcactcctgggaagacattccctacctgggcaaacgcgaggatctttggtgcgggagcctgatcggactctcttccagagccacatgggctaagaacattcatacggccatcacccaagtgcggaatctgatcggcattgaagggtatgtcgactactttctgctcatcaagtggtatagcgcgcctttcgagtctgaaggagtgctgtga

SEQ ID NO: 20969 - RNA, 9867 nt, synthetic construct
  misc_feature 1..9867: note = derived and/or modified CDS sequence (opt5) from DENV-4__KF955510__SS-prME
  source 1..9867: mol_type = other RNA
agcaccatcaccctgctctgcctgattcccacggtgatggccttccacctttccacccgggacggagaacctctgatgatcgtcgctaagcacgaacgggggcgcccgctcctgtttaagacgaccgagggaattaacaagtgtacacttatcgccatggatctgggcgaaatgtgcgaggacaccgttacatacaagtgtcccctcctggtgaataccgaacctgaggatattgactgctggtgtaacctgacgtctgcgtgggtgatgtatgggacctgcacacagagcggagagagacggcgcgaaaagagatccgtcgctctcacaccccactctggcatggggctggagacacggaccgaaacgtggatgagctccgagggagcctggaaacatgcccaacgcgtggagtcttggatccttagaaagcctggcttcgctctgagcgccggctttatggcttacatgatcgggcagacaggcattcagcggaccgttttctttatcctcatgatgctggtggccccctcctatggcatgcgctgtgtcggggtgggaaatagagatttcgttgaaggcgtgagcgggggagcctgggtcgaccttgtgctggagcacggcggctgcgtgacaaccatggcccaggggaagcctaccctcgattttgaactgattaaaacaacggctaaggaggtcgccctgctccggacctactgtatcgaggcttctatttccaacatcacaaccgccacacgctgcccgacccaaggagagccctatctgaaagaggaacaggaccagcagtacatttgtagacgggatatggttgaccgcggctgggggaatggatgcggccttttcgggaagggaggcgtggtgacgtgcgcgaaatttagctgttctggcaagatcacagggaacctggtccaaatcgagaatctcgaatataccgtggttgtgaccgtccataacggagatacacacgccgtgggcaatgacacctccaaccacggggagacagctacgattacccctagaagcccctctgttgaagtgcggctgcctgattacggagagcttacactggactgcgagcccagatccggcatcgacttcaatgaaatgattctcatgaagatgaaaaccaagacatggctggtccataaacagtggtttctggatctcccgctgccttggaccgccggggctgacacgagcgaggtgcactggaaccataaggaacgcatggtcaccttcaaagtgccccacgccaagcggcaggatgttacagtgcttggctcccaggagggagccatgcactctgctctggcgggcgccaccgaagtcgacagcggggatggaaatcatatgtttgctggccacctcaaatgtaaggtgagaatggagaagctgcgcatcaaagggatgtcctacacaatgtgcagcggaaagttctctattgacaaagagatggccgaaacccaacatggcacgacagttgtgaaggtcaaatatgaggggaccggcgccccttgtaaggtgcccatcgaaatccgggatgtgaacaaggagaaagttgtcggaagaattatctccagcacacccttcgctgagaataccaactctgtgaccaacattgaacttgagcctccgtttggcgacagctacatcgtgattggggccggagattccgcgctgacactccactggttccgcaagggctctagcatcgggaaaatgtttgaatccacgtatcggggagctaagagaatggccatcctgggcgagaccgcctgggacttcgggagcgtcggcggactgctcacatctctgggcaaagctgtgcatcaggtttttgggtccgtgtacaccacaatgttcggaggcgtcagctggatggtgcgcattcttatcgggctgctcgttctgtggattggaaccaattctcggaacacgtccatggccatgagctgcatcgtggtcggcgggattacactgtttcttggcttcaccgtgcacgctgatatgggatgtgttgtgtcctggtctggcaaggaactcaagtgcgggagcggaatctttgtcattgacaatgtgcacacctggacagagcagtataaattccaacccgagtcccctgccagactggcgtctgccatcctgaacgctcataaggacggcgtgtgtgggatccgcagcaccacacggctcgaaaatgtcatgtggaaacagattacgaacgagctgaattacgttctttgggaaggaggccacgatctgaccgtggtggccggcgacgtcaagggggtgctctccaaaggaaagagagctctggcgccccctgttaacgatctgaagtatagctggaaaacatggggcaaggcgaaaatctttacccccgagacaagaaattctaccttccttgtggacgggccggatacgtccgaatgccctaacgagcgcagagcctggaattttctcgaggtcgaagactacggattcggcatgttcaccacaaacatttggatgaagtttcgggaggggagctctgaagtgtgtgatcatagactgatgtccgctgccatcaaagaccagaaggctgttcacgccgatatgggatactggattgagagctctaaaaatcagacctggcaaatcgaaaaggccagcctgatcgaggtgaagacatgcctctggcccaaaacccacacactgtggtccaacggcgtccttgagagccagatgctgattcctaaggcttatgcgggccccatctctcagcataattaccgccaggggtatgccacccaaacggtgggaccttggcacctcggcaaactggaaattgacttcggggagtgccccggaacaaccgttaccatccaggaagattgtgaccatcggggcccgtccctgagaacaaccacggctagcgggaaacttgtgacacagtggtgctgtcgctcctgcaccatgcctcccctcagatttctgggagaggatggctgttggtacggcatggagattcggcccctgaacgaaaaagaggaaaacatggtcaagtctcaggtgagcgccgggcaaggaacatccgagaccttctctatgggcctcctgtgccttacactgtttgtggaagagtgtctccgcagacgggtcacccgcaagcacatgatcctggttgtggtgacgaccctgtgcgccatcattcttgggggactcacatggatggacctgctgagagctctcatcatgctgggcgacaccatgagcgggcggatgggaggccagattcatcttgccatcatggcgatgttcaaaatgtcccctggctatgtcctggggatttttctccgcaagctgacatctagagagaccgctctgatggtgatcggaatggccatgacgacagttcttagcatcccgcacgatctgatggagttcattgacggcatctccctcgggctgattctcctgaaaatggtgacccactttgataatacacaggtcggaacccttgccctgagcctcaccttcatcaagtctacaatgcccctggtgatggcttggcggacgattatggccgttctgtttgtggtcacccttatccctctgtgtcgcacatcctgcctccagaaacaaagccattgggtggagattaccgcgctgatcctcggcgctcaggccctgcccgtctaccttatgacactgatgaagggggcctctaagagatcctggcctctcaacgaaggaatcatggctgtgggcctggttagcctgcttggctctgccctgctcaaaaatgacgtgcccctggctgggcctatggtcgccggaggcctcctgcttgcggcctatgtgatgtccgggagctccgctgatctgagcctggagaaggccgctaacgttcagtgggacgaaatggccgatattaccggatctagccccatcattgaggtgaaacaagacgaggatggctccttctctatccgggacgtcgaagagacgaatatgattacactcctggtgaaacttgccctgatcaccgtgagcgggctctacccgctggctatccctgttaccatgacactctggtacatgtggcaggtcaaaacccagagatccggagcgctgtgggatgtgccctctcctgccgctgcccagaaggccacacttacggaaggcgcttatcgcattatgcaacggggcctgtttgggaagacccaggtgggagtcggcatccacatggagggggtgttccatacaatgtggcacgttaccagaggaagcgtgatttgtcatgaatccggccgcctggagccctcttgggccgacgtccggaacgatatgatcagctacgggggaggctggagactcggcgacaaatgggacaaggaggaagatgtgcaggttctggcgattgagccggggaaaaatcctaagcacgtgcagacaaaacccggacttttcaagaccctgacgggcgaaatcggggctgtcaccctcgactttaaacctggaacatccggcagccccatcattaaccgcaaggggaaggtgatcggcctgtatggaaatggcgttgtgaccaaatctggggattacgtctccgccattacacaagccgagcggatcggagagcccgactatgaagtggatgaggacattttcagaaagaaacgcctcaccatcatggatctgcaccctggcgctgggaagacaaaacggattcttccgagcatcgtgagagaagccctgaagcggcgcctgagaacgctcatcctggcgcccacccgggtcgttgctgccgagatggaagaggcccttcgcggactgcctattagataccagacacccgctgtgaagtctgagcataccggccgggaaatcgtggacctcatgtgccacgccacctttacaacgagactgctctccagcacccgcgtccctaactataatctgattgtgatggatgaggctcatttcacagacccctcctctgttgccgcgcgggggtacatcagcaccagagtggaaatgggcgaggccgctgccatttttatgacagctacccctccgggaacgacagatcccttccctcagtccaacagccccatcgaagacatcgagcgcgagattcctgaacggtcttggaataccggctttgactggatcaccgattaccaggggaaaacagtctggttcgtgccctccattaaggccggaaacgacatcgccaattgccttagaaaaagcggcaagaaagttattcaactgtctcgcaagacctttgatacagagtatccgaagaccaaactgacggactgggatttcgtggtcacaaccgacatcagcgaaatgggggctaactttcgggcgggaagagtgatcgatcctcgcagatgtctcaagcccgtcattctgacagacggccccgagcgggtgatccttgccgggcctattcccgttacccctgcttccgccgcccagcgcagaggccggatcggacgcaacccggctcaggaagatgaccaatacgtgttctctggcgatcccctgagaaatgacgaggatcacgcccactggacggaggcgaaaatgctcctggacaacatttatacccctgaagggatcattcccacactgttcggacctgagcgggaaaagacccaggctatcgacggcgagtttagactccgcggggagcagcggaaaacattcgtggaacttatgagacgcggagatctgcccgtctggctgagctacaaggttgcctccgccggcatctcttataaggaccgggagtggtgctttaccggcgaaagaaataaccagattctcgaggaaaatatggaggtggagatctggacacgggaaggggagaaaaagaaactgcgcccgaagtggcttgatgctagagtgtacgccgaccctatggcgctgaaagatttcaaggaatttgccagcggacggaagtccattaccctcgacatcctgacggagattgctagcctgcccacatatctctcttcccgcgccaaacttgctctggataacatcgtcatgctgcataccaccgaaagaggcgggaaggcctaccaacacgctctcaatgagctgcctgagagccttgaaacactgatgctcgtggccctgctgggagcgatgaccgccggcatcttcctctttttcatgcaggggaaaggaatgggcaaactttccatgggcctgattgctatcgccgttgcttctgggctgctctgggtggccgagattcagccccagtggatcgccgctagcattatcctggaatttttccttatggtcctgctcgtgcctgagcccgaaaaacaacggacaccgcaggacaaccagctgatctacgtcattctgacgatcctcaccattatcgcgcttgtggccgctaatgagatgggactgattgagaagacaaaaaccgattttggcttctatcaggccaagacagaaaccacgatcctggacgttgatctccgccctgcctccgcttggaccctgtacgccgtggcgacaaccattcttacacccatgctgagacataccatcgagaacacgtctgccaatctcagcctggctgccatcgctaaccaagccgcggtcctgatggggctcggaaagggctggccccttcaccggatggacctgggggtgcctctgctcgccatgggatgttattcccaggttaatccgacaaccctgacagctagccttgtgatgctgctcgtccattacgccattatcggccccggcctgcaggctaaagccacccgcgaagctcagaagagaaccgccgcggggattatgaaaaaccctacagtggatggaatcacggtgattgacctggagcccatctcttatgaccctaagtttgagaaacaactcggccaggttatgcttctggtcctgtgcgccgggcagctcctgcttatgcggaccacatgggctttctgtgaagtgctgaccctcgccacaggacccatcctgaccctgtgggagggcaatcctgggagattctggaacacgacaattgctgtgtccaccgccaacatctttcgcggaagctacctcgccggcgcgggccttgctttctctctgattaagaatgcccaaaccccgcggagagggacaggaaccacaggcgaaacgctgggggagaagtggaaacgccagctcaactccctggatcggaagggatttgaagagtataaaagaagcggcatccttgaggtcgaccgcaccgaagctaagtctgccctgaaagatgggagcaagattaagtacgccgtttcccggggaacatctaaaatcagatggatcgtggagcgcggcatggtgaagcccaaaggcaaggtcgtggacctcgggtgcggacggggcgggtggagctactatatggctaccctgaaaaatgttacagaagtgaagggatacaccaagggcgggcctggacacgaggaacccattcctatggccacgtatggctggaacctggtcaaactccactccggcgtggatgttttctacaagcccaccgaacaggtggacacacttctgtgtgatatcggggagagctcctctaatccgaccattgaagagggaagaacactgcgcgtcctcaaaatggtggaaccttggctgagctccaagcccgagttttgcatcaaagtgcttaacccctatatgcctaccgtcattgaagaactggagaagctccagcggaaacatggcgggtctctggttagatgtcccctgagccgcaattccacacacgaaatgtactgggtgtctggagtgagcggcaacatcgtctccagcgtgaataccacgtctaagatgctccttaacagattcacaacccggcatcgcaagcctacctatgagaaagacgcggatctgggggccggaacaagatccgttagcacggaaaccgagaagccggacatgacaattatcggccggagactgcaacggctccaggaggaacacaaagagacctggcactacgatcatgaaaatccctaccgcacatgggcttatcacggctcttacgaggccccttccaccgggagcgcttcttccatggtgaacggagtcgtgaagctgcttacaaaaccctgggacgttgtgcctatggtcacccagctggccatgacggacaccacaccctttggccagcaaagagtgttcaaggaaaaggttgatacccggacaccgcagcctaaacccgggacccgcgtggtcatgacgacaaccgcgaattggctctgggccctgctgggaagaaagaaaaaccctcggctctgcacacgcgaggagtttatcagcaaggtgagatccaatgctgccattggcgctgtcttccaggaagaacaggggtggaccagcgcctctgaagctgtgaacgacagccggttttgggagctggttgataaagaacgcgcccttcatcaagagggcaagtgtgagtcctgcgtgtataatatgatgggaaagagagagaagaagctgggcgagttcgggcgggcgaaaggatctcgcgccatctggtacatgtggctcggcgctagatttctggagttcgaggcccttgggttcctgaacgaagaccactggtttggacgggagaacagctggtccggcgtcgagggggaaggcctccatcgcctgggatatattctggaggatatcgacaagaaagatggcgacctcatttacgctgatgacacggccgggtgggataccagaatcacagaagacgatctgcttaatgaggagctgatcaccgaacagatggcgccccatcacaagattctcgccaaggctatcttcaaactgacatatcagaacaaggtggtgaaagttcttcggcctacccccaagggagccgtgatggacattatctctagaaaagaccaacgcggcagcgggcaggtcggaacatacggcctgaatacctttacgaacatggaggtgcagctcattcggcagatggaagccgagggggttatcacaagagatgacatgcataatccgaagggcctgaaagaacgcgtggagaagtggctgaaggagtgcggagtcgatcggctcaaaagaatggctatctccggcgacgattgtgtggtcaagcctctggacgaacgcttctctaccagccttctgtttctcaacgatatggggaaagtgcggaaggacattccccaatgggagccctccaaaggatggaagaattggcaggaagttcctttctgcagccaccattttcacaagatcttcatgaaagatggcagatctctggtggtcccgtgtcgcaaccaggacgagcttattgggcgggccagaatctcccagggagctggctggagcctgcgcgaaaccgcctgcctcgggaaggcgtacgcccaaatgtggtctctgatgtattttcaccggagagatctgcggctcgcttccatggccatttgtagcgctgtgcccacagagtggttccctacctccagaacaacgtggtctatccatgcccaccatcagtggatgaccacagaggacatgctgaaagtttggaatcgcgtgtggatcgaagacaaccccaatatgattgataagacccctgtccacagctgggaggacatcccctaccttggcaaacgggaagatctgtggtgcggatccctcattggcctgagctctagagcgacatgggccaagaacatccataccgctattacacaggtgcgcaatcttatcgggaaggaggaatatgtggactacatgcctgttatgaaaagatattccgcccactttgagagcgagggagtcctgtga

SEQ ID NO: 20970 - RNA, 9867 nt, synthetic construct
  misc_feature 1..9867: note = derived and/or modified CDS sequence (opt5) from DENV-4__GQ868594__SS-prME
  source 1..9867: mol_type = other RNA
agcaccatgaccctgctctgcctgatccccacggtgatggctttccacctttccaccagagacggagaacctctgatgattgtcgctaagcatgaacgggggagaccgctcctgtttaaaacgaccgaaggaatcaacaagtgtacacttattgccatggatctgggcgaaatgtgcgaagacaccgttacatacgaatgtcccctcctggtgaataccgagcctgaggatatcgactgctggtgtaacctgacgtctgcgtgggtgatgtatgggacctgcacacagagcggagaaagacggcgcgagaaaagatccgtcgctctcacaccccactctggcatggggctggaaacacgggccgagacctggatgagctccgagggagcctggaagcatgctcaacgcgtggaatcttggattcttagaaatcctggcttcgccctgctcgctggctttatggcctacatgatcgggcagacgggaatccagcggacagttttctttgtgctgatgatgcttgtcgcgcccagctatggcatgcgctgtgtgggggttggaaacagagatttcgtggagggcgtctccgggggagcctgggtggacctggtgctcgaacacggcggctgcgtcaccacaatggctcaggggaaacctaccctggattttgagctgattaagaccacagccaaggaagttgctctcctgcggacgtactgtatcgaggccagcatttctaatatcaccacagcgacccgctgccccacacaaggagagccctatcttaaagaagaacaggaccagcagtacatttgtagacgggatgtggtggaccgcggctgggggaacggatgcggcctgttcgggaagggaggcgtcgtgacctgcgccaaattttcctgtagcggcaagatcacggggaatctcgttcaaattgaaaacctggagtatacagtggtcgtgaccgttcataatggagatacccacgctgtgggcaacgacatccctaatcacggggtcacagccaccatcacacccagatctccttccgtggaagtcaaacttcccgattacggagagctgacgctcgactgcgagccgcggagcggcattgacttcaacgaaatgatcctgatgaagatgaagaaaaagacctggctggtgcataaacagtggtttctcgatctgcctcttccctgggctgccggggccgacacatctgaggttcactggaattacaaggaaagaatggtgaccttcaaagtccctcatgctaagcgccaggatgtgattgttctgggctcccaggagggagcgatgcacagcgccctcacaggcgctaccgaagtggactccggggatggaaaccacatgtttgccggccatctgaaatgtaaggtccggatggagaaacttagaatcaaagggatgtcttatacgatgtgcagcggaaagttctccattgacaaagagatggccgaaacccaacacggcacaaccgtggtgaaggttaaatacgagggggctggcgccccctgtaaggtccccatcgaaatccgcgatgtgaataaggagaaagtggtcggacggattatcagctctacacctttcgcggagtataccaactccgtgacgaacattgaactggagccgccctttggcgacagctacatcgttattggggtgggagattctgctctcacactgcattggttcagaaagggcagctccatcgggaaaatgctggaatctacctatcgcggagccaagcggatggccatcctcggcgagacagcttgggactttgggagcgtcggcggactgcttacctccctgggcaaagccgtgcaccaggttttcgggagcgtgtacaccacaatgtttggaggcgtctcttggatggtgcgcattctcatcgggttcctggttctgtggattggaacaaattcccgcaacaccagcatggctatgacatgcatcgccgtgggcgggattaccctttttctcggcttcacagtccatgcggataccggatgtgccgtgtcttggtccggcaaggaactgaagtgcgggagcggaatctttgtgattgacaatgtccacacgtggacagagcagtataaattccaacctgagtcccccgctcggctggcctctgctatcctcaacgcccacaaggacggcgtttgtgggatcagaagcaccacccgcctggaaaatattatgtggaaacagatcacaaacgagcttaattacgtgctgtgggaaggaggccatgatctcaccgtggtcgcgggcgacgtgaagggggttctgtccaaaggaaagcgggccctggctcctcccgtgaacgatcttaagtactcttggaaaacatggggcaaggccaaaatttttacgccggaggctaagaatagcaccttcctcatcgacgggcctgatacatccgaatgccccaacgagagacgggcctggaattttctggaggtcgaagactatggattcggcatgttcaccacaaacatttggatgaaatttcgcgaggggagctctgaagtgtgtgatcacagactgatgtccgccgctatcaaggaccagaaagcggttcatgccgatatgggatactggatcgagagctctaagaatcagacctggcaaattgaaaaggcttccctcatcgaggtgaaaacgtgcctgtggcctaagacccacacactttggagcaacggcgtcctggagtctcagatgctcattcccaaagcctatgccggccctttcagccagcacaattaccggcaggggtatgctacccaaacagtgggaccctggcatctgggcaagctggaaatcgactttggggagtgcccgggaaccacagttaccattcaggaagattgtgaccacagaggcccttcccttcgcacgacaaccgccagcgggaaactcgtgacccagtggtgctgtcggtcttgcacaatgccgcccctgagattcctgggagaggatggctgttggtacggcatggagatccgccctctctccgaaaaggaggaaaacatggtcaagagccaggtgtccgcggggcaaggaacctctgagacgtttagcatgggcctgctttgcctgacactcttcgtggaagagtgtctgagacggcgcgtcaccagaaaacatatgatcctggttgtggtgacaaccctttgcgctattatcctcgggggactgacatggatggacctgctccgggccctgattatgcttggcgacaccatgtccgggcgcatgggaggccagatccacctggccattatggctgtctttaagatgtctccgggctatgtgctcgggatcttcctgagaaaactgacgagccgggagaccgcccttatggttatcggaatggcgatgacaaccgtgctgtccattccccatgatctcatggaatttatcgacggcatttctctggggctcatcctgcttaagatggtcacacacttcgataacacccaggtgggaacgctggctctcagcctgacatttattcgctccaccatgcctctggttatggcctggagaacaatcatggccgtgcttttcgtcgtgaccctgattcccctctgtcggaccagctgcctgcagaaacaatctcactgggtcgagatcacagctctcatcctgggcgcccaggcccttcctgtgtacctgatgacgctcatgaagggggcctccaagcgcagctggcccctgaatgaaggaattatggcggttggcctggtgtctcttctgggctccgccctcctgaaaaacgacgtccctctcgctgggcccatggtggccggaggcctgcttctggctgcctacgttatgagcgggtcttccgccgatctgagcctcgagaaggctgcgaatgtgcagtgggacgaaatggccgatatcaccggatccagcccgattatcgaggtcaaacaagacgaggatggctcttttagcattagagacatcgaagagacaaacatgatcaccctgcttgtgaagctggctctcattacagtgtccgggctgtatcctctcgccatccccgttaccatgacgctgtggtacatgtggcaggtcaaaacacagcggtctggagccctttgggatgtgcctagccccgctgccgcgcagaaggctaccctgaccgaaggcgtgtatagaattatgcaacgcggcctgttcgggaagacacaggtcggagtgggcatccatatggagggggttttccacaccatgtggcatgtgacacggggatccgtcatttgtcacgaaacgggcagactcgagccgtcttgggccgacgtgcgcaatgatatgatcagctacgggggaggctggcggctgggcgacaaatgggacaaggaggaagatgttcaggtgcttgccatcgagcctgggaaaaaccccaagcatgtccagaccaaacctggactgtttaagacactcaccggcgaaattggggctgtgacactggacttcaaacccggaacctccggctctcccatcattaatagaaaggggaaggttatcggcctctatggaaacggcgtggtcacgaaaagcggggattacgtgtccgccattacccaagcggagcgcacaggagagcctgactatgaagtggatgaggacatctttcggaagaaaagactgaccattatggatcttcacccgggcgctgggaagacaaaacgcatcctgcccagcatcgtccgggaagccctgaagagacggctccgcaccctgattcttgcccctacaagagttgtggctgccgagatggaagaggctctgcggggactccccatccgctaccagacgcctgccgtgaagtctgagcacaccggcagagaaattgtcgacctgatgtgccatgcgacattcaccacccggctcctgtccagcacaagagtgcccaattacaaccttatcgttatggatgaggcccactttacggacccttcttccgtggctgcccgcgggtatattagcacccgggtcgaaatgggcgaggctgccgccatcttcatgacagctaccccgcccggagcgacagatccttttccccagtccaattctcctatcgaagacattgagagagagatccccgaacgcagctggaacaccggcttcgactggattacggattaccaggggaaaacagtgtggtttgttccgtccatcaaggccggaaatgacattgctaactgcctgcggaaaagcggcaagaaagtgatccaactgtctagaaagaccttcgataccgagtatcctaagacaaaactcaccgactgggattttgtcgtgacaaccgacatctccgaaatgggggccaatttccgcgccggacgggtcattgatcccagacgctgtctgaagcccgtgatcagcacggacggccctgagagagttattcttgctgggcccatccctgtgacaccggcctctgcggctcagcggcgcggcagaattggacggaaccccgcccaggaagatgaccaatacgtgttcagcggcgatcctctgaaaaacgacgaggatcatgcccactggaccgaggctaagatgctcctggacaatatctatacacccgaagggattatccctaccctgtttggacccgagcgcgagaagaaccaggccatcgacggcgagttcagactcagaggggagcagcggaagacgtttgtcgaacttatgcgccggggagatctgccggtttggctgtcctacaaggtggcgtctgccggcattagctataaagacagagagtggtgcttcaccggcgaacgcaataaccagatcctcgaggaaaatatggaggtggagatttggacacgggaaggggagaagaaaaagctgagacctaaatggcttgatgctcgggtctacgccgaccccatggctctgaaggattttaaggagttcgcctccggacgcaaatctatcaccctcgacattctgacagagatcgctagcctgcctacctacctctccagcagagccaaacttgcgctggataacatcgtgatgctgcacacaaccgaacggggcgggaaagcctatcaacatgctctcaatgagctgcccgagtctcttgaaacgctgatgctcgttgccctgctgggagctatgacagccggcatttttctcttctttatgcaggggaagggaatcggcaaactttccatgggcctgattgccatcgctgtggcgagcgggctgctctgggtcgccgagattcagcctcagtggatcgctgcctccatcattctggagttctttcttatggtgctgctcatccccgagccggaaaagcaacgcacccctcaggacaaccagctgatttacgtcatcctgaccattctcacaatcattggacttatcgccgctaatgagatgggcctgatcgagaaaaccaagacagatttcgggttttatcaggtgaagacggaaaccacaattctggacgttgatctcagacccgcctctgcgtggaccctgtacgccgtggctacaaccatccttacgcccatgctgcggcacaccattgagaacacaagcgccaatctctccctggctgccatcgcgaaccaagccgctgtcctgatgggactcggcaaagggtggcctcttcatcgcatggacctgggagtgccgctgctcgccatgggctgttattctcaggttaatcccaccacactgattgctagccttgtgatgctgctcgtccactacgccatcatcggccctgggctgcaggctaaggccaccagagaagcgcagaaacggacggccgctggaattatgaagaaccccacagtggatggcatcaccgtgattgacctggagcctatctcctatgaccccaaattcgagaagcaactcgggcaggttatgcttctggtcctgtgcgccggacagctcctgcttatgcgcacaacctgggctttctgtgaagtgctgaccctcgccacaggccctgtgctgacgctgtgggaggggaatccgggaagattttggaacaccacaattgccgtcagcaccgcgaacatcttccggggctcttacctcgctggcgccgggcttgctttttccctgatcaagaatgcccaaacacccagacgcggaaccggcacgacaggggaaaccctgggagagaaatggaagcggcagctcaacagcctggatagaaaagagttcgaggagtacaagcgctctggcattcttgaagttgaccggaccgaggccaaatccgctctgaaggatgggagcaagatcaaacatgccgtgtctagaggaagctccaagattcgctggatcgtggaacggggcatggtcaaacctaagggcaaagtggttgacctcgggtgcggaagaggcgggtggtcttattacatggcgacactgaagaatgtgaccgaggtcaagggatatacaaaaggcgggcccggacacgaagaacctattcccatggccacgtacggctggaacctggtgaagctccacagcggcgttgatgtgttttataaaccgaccgagcaggtcgacacacttctgtgtgatatcggggaatccagctccaatcctaccattgaggaaggacgcacactgcgggtgctcaagatggtggagccctggctgtctagcaaacccgagttctgcatcaaggtccttaacccttacatgcccaccgttatcgaggagctggaaaaactccagagaaagcatggcgggtccctggtgcgctgtcctctgtctcggaatagcacgcacgagatgtattgggtgtccggagtctctggcaacattgtgagctccgttaataccacaagcaagatgctccttaacagatttaccacacgccatagaaaaccgacctacgaaaaggacgtggatctgggggctggaacacggtctgtctccaccgagacggagaaacccgacatgacaatcattggccgcagactgcaacggctccaggaagaacacaaggaaacctggcactacgatcaggagaatccttatagaacctgggcctaccatggcagctatgaagctccctctacagggtccgccagctctatggtgaacggagttgtgaaactgcttacgaagccttgggacgtcatccccatggtgacccagctggcgatgacagacaccacaccgttcggccaacagcgggtttttaaggagaaagtggatacccgcacacctcagcccaagcctgggaccagaatggtcatgacgaccacagccaattggctctgggctctgctgggcaagaagaaaaacccccggctctgcacccgcgaggagttcatttccaaggtgagaagcaatgccgctatcggcgccgtctttcaggaggaacaagggtggacatccgctagcgaggccgtgaacgactctcggttctgggaactggttgataaggagcgcgcgcttcaccaggagggcaaatgtgaaagctgcgtgtacaatatgatgggaaagagagagaaaaagctgggcgaatttgggcgggccaaaggatcccgcgctatctggtatatgtggctcggcgccagattcctggagttcgaagctcttgggtttctgaacgaggaccattggttcggacgggagaactcttggagcggcgtcgaaggggagggcctccaccgcctgggatacattctggaagatatcgacaagaaggatggcgacctcatttatgccgatgacaccgccgggtgggatacgagaatcacagaggacgatctgcttaatgaggaactgattaccgagcagatggcgcctcatcacaaaatcctcgctaaggccatctttaaactgacataccaaaacaaggtggtgaaagttcttcggcccaccccgaagggagccgtgatggacattatctcccgcaaagaccagagaggctctgggcaggtcggaacgtacggcctgaataccttcacaaacatggaagtgcagctcattcggcaaatggaggctgaaggggttatcacccaggatgacatgcacaatcctaagggcctgaaggagagagtggagaaatggctgaaggaatgcggagtcgatcgcctcaaacggatggccattagcggcgacgattgtgtggtcaagcccctggacgagagattttccacatctcttctgttcctcaacgatatggggaaagtgcgcaaggacatcccccagtgggaacctagcaagggatggaaaaattggcaggaggttccgttttgctcccatcacttccataagatctttatgaaagatggccggagcctggtggtcccctgtagaaaccaagacgaacttattgggcgcgctcggatctctcagggagccggctggtccctgagagagaccgcgtgcctcgggaaggcctatgctcagatgtggagcctgatgtacttccaccgccgggatctgagactcgcctctatggctatttgttccgccgtgcctacagagtggtttcccaccagccgcacgacatggtccatccacgcgcatcaccagtggatgaccaccgaagacatgctgaaagtttggaatcgggtgtggattgaggacaaccctaatatgacagataagacccccgtccattcttgggaagacatcccttatcttggcaagagagaggatctgtggtgcggaagcctcattggcctgtccagccgggccacatgggctaaaaacatccacacggccatcacccaagtgagaaatcttattgggaaggaagagtacgtggactatatgcccgttatgaaacgctactctgctccgttcgagtccgaaggagtcctgtga

SEQ ID NO: 20971 - RNA, 9867 nt, synthetic construct
  misc_feature 1..9867: note = derived and/or modified CDS sequence (opt5) from DENV-4__FJ024424__SS-prME
  source 1..9867: mol_type = other RNA
agcaccatcacactgctctgcctgattcccacggtgatggccttccacctttccaccagagacggcgagcctctgatgatcgtcgctaagcatgaacgggggcgcccgctcctgtttaaaacaaccgagggaattaacaagtgtacacttatcgccatggatctgggcgaaatgtgcgaggacaccgttacatacaaatgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggatccttagaaatcctggcttcgctctgctcgccggctttatggcttacatgatcgggcagacaggaattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctagcatttctaatatcaccacagccacccgctgcccgacgcaaggagagccctatcttaaggaggaacaggaccagcagtacatttgtagacgggatgtggtggaccgcggctgggggaacggatgcggcctgttcgggaaaggaggcgtcgtgacatgcgcgaagttttcctgtagcggcaaaatcaccgggaatctcgttcaaattgagaacctggaatataccgtggtcgtgacagttcataatggagatacccacgccgtgggcaacgacacatctaatcacggggtcacgaccacaatcacccctagatcccccagcgtggaggtcaagcttcctgattacggagaactgacactcgactgcgagccccggtctggcatcgacttcaacgagatgattctgatgaagatgaaaaagaaaacctggctggtgcataagcagtggtttctcgatctgccgcttccttggacggctggggccgacacctccgaagttcactggaattacaaagagagaatggtgacattcaaggtcccccatgctaaacgccaggatgtgaccgttctgggcagccaggaaggagccatgcactccgccctcgctggcgcgacagaggtggactctggggatggaaaccacatgtttgccggccatctgaagtgtaaggtccggatggaaaaacttagaatcaaggggatgagctataccatgtgctccggaaaattcagcattgacaaggagatggctgagacgcaacacggcacaaccgtggtgaaagttaagtacgaaggggccggcgccccttgtaaggtccccatcgagattcgcgatgtgaataaagaaaaggtggtcggacgggtgatctcttccacacccctggctgagaacaccaacagcgttaccaatatcgagctcgaacctccgttcggcgactcttatattgtgatcggggtcggaaacagcgccctgacactgcattggtttagaaaaggctcctctattgggaagatgttcgagagcacgtaccgcggagcgaaacggatggctatcctcggcgaaaccgcctgggattttgggtccgtgggcggactgttcacaagccttggcaaggccgttcaccaggtgtttgggtctgtctataccacaatgttcggaggcgtgtcctggatgattagaatcctgatcgggtttctcgttctgtggattggaaccaatagccgcaacacgtctatggctatgacatgcatcgccgtgggcgggattaccctgttccttggctttaccgtccaggctgacatgggatgtgtggtgtcctggagcggcaaggagctcaaatgcgggtccggaatcttcgtcgttgataatgtgcatacatggaccgaacaatacaagtttcagcccgagtctcctgcccggctggcgagcgccattctgaacgctcacaaagacggcgtgtgtgggatcagatccacaacgcgcctcgagaatgtcatgtggaagcagattaccaacgaactgaattatgtgctttgggagggaggccacgacctgacagttgtggccggcgatgtcaaaggggtgctcaccaagggaaagcgggctctgacaccccctgtttctgacctgaaatacagctggaagacctggggcaaagccaagatcttcacgcccgaagcgagaaactccacctttcttatcgatgggccggacacaagcgagtgccctaatgaacggcgcgcctggaactctctcgaggtggaggattacggattcggcatgttcaccacaaatatttggatgaaatttagagaagggtccagcgaggtctgtgaccatcggctgatgtctgctgccatcaaggatcagaaagctgtgcacgccgacatgggatattggattgaatccagcaagaaccaaacctggcagatcgagaaggcctctctgattgaagttaaaacatgcctctggcccaagacccatacgctgtggagcaatggcgtgcttgagtcccagatgctgatccctaaaagctacgctggccccttctctcagcacaactatagacaagggtacgcgacacagaccgtcggaccttggcacctcggcaagctggagatcgattttggggaatgccccggaaccacagtgaccattcaggaggactgtgatcatcgcggcccgtccctgcggacgacaaccgccagcgggaaacttgtgacacagtggtgctgtagatcctgcaccatgcctcccctccgcttcctgggagaagacggctgttggtatggcatggagatcagacccctgtctgagaaggaagagaacatggtcaagagccaagttgctgccgggcagggaacatccgaaaccttttctatgggcctcctgtgccttacgctgttcgtggaggaatgtctccggcgcagagtgacccggaaacacatgattctggccgtcgtgatcacactgtgcgctattatccttgggggactcacctggatggatctgctgcgcgccctcatcatgctgggcgacacaatgagcgggagaattggaggccagacccatcttgcgatcatggctgtttttaagatgtcccctggctacgtgctgggggtcttcctccggaaactgacgtctcgcgagacagccctgatggtgattggaatggccatgaccacaacccttagcatcccgcacgacctgatggagctcattgatggcatctccctggggctcatcctgcttaagattgttacccagtttgacaatacacaagtgggaacgctggctctcagcctgaccttcatcagatctacaatgtccctggtcatggcctggcggaccattatggcggtgctttttgtcgtgacactgatccccctctgtcgcaccagctgcctgcagaaacagtctcattgggttgaaattacggctctcatcctgggcgcccaagcccttcctgtgtatctgatgacactcatgaagggggcttccagacggagctggcccctgaacgagggaattatggccgtcggcctggtgtctcttctgggctccgctctcctgaagaatgatgttcctctcgccgggcccatggtggcgggaggcctgcttctggccgcttacgtcatgagcgggtccagcgccgacctgtctctcgaaaaagctgccaacgtgcagtgggatgagatggccgacatcaccggaagctcccctatcattgaagtgaagcaggatgaggacggctctttcagcatcagagatgttgaggaaaccaatatgattacactgcttgtcaaactggctctcatcaccgtgtccgggctgtaccccctcgcgattccggtgacaatgacgctgtggtatatgtggcaggtcaagacccaacgctctggagccctttgggacgtgcctagccccgctgccacacagaaagccgctctgtccgagggcgtttaccggatcatgcagagaggcctgtttgggaagacccaggtgggagtcggcatccacatggaaggggtgttccacacaatgtggcatgttacccgcggatctgtgatttgtcacgagacgggccggctcgaacctagctgggccgatgtcagaaacgacatgatctcctatgggggaggctggcgcctgggcgataagtgggacaaagaggaggacgtgcaagttcttgcgattgaacccgggaagaatccgaaacatgtgcagaccaagcctggactgttcaaaacactcaccggcgagatcggggctgtcacactggattttaagcccggaaccagcggctctcctattatcaaccggaaagggaaggtgatcggcctctacggaaatggcgtggtcacaaagtccggggactatgttagcgccattacgcaggccgaaagaatcggagagcccgattacgaggtggacgaagatattttccgcaaaaagcggctgaccatcatggaccttcaccccggcgctgggaaaacaaagagaattctgccttctatcgtgcgggaggccctgaaacgcagactccggaccctgattcttgcgccgacccgcgtcgtggctgccgaaatggaggaagccctgagaggactccccatccggtatcagacacctgctgttaagtccgagcatacgggcagagagatcgtggatctgatgtgccacgccacctttacaacccgcctcctgagctccacacgggtccccaactacaatcttattgtgatggacgaagctcacttcaccgatccttctagcgttgccgcgagagggtacatctccacgcgcgtggagatgggcgaagccgctgccatttttatgacagctaccccccctggagccaccgacccgttcccccaaagcaactctcctatcgaggatattgaacgggagatccccgagagatcctggaatacaggctttgactggatcaccgactatcaggggaagacagtctggttcgtgcctagcattaaagccggaaacgatatcgctaattgcctgcgcaagtctggcaaaaaggtcattcagctgagccggaaaacctttgacacggaataccccaagacaaagctcaccgattgggacttcgtggttacaaccgatatctccgagatgggggcgaactttagagccggacgcgtgattgacccgagacggtgtctgaaacctgtgatccttacggatggccccgaacgcgtcatcctggctgggcccattcctgttacccccgcctctgccgctcaaagacggggccgcatcggaagaaaccctacacaggaggacgatcagtatgtgttcagcggcgacccgctcaagaatgatgaagaccatgcccactggaccgaggcgaaaatgctgctggataacatttacacacccgaggggatcattcctaccctcttcggacccgaacgggagaagacacaggctatcgacggcgaatttagacttcgcggggagcaacggaaaaccttcgtggagctgatgagacgcggagacctgcctgtctggctctcctataaggtggcctctgccggcattagctacaaggatcgggaatggtgctttacgggcgagagaaataaccagatcctggaagagaatatggaagttgagatctggacacgggagggggaaaaaaagaaacttcgccccagatggctggacgctcgggtgtatgccgatccgatggcgctcaaggacttcaaagagtttgcctccggacgcaagagcattaccctggatatcctgaccgaaattgcttctctccctacatacctttccagcagagccaagctggctctggacaacatcgtcatgctccataccacagagcggggcgggcgcgcctaccagcacgctctgaatgaacttcccgagtccctggagacgctcatgctggtggccctgctcggagcgatgaccgccggcattttcctttttttcatgcaggggaaaggaatcggcaagctgtctatgggcctgatcacaattgctgtcgccagcgggctcctgtgggtggctgaaatccaacctcagtggattgccgcctccatcattcttgagtttttcctgatggttctcctgatccccgaacctgagaaacagagaaccccccaggataaccaactgatctatgtgattctcacaatccttaccattatcggactgattgctgcgaatgaaatgggcctgatcgagaagacgaaaaccgactttgggttctaccaggtcaagacagagaccacaattctcgatgtggacctgcggccggcctctgcttggaccctttatgccgttgccacgacaatcctgacccctatgctccgccacacaatcgaaaacaccagcgctaatctgtccctggccgcgattgccaaccaggctgccgtgctcatgggacttggcaaagggtggcccctgcatagaatggatctgggagtccccctcctggctatgggctgttacagccaggtgaatcctaccacacttacggcctctctggtgatgctcctggttcactatgcgatcattggcccggggctgcaagccaaggctacccgggaggcccagaagagaacagctgccggaatcatgaaaaaccccaccgtcgacggcattacagtgatcgatctcgaacctatctcctacgaccccaagtttgagaaacagcttgggcaagtgatgctgctggtcctctgcgctggacagctgcttctgatgcgcaccacgtgggccttctgtgaggttctcacactggcgaccggccctattctgaccctctgggaagggaatcccggacggttctggaacacaaccatcgccgtgagcacagctaacatttttagaggctcttatcttgccggcgctgggctggccttctccctgatcaagaatgcccagacgcctcgccggggaaccggcacaaccggggagacactcggagaaaaatggaagagacagctgaacagccttgaccgcaaggagtttgaagagtacaaacggtctggcattctggaggtggatagaaccgaagcgaagagcgctctcaaagacgggtccaagatcaaacatgccgtctctcgcggaagctccaagatccggtggattgtggagagaggcatggttaagccgaaaggcaaggtggtcgatctggggtgcggacgcggcgggtggagctactatatggctacgctgaaaaatgtgaccgaagttaagggatacacaaaaggcgggcccggacacgaggaacctatccccatggccacctatggctggaacctcgtgaagcttcattccggcgtcgacgtgttctacaagcctacagagcaagtggataccctgctgtgtgacattggggagtctagctccaatcccacaatcgaagagggacggaccctcagagtcctgaaaatggttgaaccgtggctttctagcaagcctgagttttgcattaaagtgctgaacccctatatgcccacggtgatcgaagagctcgagaagctgcagcgcaaacacggcgggaatctggtcagatgtcctctctcccggaactctacacacgaaatgtactgggtgagcggagcctccggcaatattgttagctctgtgaacaccacctccaagatgcttctgaatcgcttcacaacgagacatcggaaacccacctatgagaaggatgtcgacctgggggctggaacaagaagcgtgtctaccgaaacagagaagcctgatatgaccatcatcggccggcgcctccagagactgcaggaggaacacaaagagacatggcattacgaccaagaaaacccgtaccggacctgggcctatcacggctcctacgaggcgcccagcacggggtctgcctccagcatggttaatggagtggtcaagcttctgaccaaaccttgggatatgattcccatggtgacacagctcgctatgaccgacacaaccccttttggccagcagcgcgttttcaaggaaaaagtggacacgagaacaccccaaccgaagcctgggacccggatggtcatgacaaccacggccaactggctgtgggctctgctcggaaagaaaaagaatccccgcctgtgcaccagagaggagtttatctccaaagtgcggagcaacgccgcgattggcgccgtcttccaggaagagcaggggtggacatctgctagcgaagccgtgaatgattcccgcttttgggagcttgttgacaaggaaagagctctgcaccaagagggcaaatgtgagtcttgcgtgtataacatgatgggaaagcgggaaaagaaactcggcgagttcgggcgcgccaagggaagcagagctatctggtacatgtggctgggcgcccggtttcttgaattcgaggcgctggggttcctcaacgaagatcattggtttggacgcgagaattcctggtctggcgtcgagggggaaggcctgcacagactgggatatattctcgaggaaatcgacaaaaaggatggcgacctgatgtacgccgatgacaccgctgggtgggatacacggatcaccgaggacgatcttcagaacgaggaactgattacagagcagatggcccctcatcacaaaatcctcgctaaggccattttcaagctgacctatcagaataaagtggtgaaggttcttagacccacgcctcgcggagccgtgatggacatcattagccggaaagatcaaagaggctccgggcaggtcggaacatacggcctgaacacctttaccaatatggaagtgcagctcatccgccagatggaggcggaaggggttatcacacaagacgacatgcagaaccccaagggcctgaaagagcgggtggagaagtggctgagagaatgcggagtcgatcgcctcaaacggatggctatttctggcgacgattgtgtggtcaagccgctggacgagagattcgggaccagccttctgtttctcaatgatatgggaaaggtgcgcaaagacatccctcagtgggaaccctccaagggctggaaaaactggcaggaggttcccttctgcagccatcactttcacaagattttcatgaaagatgggcggtctctggtggtcccttgtagaaatcaagacgaacttatcggacgcgcccggatttcccagggcgccgggtggagcctgagagagacagcttgcctcggcaaggcctacgctcagatgtggtctctgatgtattttcatcggagagatctgcgcctcgcctccatggcgatctgtagcgccgtgccgacggagtggttccccacctcccggacaacctggtctatccacgctcatcaccagtggatgacaaccgaagacatgctgaaggtttggaacagagtgtggattgaggataatcctaacatgatcgacaaaacgcccgtccacagctgggaagacattccttaccttggaaagcgcgaggatctgtggtgcggctccctcatcgggctgagctctagagccacctgggctaaaaatattcatacagccatcacccaagtgcggaaccttattggaaaggaagagtatgtggactacatgcccgttatgaaacgctattccgcgcctagcgagtctgaaggcgtcctgtga

SEQ ID NO: 20972 - RNA, 9867 nt, synthetic construct
  misc_feature 1..9867: note = derived and/or modified CDS sequence (opt5) from DENV-4__EU854295__SS-prME
  source 1..9867: mol_type = other RNA
agcaccatcaccctgctttgcctgattcccacggtgatggctttccatctttccacccgggacggagagcctctgatgatcgtcgctaagcatgaacgggggcgcccgctcctgtttaagacaaccgaggggattaacaagtgtacccttatcgccatggatctgggcgaaatgtgcgaggacaccgttacatacaagtgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaagcatgcccaacgcgtggagtcttggatccttagaaatcctggcttcgctctgctcgccggctttatggcttacatgatcgggcagacaggcattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctagcatttctaatatcaccacagccacccgctgcccgacgcaaggagagccctatcttaaggaggaacaggaccagcagtacatttgtagacgggatgtggtggaccgcggctgggggaacggatgcggcctgttcgggaaaggaggcgtcgtgacatgcgcgaagttttcctgtagcggcaaaatcaccgggaatctcgttcaaattgagaacctggaatataccgtggtcgtgacagttcataatggagatacccacgccgtgggcaacgacacatctaatcacggggtcacggctaccatcacacctagatcccccagcgtggaggtcaaacttcctgattacggagaactgaccctcgactgcgagccccggtctggcatcgacttcaacgagatgattctgatgaagatgaaaaagaaaacatggctggtgcataagcagtggtttctcgatctgccgcttccttggaccgccggggctgacacgtccgaagttcactggaattacaaagagagaatggtgaccttcaaggtcccccatgccaaacgccaggatgtgacagttctgggcagccaggaaggagccatgcactccgctctcgcgggcgccaccgaggtggactctggggatggaaaccacatgtttgctggccatctgaagtgtaaggtccggatggaaaaacttagaatcaaggggatgagctatacaatgtgctccggaaaattcagcattgacaaggagatggccgagacccaacacggcacgacagtggtgaaagttaagtacgaaggggccggcgctccttgtaaggtccccatcgagattcgcgatgtgaataaagaaaaggtggtcggacgggtgatctcttccacacccctggccgagaacacaaacagcgttaccaatatcgagctcgaacctccgttcggcgactcttatattgtgatcggggtcggaaacagcgcgctgaccctgcattggtttagaaaaggctcctctattgggaagatgttcgagagcacataccgcggagctaaacggatggccatcctcggcgaaacggcctgggattttgggtccgtgggcggactgttcaccagccttggcaaggctgttcaccaggtgtttgggtctgtctatacaaccatgttcggaggcgtgtcctggatgattagaatcctgatcgggtttctcgttctgtggattggaacaaatagccgcaacacctctatggccatgacgtgcatcgctgtgggcgggattacactgttccttggctttaccgtccaggccgacatgggatgtgtggtgtcctggagcggccgggagctcaagtgcgggtccggaatcttcgtcgttgataatgtgcatacctggacagaacaatacaaatttcagcccgagtctcctgcgagactggccagcgctattctgaacgcccacaaggacggcgtgtgtgggatccgctccaccacacggctcgagaatgtcatgtggaaacagattacgaacgaactgaattatgtgctttgggagggaggccacgacctgaccgttgtggctggcgatgtcaagggggtgctcacaaaaggaaagagagccctgacaccccctgtttctgacctgaagtacagctggaaaacatggggcaaggcgaaaatcttcacccccgaagcccggaactccacgtttcttatcgatgggccggacaccagcgagtgccctaatgaacgcagagcttggaactctctcgaggtggaggattacggattcggcatgttcacaaccaatatttggatgaagtttcgggaagggtccagcgaggtctgtgaccatagactgatgtctgccgctatcaaagatcagaaggccgtgcacgccgacatgggatattggattgaatccagcaaaaaccaaacatggcagatcgagaaggcttctctgattgaagttaagacctgcctctggcccaaaacacataccctgtggagcaatggcgtgcttgagtcccagatgctgatccctaagagctacgcgggccccttctctcagcacaactatcgccaagggtacgccacgcagacagtcggaccttggcacctcggcaaactggagatcgattttggggaatgccccggaaccaccgtgacaattcaggaggactgtgatcatcggggcccgtccctgagaaccacgacagctagcgggaaacttgtgacccagtggtgctgtcgctcctgcacaatgcctcccctcagattcctgggagaagacggctgttggtatggcatggagatccggcccctgtctgagaaagaagagaacatggtcaagagccaagttgccgccgggcctggaacctccgaaacattttctatgggcctcctgtgccttaccctgttcgtggaggaatgtctccgcagacgggtgacgcgcaagcacatgattctggctgtcgtgatcaccctgtgcgccattatccttgggggactcacatggatggatctgctgagagcgctcatcatgctgggcgacaccatgagcgggcggattggaggccagacacatcttgctatcatggccgtttttaaaatgtccccgggctacgtgctgggggtcttcctccgcaagctgacctctagagagacggccctgatggtgattggaatggctatgacaaccacacttagcatcccccacgacctgatggagctcattgatggcatctccctggggctcatcctgcttaaaattgttacccagtttgacaatacccaggtgggaacactggccctcagcctgacgttcatccggtctaccatgtccctggtcatggcgtggcgcacaattatggctgtgctttttgtcgtgaccctgatccctctctgtagaacaagctgcctgcaaaagcagtctcattgggttgaaattaccgccctcatcctgggcgcccaggcccttcccgtgtatctgatgacgctcatgaaaggggcctcccggagaagctggcctctgaacgagggaattatggctgtcggcctggtgtctcttctgggctccgccctcctgaagaatgatgttcccctcgcggggcctatggtggccggaggcctgcttctggctgcctacgtcatgagcgggtccagcgctgacctgtctctcgaaaaggccgccaacgtgcaatgggatgagatggctgacatcacaggaagctcccccatcattgaagtgaaacaggatgaggacggctctttcagcatccgcgatgttgaggaaaccaatatgattaccctgcttgtcaagctggcgctcatcacagtgtccgggctgtacccgctcgccattcctgtgaccatgacactgtggtatatgtggcaggtcaaaacgcagcggtctggagctctttgggacgtgcccagccctgccgccacccaaaaggctgccctgtccgagggcgtttacagaatcatgcagcgcggcctgtttgggaaaacacaggtgggagtcggcatccacatggaaggggtgttccacaccatgtggcatgttacacggggatctgtgatttgtcacgagaccggcagactcgaacccagctgggcggatgtccgcaacgacatgatctcctatgggggaggctggcggctgggcgataagtgggacaaggaggaggacgtgcaggttcttgctattgaaccggggaaaaatcctaagcatgtgcaaacgaaacccggactgttcaagaccctcacaggcgagatcggggccgtcaccctggattttaaacctggaacaagcggctctcccattatcaacagaaaggggaaagtgatcggcctctacggaaatggcgtggtcaccaagtccggggactatgttagcgccattacacaggctgaacgcatcggagagcccgattacgaggtggacgaagatattttccggaagaaaagactgacgatcatggaccttcaccctggcgccgggaagaccaaacggattctgccgtctatcgtgcgcgaggcgctgaagagacggctccgcacactgattcttgctcccaccagagtcgtggccgccgaaatggaggaagctctgcggggactccctatcagatatcagacccccgccgttaaatccgagcatacaggccgcgagatcgtggatctgatgtgccacgctacgtttaccacacggctcctgagctccaccagagtccctaactacaatcttattgtgatggacgaagcccacttcacagatccctctagcgttgcggcccgcgggtacatctccacccgggtggagatgggcgaagctgccgctatttttatgacggccacacctccgggagccaccgaccccttccctcagagcaactctcccatcgaggatattgaaagagagatccctgagcgctcctggaataccggctttgactggatcacagactatcaagggaagaccgtctggttcgtgcccagcattaaggctggaaacgatatcgcgaattgcctgcggaaatctggcaagaaagtcattcagctgagcagaaagacatttgacaccgaatacccgaaaacgaagctcacagattgggacttcgtggttaccacagatatctccgagatgggggccaactttcgcgctggaagagtgattgaccctcggcgctgtctgaagcccgtgatccttaccgatggccccgaaagagtcatcctggccgggcctattcccgttacgcctgcctctgctgcccagcggcgcggcagaatcggacggaacccggcgcaagaggacgatcagtatgtgttcagcggcgaccccctcaaaaatgatgaagaccatgctcactggaccgaggccaagatgctgctggataacatttacacacctgaggggatcattcccaccctcttcggacctgaaagagagaaaacacaggccatcgacggcgaatttcgccttagaggggaacagagaaagaccttcgtggagctgatgcgccggggagacctgcccgtctggctctcctataaagtggcttctgccggcattagctacaaggatagagaatggtgctttacaggcgagcggaataaccaaatcctggaagagaatatggaagttgagatctggacccgcgagggggaaaagaagaaacttagaccgcggtggctggacgcgcgcgtgtatgccgatcctatggctctcaaagacttcaaagagtttgcctccggaagaaaaagcattacgctggatatcctgacagaaattgcttctctccccacctacctttccagccgggccaagctggctctggacaacatcgtcatgctccataccacagagcgcggcgggagagcctaccagcacgcgctgaatgaacttcctgagtccctggagaccctcatgctggtggccctgctcggagctatgacagccggcattttcctctttttcatgcaggggaagggaatcggcaaactgtctatgggcctgatcacgattgctgtcgccagcgggctcctgtgggtggccgaaatccagccccaatggattgctgcgtccatcattcttgagtttttcctgatggttctcctgatccctgaacccgagaagcagcggaccccgcaggataaccagctgatctatgtgattctcacaatccttaccattatcggactgattgccgctaatgaaatgggcctgatcgagaaaacaaagaccgactttgggttctaccaagtcaaaacggagaccacaattctcgatgtggacctgcgccctgcctctgcctggaccctttatgctgttgccacaaccatcctgacgcccatgctcagacacacaatcgaaaacaccagcgcgaatctgtccctggccgctattgccaaccaggctgccgtgctcatgggacttggcaaggggtggcccctgcatcggatggatctgggagtccctctcctggcgatgggctgttacagccaggtgaatccgacaacccttaccgcctctctggtgatgctcctggttcactatgctatcattggccccgggctgcaggccaaagctacaagagaggcccaaaagcgcacggctgccggaatcatgaagaaccctaccgtcgacggcattacagtgatcgatctcgaacccatctcctacgaccctaaatttgagaagcagcttggacaggtgatgctgctggtcctctgcgcgggacaactgcttctgatgcggaccacatgggccttctgtgaggttctcaccctggctacgggccccattctgacactctgggaagggaatcctggaagattctggaacaccaccatcgccgtgagcacagctaacatttttcgcggctcttatcttgccggcgccgggctggcgttctccctgatcaaaaatgctcagaccccgcggagaggaacaggcacgaccggggagacactcggagaaaagtggaaacgccagctgaacagccttgaccggaaggagtttgaagagtacaagagatctggcattctggaggtggatcgcaccgaagccaaaagcgctctcaaggacgggtccaaaatcaagcatgccgtctctcggggaagctccaaaatcagatggattgtggagcgcggcatggttaagcccaagggcaaagtggtcgatctggggtgcggacggggcgggtggagctactatatggccacactgaagaatgtgaccgaagttaaaggatacacgaagggcgggcctggacacgaggaacccatccctatggctacctatggctggaacctcgtgaaacttcattccggcgtcgacgtgttctacaagcccacagaacaggtggataccctgctgtgtgacattggggagtctagctccaatccgacaatcgaagagggaagaaccctccgcgtcctgaagatggttgaaccttggctttctagcaaacccgagttttgcattaaggtgctgaacccctatatgcctacagtgatcgaggagctcgagaaactgcaaagaaagcacggcgggaatctggtccggtgtcccctctcccgcaactctacccacgaaatgtactgggtgagcggagcctccggcaatattgttagctctgtgaacacgacatccaaaatgcttctgaatagattcaccacccggcatagaaagcctacatatgagaaagatgtcgacctgggggcgggaacgcggagcgtgtctaccgaaacagagaagccggatatgaccatcatcggccgcagactccagcggctgcaggaggaacacaaggagacatggcattacgaccaggaaaacccctaccgcacctgggcctatcacggctcctacgaggctcctagcacagggtctgcctccagcatggttaatggagtggtcaaacttctgaccaagccctgggatgtgattcctatggttacgcaactcgctatgaccgacacaaccccctttggccagcagagagtgttcaaagaaaaggtcgacacacggaccccgcagcctaaacccgggacgcgcgtggtcatgacaaccacagccaactggctgtgggcgctgctcggaaagaagaaaaatcctagactgtgcacccgggaggagtttatctccaaggtgcgcagcaacgccgctattggcgccgttttccaagaggagcaggggtggacgtctgctagcgaagccgtgaatgattccagattttgggagcttgtcgacaaagaacgggctctgcaccaggagggcaagtgtgagtcttgcgtgtataacatgatgggaaaacgcgaaaagaagctcggcgagttcgggagagccaaaggaagccgggcgatctggtacatgtggctgggcgcccgctttcttgagttcgaggctctggggttcctcaacgaagatcattggtttggaagagaaaattcctggtctggcgtggagggggaaggcctgcaccggctgggatatattctcgaggaaatcgacaagaaagatggcgacctgatgtacgccgatgacaccgctgggtgggatacaagaatcaccgaggacgatcttcaaaacgaggaactgattacagagcagatggcgccccaccacaagatcctcgccaaagccattttcaagctgacctatcagaataaggttgtgaaagtccttcgccctacaccccggggagctgtgatggacatcattagcagaaaggatcagcgcggctccgggcaagttggaacctacggcctgaacacgtttacaaatatggaagtgcagctcatccggcagatggaggccgaaggggtcatcacccaggacgacatgcaaaacccgaaaggcctgaaggagagagtggagaaatggctgcgcgaatgcggagtcgatcggctcaagagaatggccatttctggcgacgattgtgtggttaaacctctggacgagcgcttcgggaccagccttctgtttctcaatgatatgggaaaggtgcggaaggacatcccccagtgggaaccctccaaaggctggaagaactggcaggaggtccctttctgcagccatcactttcacaaaattttcatgaaggatgggagatctctggtggttccgtgtcgcaatcaggacgaacttatcggacgggctagaatttcccaaggcgccgggtggagcctgcgggagacagcttgcctcggcaaagcctacgcgcagatgtggtctctgatgtattttcatagacgcgatctgcggctcgcctccatggctatctgtagcgccgtgcccaccgagtggttccctacatccagaacgacctggtctatccacgctcatcaccagtggatgacaaccgaagacatgctgaaggtctggaaccgcgtgtggattgaggataatcccaacatgatcgacaagacacctgtgcacagctgggaagacattccctaccttggaaaaagagaggatctgtggtgcggctccctcatcgggctgagctctcgggccacctgggcgaagaatattcatacggccatcacccaggttcgcaaccttattggaaaagaagagtatgtcgactacatgcctgtgatgaagagatattccgctcccagcgagtctgaaggcgtgctgtga

SEQ ID NO: 20973 - RNA, 9867 nt, synthetic construct
  misc_feature 1..9867: note = derived and/or modified CDS sequence (opt5) from DENV-4__EU854296__SS-prME
  source 1..9867: mol_type = other RNA
agcaccatcaccctgctttgcctgattcccacggtgatggccttccacctttccaccagagacggagagcctctgatgatcgtggctaagcatgaacgggggcgcccgctcctgtttaagaccaccgaggggattaacaagtgtacccttatcgccatggatctgggagaaatgtgcgaggacaccgttacatacaagtgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggaatggggctggagacccgggctgaaacgtggatgagctccgagggagcctggaaacatgcccaacgcgtggagtcttggatccttagaaatcctggcttcgctctgctcgccggctttatggcttacatgatcgggcagacaggcattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctagcatttctaatatcaccacagccacccgctgcccgacgcaaggagagccctatcttaaggaggaacaggaccagcagtacatttgtagacgggatgtggtggaccgcggctgggggaacggatgcggcctgttcgggaaaggaggcgtcgtgacatgcgcgaagttttcctgtagcggcaaaatcaccgggaatctcgttcaaattgagaacctggaatataccgtggtcgtgacagttcataatggagatacccacgccgtgggcaacgacacatctaatcacggggtcacggctaccatcacacctagatcccccagcgtggaggtcaaacttcctgattacggagaactgaccctcgactgcgagccccggtctggcatcgacttcaacgagatgattctgatgaagatgaaaaagaaaacatggctggtgcataagcagtggtttctcgatctgccgcttccttggaccgccggggctgacacgtccgaagttcactggaattacaaagagagaatggtgaccttcaaggtcccccatgccaaacgccaggatgtgacagttctgggcagccaggaaggagccatgcactccgctctcgcgggcgccaccgaggtggactctggggatggaaaccacatgtttgctggccatctgaagtgtaaggtccggatggaaaaacttagaatcaaggggatgagctatacaatgtgctccggaaaattcagcattgacaaggagatggccgagacccaacacggcacgacagtggtgaaagttaagtacgaaggggccggcgctccttgtaaggtccccatcgagattcgcgatgtgaataaagaaaaggtggtcggacgggtgatctcttccacacccctggccgagaacacaaacagcgttaccaatatcgagctcgaacctccgttcggcgactcttatattgtgatcggggtcggaaacagcgcgctgaccctgcattggtttagaaaaggctcctctattgggaagatgttcgagagcacataccgcggagctaaacggatggccatcctcggcgaaacggcctgggattttgggtccgtgggcggactgttcaccagccttggcaaggctgttcaccaggtgtttgggtctgtctatacaaccatgttcggaggcgtgtcctggatgattagaatcctgatcgggtttctcgttctgtggattggaacaaatagccgcaacacctctatggccatgacgtgcatcgctgtgggcgggattacactgttccttggctttaccgtccaggccgacatgggatgtgtggtgtcctggagcggccgggagctcaagtgcgggtccggaatcttcgtcgttgataatgtgcatacctggacagaacaatacaaatttcagcccgagtctcctgcgagactggccagcgctattctgaacgcccacaaggacggcgtgtgtgggatccgctccaccacacggctcgagaatgtcatgtggaaacagattacgaacgaactgaattatgtgctttgggagggaggccacgacctgaccgttgtggctggcgatgccaagggggtcctcacaaaaggaaagagagcgctgacaccccctgtgtctgacctgaagtacagctggaaaacatggggcaaggccaaaatcttcacccccgaagctcggaactccacgtttcttatcgatgggccggacaccagcgagtgccctaatgaacgcagagcctggaactctctcgaggttgaggattacggattcggcatgttcacaaccaatatttggatgaagtttcgggaagggtccagcgaggtgtgtgaccatagactgatgtctgctgccatcaaagatcagaaggccgtccacgctgacatgggatattggattgaatccagcaaaaaccaaacatggcagatcgagaaggcgtctctgattgaagtgaagacctgcctctggcccaaaacacataccctgtggagcaatggcgttcttgagtcccagatgctgatccctaagagctacgccggccccttctctcagcacaactatcgccaagggtacgctacgcagacagtgggaccttggcacctcggcaaactggagatcgattttggggaatgccccggaaccaccgtcacaattcaggaggactgtgatcatcggggcccgtccctgagaaccacgacagccagcgggaaacttgtgacccagtggtgctgtcgctcctgcacaatgcctcccctcagattcctgggagaagacggctgttggtatggcatggagatccggcccctgtctgagaaagaagagaacatggtcaagagccaagtcaccgccgggcagggaacatccgaaaccttttctatgggcctcctgtgccttacgctgttcgttgaggaatgtctccgcagacgggtgacccgcaagcacatgattctggctgtggtcatcacactgtgcgccattatccttgggggactcacctggatggatctgctgagagcgctcatcatgctgggcgacacaatgagcgggcggattggaggccagacccatcttgctatcatggccgtgtttaaaatgtcccctggctacgttctgggggtgttcctccgcaagctgacgtctagagagacagccctgatggtcattggaatggctatgaccacaacccttagcatcccgcacgacctgatggagctcattgatggcatctccctggggctcatcctgcttaaaattgtgacccagtttgacaatacacaagttggaacgctggccctcagcctgaccttcatccggtctacaatgtccctggtgatggcgtggcgcaccattatggctgtcctttttgtggtcacactgatccccctctgtagaaccagctgcctgcagaagcagtctcattgggtggaaattacggccctcatcctgggcgcccaagcccttcctgtttatctgatgacactcatgaaaggggcctcccggagaagctggcccctgaacgagggaattatggctgtgggcctggtctctcttctgggctccgccctcctgaagaatgatgtgcctctcgcggggcccatggttgccggaggcctgcttctggctgcctacgtgatgagcgggtccagcgctgacctgtctctcgaaaaggccgccaacgtccagtgggatgagatggctgacatcaccggaagctcccctatcattgaagtgaaacaggatgaggacggctctttcagcatccgcgatgtggaggaaaccaatatgattacactgcttgttaagctggcgctcatcaccgtctccgggctgtaccccctcgccattccggtgacaatgacgctgtggtatatgtggcaagtgaaaacccaacggtctggagctctttgggacgtccctagccccgccgccacacagaaggctgccctgtccgagggcgtgtacagaatcatgcagcgcggcctgtttgggaaaacccaggttggagtgggcatccacatggaaggggtcttccacacaatgtggcatgtgacccggggatctgttatttgtcacgagacgggcagactcgaacctagctgggcggatgtgcgcaacgacatgatctcctatgggggaggctggcggctgggcgataagtgggacaaggaggaggacgtccaagtgcttgctattgaacccgggaaaaatccgaagcatgttcagaccaaacctggactgttcaagacactcaccggcgagatcggggccgtgacactggattttaaacccggaaccagcggctctcctattatcaacagaaaggggaaagtcatcggcctctacggaaatggcgtggtgacaaagtccggggactatgtcagcgccattacgcaggctgaacgcatcggagagcccgattacgaggttgacgaagatattttccggaagaaaagactgaccatcatggaccttcaccccggcgccgggaagacaaaacggattctgccttctatcgtgcgcgaggcgctgaagagacggctccgcaccctgattcttgctccgaccagagtggtcgccgccgaaatggaggaagctctgcggggactccccatcagatatcagacccctgctgtgaaatccgagcatacgggccgcgagatcgttgatctgatgtgccacgctacctttacaacccggctcctgagctccacaagagtgcccaactacaatcttattgtcatggacgaagcccacttcaccgatccttctagcgtggcggcccgcgggtacatctccacgcgggttgagatgggcgaagctgccgctatttttatgacagccacaccccctggagccaccgacccgttcccccaaagcaactctcctatcgaggatattgaaagagagatccccgagcgctcctggaatacaggctttgactggatcaccgactatcaggggaagacagtgtggttcgtccctagcattaaggctggaaacgatatcgcgaattgcctgcggaaatctggcaagaaagtgattcagctgagcagaaagacctttgacacggaataccccaaaacaaagctcaccgattgggacttcgtcgtgacaaccgatatctccgagatgggggccaactttcgcgctggaagagttattgacccgcggcgctgtctgaagcctgtgatccttacggatggccccgaaagagtgatcctggccgggcccattcctgtcacccccgcctctgctgcccaacggcgcggcagaatcggacggaaccctgcgcaggaggacgatcagtatgttttcagcggcgacccgctcaaaaatgatgaagaccatgctcactggacagaggccaagatgctgctggataacatttacacccccgaggggatcattcctacactcttcggacccgaaagagagaaaacccaggccatcgacggcgaatttcgccttagaggggaacaacggaagacattcgtggagctgatgcgccggggagacctgcctgtgtggctctcctataaagtcgcttctgccggcattagctacaaggatagagaatggtgctttaccggcgagcggaataaccagatcctggaagagaatatggaagtggagatctggacgcgcgagggggaaaagaagaaacttagaccccggtggctggacgcgcgcgtttatgccgatccgatggctctcaaagacttcaaagagtttgcctccggaagaaaaagcattacactggatatcctgaccgaaattgcttctctccctacctacctttccagccgggccaagctggctctggacaacatcgtgatgctccatacaaccgagcgcggcgggagagcctaccagcacgcgctgaatgaacttcccgagtccctggagacactcatgctggtcgccctgctcggagctatgacggccggcattttcctctttttcatgcaggggaagggaatcggcaaactgtctatgggcctgatcaccattgctgtggccagcgggctcctgtgggtcgccgaaatccaacctcagtggattgctgcgtccatcattcttgagtttttcctgatggtgctcctgatccccgaacctgagaagcagcggacaccccaggataaccaactgatctatgttattctcaccatccttacaattatcggactgattgccgctaatgaaatgggcctgatcgagaaaaccaagacggactttgggttctaccaggccaaaaccgagacaaccattctcgatgtggacctgcgcccggcctctgcttggacactttatgccgtcgcgaccacgatcctgacacctatgctcagacacaccatcgaaaacacaagcgccaatctgtccctggctgccattgctaaccaggccgcggtgctcatgggacttggcaaggggtggcccctgcatcggatggatctgggagttcccctcctggccatgggctgttacagccaggtgaatcctaccacccttacagcttctctggtcatgctcctggtgcactatgccatcattggcccggggctgcaagctaaagccacgagagaggctcagaagcgcaccgccgcgggaatcatgaagaaccccacagtggacggcattaccgttatcgatctcgaacctatctcctacgaccccaaatttgagaagcagcttgggcaagtcatgctgctggtgctctgcgccggacagctgcttctgatgcggacaacctgggctttctgtgaggtgctcacgctggccacaggccctattctgaccctctgggaagggaatcccggaagattctggaacaccacaatcgctgtcagcaccgccaacatttttcgcggctcttatcttgccggcgcggggctggctttctccctgatcaaaaatgcccagacacctcggagaggaacgggcaccattggggagacactcggagaaaagtggaaacgccagctgaacagccttgaccggaaggagtttgaagagtacaagagatctggcatcctggaggttgatcgcaccgaagctaaaagcgccctcaaggacgggtccaaaatcaagcatgccgtgtctcggggaagctccaaaattagatggatcgtggagcgcggcatggtcaagccgaagggcaaagtggttgatctggggtgcggacggggcgggtggagctactatatggctacactgaagaatgtgaccgaagtcaaaggatacacgaagggcgggcccggacacgaggaacctattcccatggccacctatggctggaacctcgtgaaacttcattccggcgttgacgtgttctacagacctacagagcaagtcgataccctgctgtgtgacatcggggagtctagctccaatcccacaattgaagagggacgcaccctcagagtgctgaagatggtggaaccgtggctttctagcaagcctgagttttgcatcaaagtcctgaacccctatatgcccacagttattgaggaactcgagaagctgcagcggaaacacggcgggaatctggtgcgctgtcctctctccagaaactctacccacgaaatgtactgggtgagcggagcgtccggcaatatcgtcagctctgtgaacacgacatccaagatgcttctgaatcggttcaccaccagacatcggaaacccacatatgagaaggatgttgacctgggggccggaacgcgcagcgtgtctaccgaaacagagaaacctgatatgaccatcattggcagacggctccagcgcctgcaggaggaacacaaggagacatggcattacgaccaagaaaacccgtacagaacctgggcttatcacggctcctacgaggcccccagcacagggtctgcttccagcatggtcaatggagtggttaaacttctgaccaaaccttgggatgtgatccccatggtcacgcagctcgccatgaccgacacaaccccttttggccagcagcgggtgttcaaggaaaaagttgacacacgcacaccccagccgaagcctgggacgagaatggtgatgacaaccacagcgaactggctgtgggccctgctcggcaagaagaagaatccccggctgtgcacccgcgaggagtttatttccaaagtcagaagcaacgctgccatcggcgctgtgttccaggaggaacaggggtggacgtctgccagcgaagctgtcaatgattcccggttttgggagcttgtggacaaggaacgcgccctgcaccaagagggcaaatgtgagtcttgcgtttataacatgatgggaaagagagagaagaagctcggcgagttcgggcgggcgaagggaagccgcgccatttggtacatgtggctgggcgctagatttcttgagttcgaggccctggggttcctcaacgaagatcattggtttggacgggaaaattcctggtctggcgtggagggggaaggcctgcacagactgggatatatcctcgaggaaatcgacaaaaaggatggcgacctgatgtacgctgatgacaccgccgggtgggatacacgcattaccgaggacgatcttcagaacgaggaactgatcacagagcagatggcccctcatcacaaaattctcgcgaaggctatcttcaaactgacctatcagaataaggtcgtgaaggtgcttcggcccacacctagaggagccgttatggacattatcagccgcaaagatcaacggggctccggacaggtgggaacctacggcctgaacacgtttacaaatatggaagtccagctcatcagacagatggaggccgaaggggtgattacccaagacgacatgcagaaccccaagggcctgaaagagcgcgttgagaagtggctgcgggaatgcggagtggatagactcaaacgcatggctatctctggcgacgattgtgtcgtgaagccgctggacgagcggttcgggaccagccttctgtttctcaatgatatgggaaaagtcagaaaggacattcctcagtgggaaccctccaagggctggaaaaactggcaggaggtgcccttctgcagccatcactttcacaagatcttcatgaaagatgggcgctctctggttgtgccttgtcggaatcaagacgaacttattggcagagcccggatctcccagggcgctgggtggagcctgagagagacagcctgcctcggcaaggcgtacgcccagatgtggtctctgatgtattttcatcgccgggatctgagactcgcttccatggccatctgtagcgctgtcccgaccgagtggttccccacatcccgcacgacctggtctattcacgcccatcaccagtggatgacaaccgaagacatgctgaaagtgtggaacagagtttggatcgaggataatcctaacatgattgacaagacacccgtgcacagctgggaagacatcccttaccttggaaagcgggaggatctgtggtgcggctccctcattgggctgagctctcgcgcgacctgggccaaaaatatccatacggctattacccaagtcagaaaccttatcggaaaggaagagtatgtggactacatgcccgtgatgaaacggtattccgcccctagcgagtctgaaggcgttctgtga

SEQ ID NO: 20974 - RNA, 9867 nt, synthetic construct
  misc_feature 1..9867: note = derived and/or modified CDS sequence (opt5) from DENV-4__GQ199878__SS-prME
  source 1..9867: mol_type = other RNA
agcaccatcaccctgctttgcctgattcccacggtgatggctttccacctttccacccgggacggagagcctctgatgatcgtcgctaagcatgaacgggggcgcccgctcctgtttaagaccaccgaggggattaacaagtgtacccttatcgccatggatctgggcgaaatgtgcgaggacaccgttacctacaagtgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaagcatgcccaacgcgtggagtcttggatccttagaaatcctggcttcgctctgctcgccggctttatggcttacatgatcgggcagacaggcattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctagcatttctaatatcaccacagccacccgctgcccgacgcaaggagagccctatcttaaggaggaacaggaccagcagtacatttgtagacgggatgtggtggaccgcggctgggggaacggatgcggcctgttcgggaaaggaggcgtcgtgacatgcgcgaagttttcctgtagcggcaaaatcaccgggaatctcgttcaaattgagaacctggaatataccgtggtcgtgacagttcataatggagatacccacgccgtgggcaacgacacatctaatcacggggtcacggctaccatcacacctagatcccccagcgtggaggtcaaacttcctgattacggagaactgaccctcgactgcgagccccggtctggcatcgacttcaacgagatgattctgatgaagatgaaaaagaaaacatggctggtgcataagcagtggtttctcgatctgccgcttccttggaccgccggggctgacacgtccgaagttcactggaattacaaagagagaatggtgaccttcaaggtcccccatgccaaacgccaggatgtgacagttctgggcagccaggaaggagccatgcactccgctctcgcgggcgccaccgaggtggactctggggatggaaaccacatgtttgctggccatctgaagtgtaaggtccggatggaaaaacttagaatcaaggggatgagctatacaatgtgctccggaaaattcagcattgacaaggagatggccgagacccaacacggcacgacagtggtgaaagttaagtacgaaggggccggcgctccttgtaaggtccccatcgagattcgcgatgtgaataaagaaaaggtggtcggacgggtgatctcttccacacccctggccgagaacacaaacagcgttaccaatatcgagctcgaacctccgttcggcgactcttatattgtgatcggggtcggaaacagcgcgctgaccctgcattggtttagaaaaggctcctctattgggaagatgttcgagagcacataccgcggagctaaacggatggccatcctcggcgaaacggcctgggattttgggtccgtgggcggactgttcaccagccttggcaaggctgttcaccaggtgtttgggtctgtctatacaaccatgttcggaggcgtgtcctggatgattagaatcctgatcgggtttctcgttctgtggattggaacaaatagccgcaacacctctatggccatgacgtgcatcgctgtgggcgggattacactgttccttggctttaccgtccaggccgacatgggatgtgtggtgtcctggagcggccgggagctcaagtgcgggtccggaatcttcgtcgttgataatgtgcatacctggacagaacaatacaaatttcagcccgagtctcctgcgagactggccagcgctattctgaacgcccacaaggacggcgtgtgtgggatccgctccaccacacggctcgagaatgtcatgtggaaacagattacgaacgaactgaattatgtgctttgggagggaggccacgacctgaccgttgtggctggcgatgtcaagggggtgctcacaaaaggaaagagagccctgacaccccctgtttctgacctgaagtacagctggaaaacatggggcaaggcgaaaatcttcacccccgaagcccggaactccacgtttcttatcgatgggccggacaccagcgagtgccctaatgaacgcagagcttggaactctctcgaggtggaggattacggattcggcatgttcacaaccaatatttggatgaagtttcgggaagggtccagcgaggtctgtgaccatagactgatgtctgccgctatcaaagatcagaaggccgtgcacgccgacatgggatattggattgaatccagcaaaaaccaaacatggcagatcgagaaggcttctctgattgaagttaagacctgcctctggcccaaaacacataccctgtggagcaatggcgtgcttgagtcccagatgctgatccctaagagctacgcgggccccttctctcagcacaactatcgccaagggtacgccacgcagacagtcggaccttggcacctcggcaaactggagatcgattttggggaatgccccggaaccaccgtgacaattcaggaggactgtgatcatcggggcccgtccctgagaaccacgacagctagcgggaaacttgtgacccagtggtgctgtcgctcctgcacaatgcctcccctcagattcctgggagaagacggctgttggtatggcatggagatccggcccctgtctgagaaagaagagaacatggtcaagagccaagttgccgccgggcagggaacctccgaaacattttctatgggcctcctgtgccttaccctgttcgtggaggaatgtctccgcagacgggtgacgcgcaagcacatgattctggctgtcgtgatcaccctgtgcgccattatccttgggggactcacatggatggatctgctgagagcgctcatcatgctgggcgacaccatgagcgggcggattggaggccagacacatcttgctatcatggccgtttttaaaatgtcccctggctacgtgctgggggtcttcctccgcaagctgacctctagagagacggccctgatggtgattggaatggctatgacaaccacacttagcatcccgcacgacctgatggagctcattgatggcatctccctggggctcatcctgcttaaaattgttacccagtttgacaatacccaagtgggaacactggccctcagcctgacgttcatccggtctaccatgtccctggtcatggcgtggcgcacaattatggctgtgctttttgtcgtgaccctgatccccctctgtagaacaagctgcctgcagaagcagtctcattgggttgaaattaccgccctcatcctgggcgcccaagcccttcctgtgtatctgatgacgctcatgaaaggggcctcccggagaagctggcccctgaacgagggaattatggctgtcggcctggtgtctcttctgggctccgccctcctgaagaatgatgttcctctcgcggggcccatggtggccggaggcctgcttctggctgcctacgtcatgagcgggtccagcgctgacctgtctctcgaaaaggccgccaacgtgcagtgggatgagatggctgacatcacaggaagctcccctatcattgaagtgaaacaggatgaggacggctctttcagcatccgcgatgttgaggaaaccaatatgattaccctgcttgtcaagctggcgctcatcacagtgtccgggctgtaccccctcgccattccggtgaccatgacactgtggtatatgtggcaggtcaaaacgcaacggtctggagctctttgggacgtgcctagccccgccgccacccagaaggctgccctgtccgagggcgtttacagaatcatgcagcgcggcctgtttgggaaaacacaggtgggagtcggcatccacatggaaggggtgttccacaccatgtggcatgttacacggggatctgtgatttgtcacgagaccggcagactcgaacctagctgggcggatgtccgcaacgacatgatctcctatgggggaggctggcggctgggcgataagtgggacaaggaggaggacgtgcaagttcttgctattgaacccgggaaaaatccgaagcatgtgcagacgaaacctggactgttcaagaccctcacaggcgagatcggggccgtcaccctggattttaaacccggaacaagcggctctcctattatcaacagaaaggggaaagtgatcggcctctacggaaatggcgtggtcaccaagtccggggactatgttagcgccattacacaggctgaacgcatcggagagcccgattacgaggtggacgaagatattttccggaagaaaagactgacgatcatggaccttcaccccggcgccgggaagaccaaacggattctgccttctatcgtgcgcgaggcgctgaagagacggctccgcacactgattcttgctccgaccagagtcgtggccgccgaaatggaggaagctctgcggggactccccatcagatatcagacccctgccgttaaatccgagcatacaggccgcgagatcgtggatctgatgtgccacgctacgtttaccacacggctcctgagctccaccagagtccccaactacaatcttattgtgatggacgaagcccacttcacagatccttctagcgttgcggcccgcgggtacatctccacccgggtggagatgggcgaagctgccgctatttttatgacggccacaccccctggagccaccgacccgttcccccaaagcaactctcctatcgaggatattgaaagagagatccccgagcgctcctggaataccggctttgactggatcacagactatcaggggaagaccgtctggttcgtgcctagcattaaggctggaaacgatatcgcgaattgcctgcggaaatctggcaagaaagtcattcagctgagcagaaagacatttgacaccgaataccccaaaacgaagctcacagattgggacttcgtggttaccacagatatctccgagatgggggccaactttcgcgctggaagagtgattgacccgcggcgctgtctgaagcctgtgatccttaccgatggccccgaaagagtcatcctggccgggcccattcctgttacgcccgcctctgctgcccaacggcgcggcagaatcggacggaaccctgcgcaggaggacgatcagtatgtgttcagcggcgacccgctcaaaaatgatgaagaccatgctcactggaccgaggccaagatgctgctggataacatttacacacccgaggggatcattcctaccctcttcggacccgaaagagagaaaacacaggccatcgacggcgaatttcgccttagaggggaacaaagaaagaccttcgtggagctgatgcgccggggagacctgcctgtctggctctcctataaagtggcttctgccggcattagctacaaggatagagaatggtgctttacaggcgagcggaataaccagatcctggaagagaatatggaagttgagatctggacccgcgagggggaaaagaagaaacttagaccccggtggctggacgcgcgcgtgtatgccgatccgatggctctcaaagacttcaaagagtttgcctccggaagaaaaagcattacgctggatatcctgacagaaattgcttctctccctacctacctttccagccgggccaagctggctctggacaacatcgtcatgctccataccacagagcgcggcgggagagcctaccagcacgcgctgaatgaacttcccgagtccctggagaccctcatgctggtggccctgctcggagctatgacagccggcattttcctctttttcatgcaggggaagggaatcggcaaactgtctatgggcctgatcacgattgctgtcgccagcgggctcctgtgggtggccgaaatccaacctcagtggattgctgcgtccatcattcttgagtttttcctgatggttctcctgatccccgaacctgagaagcagcggacaccccaggataaccaactgatctatgtgattctcacaatccttaccattatcggactgattgccgctaatgaaatgggcctgatcgagaaaacaaagaccgactttgggttctaccaggtcaaaacggagaccacaattctcgatgtggacctgcgcccggcctctgcctggaccctttatgctgttgccacaaccatcctgacgcctatgctcagacacacaatcgaaaacaccagcgcgaatctgtccctggccgctattgccaaccaggctgccgtgctcatgggacttggcaaggggtggcccctgcatcggatggatctgggagtccccctcctggcgatgggctgttacagccaggtgaatcctacaacccttaccgcctctctggtgatgctcctggttcactatgctatcattggcccggggctgcaagccaaagctacaagagaggcccagaagcgcacggctgccggaatcatgaagaaccccaccgtcgacggcattacagtgatcgatctcgaacctatctcctacgaccccaaatttgagaagcagcttgggcaagtgatgctgctggtcctctgcgcgggacagctgcttctgatgcggaccacatgggccttctgtgaggttctcaccctggctacgggccctattctgacactctgggaagggaatcccggaagattctggaacaccaccatcgccgtgagcacagctaacatttttcgcggctcttatcttgccggcgccgggctggcgttctccctgatcaaaaatgctcagacccctcggagaggaacaggcacgaccggggagacactcggagaaaagtggaaacgccagctgaacagccttgaccggaaggagtttgaagagtacaagagatctggcattctggaggtggatcgcaccgaagccaaaagcgctctcaaggacgggtccaaaatcaagcatgccgtctctcggggaagctccaaaatcagatggattgtggagcgcggcatggttaagccgaagggcaaagtggtcgatctggggtgcggacggggcgggtggagctactatatggccacactgaagaatgtgaccgaagttaaaggatacacgaagggcgggcccggacacgaggaacctatccccatggctacctatggctggaacctcgtgaaacttcattccggcgtcgacgtgttctacaagcctacagagcaagtggataccctgctgtgtgacattggggagtctagctccaatcccacaatcgaagagggaagaaccctccgcgtcctgaagatggttgaaccgtggctttctagcaaacctgagttttgcattaaggtgctgaacccctatatgcccacagtgatcgaggaactcgagaaactgcagagaaagcacggcgggaatctggtccggtgtcctctctcccgcaactctacccacgaaatgtactgggtgagcggagcctccggcaatattgttagctctgtgaacacgacatccaaaatgcttctgaatagattcaccacccggcatagaaagcccacatatgagaaagatgtcgacctgggggcgggaacgcggagcgtgtctaccgaaacagagaagcctgatatgaccatcatcggccgcagactccagcggctgcaggaggaacacaaggagacatggcattacgaccaagaaaacccgtaccgcacctgggcctatcacggctcctacgaggctcccagcacagggtctgcctccagcatggttaatggagtggtcaaacttctgaccaagccttgggatgtgattcccatggttacgcagctcgctatgaccgacacaaccccttttggccagcagagagtgttcaaagaaaaggtcgacacacggacaccccaaccgaaacctgggacgcgcatggtgatgacaaccacagccaactggctgtgggcgctgctcggaaagaagaaaaatcccagactgtgcacccgggaggagtttatctccaaggtccgcagcaacgccgctattggcgccgtgttccaggaggagcaggggtggacgtctgctagcgaagccgttaatgattccagattttgggagcttgtggacaaagaacgggctctgcaccaagagggcaagtgtgagtcttgcgtctataacatgatgggaaaacgcgaaaagaagctcggcgagttcgggagagccaaaggaagccgggcgatctggtacatgtggctgggcgcccgctttcttgagttcgaggctctggggttcctcaacgaagatcattggtttggaagagaaaattcctggtctggcgtggagggggaaggcctgcaccggctgggatatattctcgaggaaatcgacaagaaagatggcgacctgatgtacgccgatgacaccgctgggtgggatacaagaatcaccgaggacgatcttcagaacgaggaactgattacagagcagatggcccctcatcacaagatcctcgccaaagcgattttcaagctgacctatcagaataaggtggttaaagtgcttcgccccacacctcggggagctgtcatggacatcattagcagaaaggatcaacgcggctccggacaggtgggaacctacggcctgaacacgtttacaaatatggaagttcagctcatccggcagatggaggccgaaggggtgatcacccaagacgacatgcagaaccccaaaggcctgaaggagagagtcgagaaatggctgcgcgaatgcggagtggatcggctcaagagaatggccatttctggcgacgattgtgtcgtgaaaccgctggacgagcgcttcgggaccagccttctgtttctcaatgatatgggaaaggttcggaaggacatccctcagtgggaaccctccaaaggctggaagaactggcaggaggtgcccttctgcagccatcactttcacaaaattttcatgaaggatgggagatctctggtcgtgccttgtcgcaatcaagacgaacttatcggacgggctagaatttcccagggcgccgggtggagcctgcgggagacagcttgcctcggcaaagcctacgcgcagatgtggtctctgatgtattttcatagacgcgatctgcggctcgcctccatggctatctgtagcgccgttccgaccgagtggttccccacatccagaacgacctggtctatccacgctcatcaccagtggatgacaaccgaagacatgctgaaggtgtggaaccgcgtctggattgaggataatcctaacatgatcgacaagacacccgtgcacagctgggaagacattccttaccttggaaaaagagaggatctgtggtgcggctccctcatcgggctgagctctcgggccacctgggcgaagaatattcatacggccatcacccaagtgcgcaaccttattggaaaagaagagtatgttgactacatgcccgtcatgaagagatattccgctcctagcgagtctgaaggcgtgctgtga

SEQ ID NO: 20975 - RNA, 9867 nt, synthetic construct
  misc_feature 1..9867: note = derived and/or modified CDS sequence (opt5) from DENV-4__GQ199879__SS-prME
  source 1..9867: mol_type = other RNA
agcaccatcaccctgctttgcctgattcccacggtgatggccttccacctttccaccagagacggagagcctctgatgatcgtcgctaagcatgaacgggggagaccgctcctgtttaagaccaccgaggggattaacaagtgtacccttatcgccatggatctgggcgaaatgtgcgaggacaccgttacatacaagtgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccagcgcgtggagtcttggatccttagaaatcctggcttcgctctgctcgccggctttatggcttacatgatcgggcagacaggcattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctagcatttctaatatcaccacagccacccgctgcccgacgcaaggagagccctatcttaaggaggaacaggaccagcagtacatttgtagacgggatgtggtggaccgcggctgggggaacggatgcggcctgttcgggaaaggaggcgtcgtgacatgcgcgaagttttcctgtagcggcaaaatcaccgggaatctcgttcaaattgagaacctggaatataccgtggtcgtgacagttcataatggagatacccacgccgtgggcaacgacacatctaatcacggggtcacggctaccatcacacctagatcccccagcgtggaggtcaaacttcctgattacggagaactgaccctcgactgcgagccccggtctggcatcgacttcaacgagatgattctgatgaagatgaaaaagaaaacatggctggtgcataagcagtggtttctcgatctgccgcttccttggaccgccggggctgacacgtccgaagttcactggaattacaaagagagaatggtgaccttcaaggtcccccatgccaaacgccaggatgtgacagttctgggcagccaggaaggagccatgcactccgctctcgcgggcgccaccgaggtggactctggggatggaaaccacatgtttgctggccatctgaagtgtaaggtccggatggaaaaacttagaatcaaggggatgagctatacaatgtgctccggaaaattcagcattgacaaggagatggccgagacccaacacggcacgacagtggtgaaagttaagtacgaaggggccggcgctccttgtaaggtccccatcgagattcgcgatgtgaataaagaaaaggtggtcggacgggtgatctcttccacacccctggccgagaacacaaacagcgttaccaatatcgagctcgaacctccgttcggcgactcttatattgtgatcggggtcggaaacagcgcgctgaccctgcattggtttagaaaaggctcctctattgggaagatgttcgagagcacataccgcggagctaaacggatggccatcctcggcgaaacggcctgggattttgggtccgtgggcggactgttcaccagccttggcaaggctgttcaccaggtgtttgggtctgtctatacaaccatgttcggaggcgtgtcctggatggttcgcattctgatcgggtttctcgtgctgtggatcggaacaaatagccgcaacacctctatggccatgacgtgcattgctgtcggcgggatcacactgttccttggctttaccgtgcaggccgacatgggatgtgtggtctcctggagcggccgggagctcaagtgcgggtccggaattttcgttgtggataatgtgcatacctggacagaacaatacaaatttcagcccgagtctcctgcgagactggccagcgctatcctgaacgcccacaaggacggcgtctgtgggattcgctccaccacacggctcgagaatgtgatgtggaaacagatcacgaacgaactgaattatgttctttgggagggaggccacgacctgaccgtggtcgctggcgatgtgaagggggttctcacaaaaggaaagagagccctgacaccccctgtgtctgacctgaagtacagctggaaaacatggggcaaggcgaaaattttcacccccgaagcccggaactccacgtttcttatcgatgggccggacaccagcgagtgccctaatgaacgcagagcttggaactctctcgaggtcgaggattacggattcggcatgttcacaaccaatatctggatgaagtttcgggaagggtccagcgaggtgtgtgaccatagactgatgtctgccgctattaaagatcagaaggccgttcacgccgacatgggatattggatcgaatccagcaaaaaccaaacatggcagattgagaaggcttctctgatcgaagtgaagacctgcctctggcccaaaacacataccctgtggagcaatggcgtccttgagtcccagatgctgattcctaagagctacgcgggccccttctctcagcacaactatcgccaagggtacgccacgcagacagtgggaccttggcacctcggcaaactggagatcgattttggggaatgccccggaaccaccgtgacaatccaggaggactgtgatcatcggggcccgtccctgagaaccacgacagctagcgggaaacttgtcacccagtggtgctgtcgctcctgcacaatgcctcccctcagattcctgggagaagacggctgttggtatggcatggagattcggcccctgaacgagaaagaagagaatatggttaagtctcaagtgaccgccgggcagggaacaagcgaaaccttttccatgggcctcctgtgccttacgctgttcgtggaggaatgtctccgcagacgggtcacccgcaagcacatgatcctggtggttgtgattacactgtgcgccatcattcttgggggactcacctggatggatctgctgagagctctcatcatgctgggcgacacaatgtctgggcggatcggaggccagattcatcttgccatcatggcggtctttaaaatgagccctggctacgtgctgggggttttcctccgcaagctgacctccagagagacggctctgatggtgattggaatggccatgacaaccgtcctttctatcccgcacgacctgatggagctcattgatggcatcagcctggggctcatcctgcttaaaattgtgacacagtttgacaacacccaagtcggaaccctggccctctccctgacattcatccggagcacgatgcccctggtgatggcttggcgcaccattatggccgttctttttgtggtcacactgatccctctctgtagaacctcttgcctgcagaagcagtcccattgggtggaaattacagcgctcatcctgggcgctcaagcccttcccgtttatctgatgaccctcatgaaaggggccagccggagatcttggcctctgaatgagggaattatggctgtgggcctggtctcccttctgggcagcgccctcctgaagaacgatgtgcccctcgctgggcctatggtggccggaggcctgcttctggcggcctacgttatgtctgggtccagcgctgacctgtccctcgaaaaggccgctaatgtccagtgggatgagatggccgacatcacgggaagctctcccatcattgaagtgaaacaggatgaggacggcagcttctccatccgcgatgtggaggaaacaaacatgattaccctgcttgtcaagctggccctcatcaccgtgtctgggctgtacccgctcgctattcctgttacaatgaccctgtggtatatgtggcaagtgaaaacacaacggagcggagcgctttgggacgtcccctcccctgccgctacgcagaaggccgccctgtctgagggcgtgtacagaatcatgcagcgcggcctgtttgggaaaacccaggttggagtgggcatccacatggaaggggtcttccacacaatgtggcatgtgacccggggaagcgttatttgtcacgagacaggcagactcgaaccctcctgggctgatgtgcgcaatgacatgatctcttatgggggaggctggcggctgggcgataagtgggacaaggaggaggacgtccaagtgcttgccattgaaccggggaaaaaccctaagcatgtgcagaccaaacccggactgttcaagacgctcaccggcgagatcggggcggtcacactggattttaaacctggaaccagcggctcccccattatcaatagaaaggggaaagttatcggcctctacggaaacggcgtggtgacaaagagcggggactatgtctctgctattacccaggccgaacgcatcggagagcccgattacgaggtggacgaagatattttccggaagaaaagactgacaatcatggaccttcaccctggcgccgggaagacgaaacggattctgccgtccatcgttcgcgaggctctgaagagacggctccgcaccctgattcttgcccccacaagagtggtcgcggctgaaatggaggaagccctgcggggactccctatcagatatcagacccccgccgtgaaaagcgagcataccggccgcgagatcgttgatctgatgtgccacgctacatttacgacccggctcctgtcttccacaagagtgcctaattacaaccttattgtcatggacgaagcccacttcaccgatcccagctccgtggctgcccgcgggtacatctctacacgggtcgagatgggcgaagcggccgctatttttatgaccgccacgcctccgggagctacagaccccttccctcaaagcaattcccccatcgaggatattgaaagagagatccctgagcgcagctggaacaccggctttgactggatcaccgactatcaggggaagacagtgtggttcgttccctctattaaggccggaaatgatatcgccaactgcctgcggaaatccggcaagaaagtgattcagctgagcagaaagacctttgacacagaatacccgaaaaccaagctcacggattgggacttcgtggtcacaaccgatatctctgagatgggggctaactttcgcgcgggaagagttattgaccctcggcgctgtctgaagcccgtgatccttacagatggccccgaaagagtgatcctggccgggcctattcccgtcacccctgctagcgccgcccaacggcgcggcagaatcggacggaatccggctcaggaggacgatcagtatgtgttctccggcgaccccctcaaaaacgatgaagaccatgcccactggacggaggcgaagatgctgctggataatatttacacccctgaggggatcattcccacactcttcggacctgaaagagagaaaacccaggctatcgacggcgaatttcgccttagaggggagcaacggaagacattcgttgagctgatgcgccggggagacctgcccgtgtggctctcttataaagtcgccagcgccggcatttcctacaaggatagagaatggtgctttaccggcgagcggaacaatcagatcctggaagagaacatggaagtggagatctggacacgcgagggggaaaagaagaaacttagaccgcggtggctggacgctcgcgtctatgccgatcctatggcgctcaaagacttcaaagagtttgcctctggaagaaaaagcattaccctggatatcctgacggaaattgcttccctccccacataccttagctctcgggccaagctggctctggacaatatcgtgatgctccataccaccgagcgcggcgggagagcctaccagcacgctctgaacgaacttcctgagtccctggagacactcatgctggttgccctgctcggagcgatgaccgccggcattttcctctttttcatgcaggggaagggaatcggcaaactgagcatgggcctgatcgctattgccgtggcttccgggctcctgtgggtcgccgaaatccaaccccagtggattgccgcttctatcattcttgagtttttcctgatggtgctcctgatccctgaacccgagaagcagcggacaccgcaggataatcaactgatctatgttattctcacgatccttaccattatcggactgattgcggccaacgaaatgggcctgatcgagaaaacaaagaccgactttgggttctaccaggtgaaaacagagaccacgattctcgatgtcgacctgcgccctgctagcgcctggaccctttatgccgtggctacaaccatcctgacacccatgctcagacacaccatcgaaaatacgtccgccaacctgtctctggcggccattgctaatcaggccgctgtgctcatgggacttggcaaggggtggcccctgcatcggatggatctgggagttcctctcctggccatgggctgttacagccaggtcaacccgacaacccttacagcgtccctggtgatgctcctggtgcactatgccatcattggccccgggctgcaagctaaagccaccagagaggctcagaagcgcaccgccgctggaatcatgaagaatcctacagtcgacggcattacggttatcgatctcgaacccatcagctacgaccctaaatttgagaagcagcttgggcaagtgatgctgctggtgctctgcgccggacagctgcttctgatgcggaccacatgggcgttctgtgaggtcctcaccctggccacaggccccattctgaccctctgggaagggaaccctggaagattctggaacacgacaatcgctgtgtctaccgccaatatttttcgcggctcctatcttgctggcgccgggctggccttcagcctgatcaaaaacgcgcagaccccgcggagaggaacaggcaccacaggggagacgctcggagaaaagtggaaacgccagctcaattctcttgaccggaaggagtttgaagagtacaagagatccggcattctggaggttgatcgcaccgaagctaaaagcgccctcaaggacgggtctaaaacaaagcatgctgtgagccggggatcctctaaaatcagatggatcgtcgagcgcggcatggtgaagcccaagggcaaagttgtggatctggggtgcggacggggcgggtggagctactatatggccaccctgaagaacgtcacagaagtgaaaggatacaccaagggcgggcctggacacgaggaacccattcctatggccacgtatggctggaatctcgtgaaacttcattccggcgtcgacgttttctacaagcccaccgagcaagtggatacactgctgtgtgacatcggggagagctcctctaacccgaccattgaagagggaagaacactccgcgtgctgaagatggtcgaaccttggcttagctccaaacccgagttttgcatcaaggtgctgaatccctatatgcctaccgttattgaagaactggagaaactgcagagaaagcacggcgggaacctggtgcggtgtcccctctctcgcaatagcacacacgaaatgtactgggtctccggagcttctggcaacatcgtgagctccgttaataccacgagcaaaatgcttctgaacagattcacaacccggcatagaaagcctacctatgagaaagatgtggacctgggggccggaacacggtctgtctccacggaaaccgagaagccggatatgacaattatcggccgcagactccagcggctgcaggaggaacacaaggagacctggcattacgaccaagaaaatccctaccgcacatgggcgtatcacggcagctacgaggccccttctaccgggtccgctagctctatggtgaacggagttgtgaaacttctgacaaagccctgggatgtcatccctatggtgacccagctcgccatgacggacaccacaccctttggccagcagagagtcttcaaagaaaaggtggacacccggacaccgcaacctaaacccgggacccgcatgattatgacgacaaccgctaattggctgtgggccctgctcggaaagaagaaaaaccctagactgtgcacacgggaggagtttatctccaaggttcgcagcaatgcggccattggcgctgtgttccaggaggaacaggggtggacctccgccagcgaagctgtcaacgattctagattttgggagcttgtggacaaagaacgggccctgcaccaagagggcaagtgtgagagctgcgtgtataacatgatgggaaaacgcgaaaagaagctcggcgagttcgggagagctaaaggatcccgggccatctggtacatgtggctgggcgcgcgctttcttgagttcgaggccctggggttcctcaatgaagatcattggtttggaagagagaactcttggagcggcgttgagggggaaggcctgcaccggctgggatatattctcgaggaaatcgacaagaaagatggcgacctgatgtacgctgatgacacggccgggtgggataccagaatcacagaggacgatcttcagaatgaggaactgattaccgagcagatggctccccatcacaagatcctcgccaaagccattttcaagctgacatatcagaacaaggtggtcaaagtgcttcgccctacaccccggggagcggttatggacatcatttccagaaaggatcaacgcggctctggacaggtgggaacatacggcctgaatacctttacgaacatggaagtccagctcatccggcagatggaggctgaaggggtgatcacacaagacgacatgcagaatccgaaaggcctgaaggagagagtcgagaaatggctgcgcgaatgcggagtggatcggctcaagagaatggccattagcggcgacgattgtgttgtgaaacctctggacgagcgcttcgggacctcccttctgtttctcaacgatatgggaaaggtccggaaggacatcccccagtgggaaccctctaaaggctggaagaattggcaggaggtgcctttctgcagccatcactttcacaaaattttcatgaaggatgggagatccctggttgtgccgtgtcgcaaccaagacgaacttatcggacgggccagaattagccagggcgctgggtggtctctgcgggagaccgcctgcctcggcaaggcttacgcccagatgtggtccctgatgtattttcatagacgcgatctgcggctcgcgagcatggccatctgttctgctgtccccacagagtggttccctacctccagaacaacgtggagcatccacgcccatcaccagtggatgaccacagaagacatgctgaaggtgtggaatcgcgtgtggattgaggataaccccaatatgaccgacaagacacctatccactcctgggaagacattccctaccttggaaaaagagaggatctgtggtgcggctctctcatcgggctgagctcccgggctacctgggccaagaacattcatacggcgatcacccaagttcgcaatcttattggaaaagaagagtatgtcgactacatgcctgtgatgaagagatatagcgccccctctgagtccgaaggcgtgctgtga

SEQ ID NO: 20976 - RNA, 9867 nt, synthetic construct
  misc_feature 1..9867: note = derived and/or modified CDS sequence (opt5) from DENV-4__GQ199880__SS-prME
  source 1..9867: mol_type = other RNA
agcaccatcaccctgctttgcctgattcccacggtgatggccttccacctttccacccgggacggagagcctctgatgatcgtcgctaagcatgaacgggggcgcccgctcctgtttaagaccaccgagggaattaacaagtgtacccttatcgccatggatctgggcgaaatgtgcgaggacaccgttacatacaagtgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggatccttagaaatcctggcttcgctctgctcgccggctttatggcttacatgatcgggcagacaggcattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctagcatttctaatatcaccacagccacccgctgcccgacgcaaggagagccctatcttaaggaggaacaggaccagcagtacatttgtagacgggatgtggtggaccgcggctgggggaacggatgcggcctgttcgggaaaggaggcgtcgtgacatgcgcgaagttttcctgtagcggcaaaatcaccgggaatctcgttcaaattgagaacctggaatataccgtggtcgtgacagttcataatggagatacccacgccgtgggcaacgacacatctaatcacggggtcacggctaccatcacacctagatcccccagcgtggaggtcaaacttcctgattacggagaactgaccctcgactgcgagccccggtctggcatcgacttcaacgagatgattctgatgaagatgaaaaagaaaacatggctggtgcataagcagtggtttctcgatctgccgcttccttggaccgccggggctgacacgtccgaagttcactggaattacaaagagagaatggtgaccttcaaggtcccccatgccaaacgccaggatgtgacagttctgggcagccaggaaggagccatgcactccgctctcgcgggcgccaccgaggtggactctggggatggaaaccacatgtttgctggccatctgaagtgtaaggtccggatggaaaaacttagaatcaaggggatgagctatacaatgtgctccggaaaattcagcattgacaaggagatggccgagacccaacacggcacgacagtggtgaaagttaagtacgaaggggccggcgctccttgtaaggtccccatcgagattcgcgatgtgaataaagaaaaggtggtcggacgggtgatctcttccacacccctggccgagaacacaaacagcgttaccaatatcgagctcgaacctccgttcggcgactcttatattgtgatcggggtcggaaacagcgcgctgaccctgcattggtttagaaaaggctcctctattgggaagatgttcgagagcacataccgcggagctaaacggatggccatcctcggcgaaacggcctgggattttgggtccgtgggcggactgttcaccagccttggcaaggctgttcaccaggtgtttgggtctgtctatacaaccatgttcggaggcgtgtcctggatgattagaatcctgatcgggtttctcgttctgtggattggaacaaatagccgcaacacctctatggccatgacgtgcatcgctgtgggcgggattacactgttccttggctttaccgtccaggccgacatgggatgtgtggtgtcctggagcggccgggagctcaagtgcgggtccggaatcttcgtcgttgataatgtgcatacctggacagaacaatacaaatttcagcccgagtctcctgcgagactggccagcgctattctgaacgcccacaaggacggcgtgtgtgggatccgctccaccacacggctcgagaatgtcatgtggaaacagattacgaacgaactgaattatgtgctttgggagggaggccacgacctgaccgttgtggctggcgatgtcaagggggtgctcacaaaaggaaagagagccctgacaccccctgtttctgacctgaagtacagctggaaaacatggggcaaggcgaaaatcttcacccccgaagcccggaactccacgtttcttatcgatgggccggacaccagcgagtgccctaatgaacgcagagcttggaactctctcgaggtggaggattacggattcggcatgttcacaaccaatatttggatgaagtttcgggaagggtccagcgaggtctgtgaccatagactgatgtctgccgctatcaaagatcagaaggccgtgcacgccgacatgggatattggattgaatccagcaaaaaccaaacatggcagatcgagaaggcttctctgattgaagttaagacctgcctctggcccaaaacacataccctgtggagcaatggcgtgcttgagtcccagatgctgatccctaagagctacgcgggccccttctctcagcacaactatcgccaagggtacgccacgcagacagtcggaccttggcacctcggcaaactggagatcgattttggggaatgccccggaaccaccgtgacaattcaggaggactgtgatcatcggggcccgtccctgagaaccacgacagctagcgggaaacttgtgacccagtggtgctgtcgctcctgcacaatgcctcccctcagattcctgggagaagacggctgttggtatggcatggagatccggcccctgaacgagaaagaagagaatatggtcaagtctcaagttaccgccgggcagggaacaagcgaaaccttttccatgggcctcctgtgccttacgctgttcgtggaggaatgtctccgcagacgggtgacccgcaagcacatgattctggtcgtggttatcacactgtgcgccattatccttgggggactcacctggatggatctgctgagagctctcatcatgctgggcgacacaatgtctgggcggattggaggccagatccatcttgccattatggcggtgtttaaaatgagccctggctacgtcctgggggtgttcctccgcaagctgacctccagagagacggctctgatggttatcggaatggccatgacaaccgtgctttctattccgcacgacctgatggagctcatcgatggcatcagcctggggctcattctgcttaaaatcgtcacacagtttgacaacacccaagtgggaaccctggccctctccctgacattcattcggagcacgatgcccctggtcatggcttggcgcaccatcatggccgtgctttttgttgtgacactgattcctctctgtagaacctcttgcctgcagaagcagtcccattgggtcgaaatcacagcgctcattctgggcgctcaagcccttcccgtgtatctgatgaccctcatgaaaggggccagccggagatcttggcctctgaatgagggaatcatggctgttggcctggtgtcccttctgggcagcgccctcctgaagaacgatgtccccctcgctgggcctatggtggccggaggcctgcttctggcggcctacgtgatgtctgggtccagcgctgacctgtccctcgaaaaggccgctaatgttcagtgggatgagatggccgacatcacgggaagctctcccattatcgaagtcaaacaggatgaggacggcagcttctccattcgcgatgtggaggaaacaaacatgatcaccctgcttgtgaagctggccctcattaccgtctctgggctgtacccgctcgctatccctgtgacaatgaccctgtggtatatgtggcaggttaaaacacaacggagcggagcgctttgggacgtgccctcccctgccgctacgcagaaggccgccctgtctgagggcgtctacagaatcatgcagcgcggcctgtttgggaaaacccaggtgggagttggcattcacatggaaggggtgttccacacaatgtggcatgtcacccggggaagcgtgatctgtcacgagacaggcagactcgaaccctcctgggctgatgttcgcaatgacatgatttcttatgggggaggctggcggctgggcgataagtgggacaaggaggaggacgtgcaagtccttgccatcgaaccggggaaaaaccctaagcatgtgcagaccaaacccggactgttcaagacgctcaccggcgagattggggcggtgacactggattttaaacctggaaccagcggctcccccatcatcaatagaaaggggaaagtcattggcctctacggaaacggcgttgtgacaaagagcggggactatgtgtctgctatcacccaggccgaacgcattggagagcccgattacgaggtcgacgaagatatcttccggaagaaaagactgacaattatggaccttcaccctggcgccgggaagacgaaacggatcctgccgtccattgtgcgcgaggctctgaagagacggctccgcaccctgatccttgcccccacaagagttgtggcggctgaaatggaggaagccctgcggggactccctatcagatatcagacccccgccgtcaaaagcgagcataccggccgcgagattgtggatctgatgtgccacgctacatttacgacccggctcctgtcttccacaagagttcctaattacaaccttatcgtgatggacgaagcccacttcaccgatcccagctccgtcgctgcccgcgggtacatttctacacgggtggagatgggcgaagcggccgctatctttatgaccgccacgcctccgggagctacagaccccttccctcaaagcaattcccccattgaggatatcgaaagagagatccctgagcgcagctggaacaccggctttgactggattaccgactatcaggggaagacagtctggttcgtgccctctatcaaggccggaaatgatattgccaactgcctgcggaaatccggcaagaaagttatccagctgagcagaaagacctttgacacagaatacccgaaaaccaagctcacggattgggacttcgtggtgacaaccgatatttctgagatgggggctaactttcgcgcgggaagagtcatcgaccctcggcgctgtctgaagcccgttatccttacagatggccccgaaagagtgattctggccgggcctatccccgtgacccctgctagcgccgcccaacggcgcggcagaattggacggaatccggctcaggaggacgatcagtatgtcttctccggcgaccccctcaaaaacgatgaagaccatgcccactggacggaggcgaagatgctgctggataatatctacacccctgaggggattatccccacactcttcggacctgaaagagagaaaacccaggctattgacggcgaatttcgccttagaggggaacaaagaaagacattcgtggagctgatgcgccggggagacctgcccgtttggctctcttataaagtggccagcgccggcatctcctacaaggatagagaatggtgctttaccggcgagcggaacaatcagatcctggaagagaacatggaagtcgagatttggacacgcgagggggaaaagaagaaacttagaccgcggtggctggacgctcgcgtgtatgccgatcctatggcgctcaaagacttcaaagagtttgcctctggaagaaaaagcatcaccctggatattctgacggaaatcgcttccctccccacataccttagctctcgggccaagctggctctggacaatattgtcatgctccataccaccgagcgcggcgggagagcctaccagcacgctctgaacgaacttcctgagtccctggagacactcatgctggtggccctgctcggagcgatgaccgccggcatcttcctctttttcatgcaggggaagggaatcggcaaactgagcatgggcctgattgctatcgccgttgcttccgggctcctgtgggtggccgaaattcaaccccagtggatcgccgcttctattatccttgagtttttcctgatggtcctcctgatccctgaacccgagaagcagcggacaccgcaggataatcaactgatttatgtgatcctcacgattcttaccatcattggactgatcgcggccaacgaaatgggcctgattgagaaaacaaagaccgactttgggttctaccaggttaaaacagagaccacgatcctcgatgtggacctgcgccctgctagcgcctggaccctttatgccgtcgctacaaccatcctgacacccatgctcagacacaccattgaaaatacgtccgccaacctgtctctggcggccatcgctaatcaggccgctgtgctcatgggacttggcaaggggtggcccctgcatcggatggatctgggagtgcctctcctggccatgggctgttacagccaggttaacccgacaacccttacagcgtccctggtcatgctcctggtgcactatgccattatcggccccgggctgcaagctaaagccaccagagaggctcagaagcgcaccgccgctggaattatgaagaatcctacagtggacggcatcacggtcatcgatctcgaacccattagctacgaccctaaatttgagaagcagcttgggcaagttatgctgctggtgctctgcgccggacagctgcttctgatgcggaccacatgggcgttctgtgaggtgctcaccctggccacaggccccatcctgaccctctgggaagggaaccctggaagattctggaacacgacaattgctgtctctaccgccaatatctttcgcggctcctatcttgctggcgccgggctggccttcagcctgattaaaaacgcgcagaccccgcggagaggaacaggcaccacaggggagacgctcggagaaaagtggaaacgccagctcaattctcttgaccggaaggagtttgaagagtacaagagatccggcatcctggaggtggatcgcaccgaagctaaaagcgccctcaaggacgggtctaaaacaaagcatgctgttagccggggatcctctaaaatcagatggattgtggagcgcggcatggtcaagcccaagggcaaagtggttgatctggggtgcggacggggcgggtggagctactatatggccaccctgaagaacgtgacagaagtcaaaggatacaccaagggcgggcctggacacgaggaacccatccctatggccacgtatggctggaatctcgtgaaacttcattccggcgtggacgtcttctacaagcccaccgagcaagttgatacactgctgtgtgacattggggagagctcctctaacccgaccatcgaagagggaagaacactccgcgtgctgaagatggtggaaccttggcttagctccaaacccgagttttgcattaaggtcctgaatccctatatgcctaccgtgatcgaagaactggagaaactgcagagaaagcacggcgggaacctggttcggtgtcccctctctcgcaatagcacacacgaaatgtactgggtgtccggagcttctggcaacattgtcagctccgtgaataccacgagcaaaatgcttctgaacagattcacaacccggcatagaaagcctacctatgagaaagatgttgacctgggggccggaacacggtctgtgtccacggaaaccgagaagccggatatgacaatcatcggccgcagactccagcggctgcaggaggaacacaaggagacctggcattacgaccaagaaaatccctaccgcacatgggcgtatcacggcagctacgaggccccttctaccgggtccgctagctctatggtcaacggagtggttaaacttctgacaaagccctgggatgtgattcctatggtcacccagctcgccatgacggacaccacaccctttggccagcagagagtgttcaaagaaaaggtcgacacccggacaccgcaacctaaacccgggacccgcatgatcatgacgacaaccgctaattggctgtgggccctgctcggaaagaagaaaaaccctagactgtgcacacgggaggagtttatttccaaggtgcgcagcaatgcggccatcggcgctgttttccaggaggagcaggggtggacctccgccagcgaagctgtgaacgattctagattttgggagcttgtcgacaaagaacgggccctgcaccaagagggcaagtgtgagagctgcgtgtataacatgatgggaaaacgcgaaaagaagctcggcgagttcgggagagctaaaggatcccgggccatttggtacatgtggctgggcgcgcgctttcttgagttcgaggccctggggttcctcaatgaagatcattggtttggaagagagaactcttggagcggcgtggagggggaaggcctgcaccggctgggatatatcctcgaggaaatcgacaagaaagatggcgacctgatgtacgctgatgacacggccgggtgggataccagaattacagaggacgatcttcagaatgaggaactgatcaccgagcagatggctccccatcacaagattctcgccaaagccatcttcaagctgacatatcagaacaaggttgtgaaagtccttcgccctacaccccggggagcggtgatggacattatctccagaaaggatcaacgcggctctgggcaggttggaacatacggcctgaatacctttacgaacatggaagtgcagctcatccggcagatggaggctgaaggggtcattacacaagacgacatgcagaatccgaaaggcctgaaggagagagtggagaaatggctgcgcgaatgcggagtcgatcggctcaagagaatggccatcagcggcgacgattgtgtggttaaacctctggacgagcgcttcgggacctcccttctgtttctcaacgatatgggaaaggtgcggaaggacattccccagtgggaaccctctaaaggctggaagaattggcaggaggtccctttctgcagccatcactttcacaaaatcttcatgaaggatgggagatccctggtggttccgtgtcgcaaccaagacgaacttattggacgggccagaatcagccagggcgctgggtggtctctgcgggagaccgcctgcctcggcaaggcttacgcccagatgtggtccctgatgtattttcatagacgcgatctgcggctcgcgagcatggccatctgttctgctgtgcccacagagtggttccctacctccagaacaacgtggagcattcacgcccatcaccagtggatgaccacagaagacatgctgaaggtctggaatcgcgtgtggatcgaggataaccccaatatgaccgacaagacacctattcactcctgggaagacatcccctaccttggaaaaagagaggatctgtggtgcggctctctcattgggctgagctcccgggctacctgggccaagaacatccatacggcgattacccaagtgcgcaatcttatcggaaaagaagagtatgttgactacatgcctgtcatgaagagatatagcgccccctctgagtccgaaggcgtgctgtga

SEQ ID NO: 20977 - RNA, 9867 nt, synthetic construct
  misc_feature 1..9867: note = derived and/or modified CDS sequence (opt5) from DENV-4__GQ252675__SS-prME
  source 1..9867: mol_type = other RNA
agcaccatcacactgctctgcctgattcccacggtgatggccttccacctttccaccagagacggcgagcctctgatgatcgtcgctaagcatgaacgggggcgcccgctcctgtttaaaacaaccgagggaattaacaagtgtacacttatcgccatggatctgggcgaaatgtgcgaggacaccgttacatacaaatgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggatccttagaaatcctggcttcgctctgctcgccggctttatggcttacatgatcgggcagacaggaattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctagcatttctaatatcaccacagccacccgctgcccgacgcaaggagagccctatcttaaggaggaacaggaccagcagtacatttgtagacgggatgtggtggaccgcggctgggggaacggatgcggcctgttcgggaaaggaggcgtcgtgacatgcgcgaagttttcctgtagcggcaaaatcaccgggaatctcgttcaaattgagaacctggaatataccgtggtcgtgacagttcataatggagatacccacgccgtgggcaacgacacatctaatcacggggtcacggctaccatcacacctagatcccccagcgtggaggtcaagcttcctgattacggagaactgaccctcgactgcgagccccggtctggcatcgacttcaacgagatgattctgatgaagatgaaaaagaaaacatggctggtgcataagcagtggtttctcgatctgccgcttccttggaccgccggggctgacacgtccgaagttcactggaattacaaagagagaatggtgaccttcaaggtcccccatgccaaacgccaggatgtgacagttctgggcagccaggaaggagccatgcactccgctctcgcgggcgccaccgaggtggactctggggatggaaaccacatgtttgctggccatctgaagtgtaagatccggatggaaaaacttagaattaaggggatgagctatacaatgtgctccggaaaattcagcatcgacaaggagatggccgagacccaacacggcacgacagtcgtgaaagtgaagtacgaaggggccggcgctccttgtaaggttcccattgagatccgcgatgtcaataaagaaaaggtggtgggacgggtcatctcttccacccccctggccgagaacacaaacagcgtgaccaatattgagctcgaacctccgttcggcgactcttatatcgttattggggtgggaaacagcgcgctgaccctgcattggtttagaaaaggctcctctatcgggaagatgttcgagagcacataccgcggagctaaacggatggccattctcggcgaaacggcctgggattttgggtccgtcggcggactgttcaccagccttggcaaggctgtgcaccaggtttttgggtctgtgtatacaaccatgttcggaggcgtctcctggatgatcagaatcctgattgggtttctcgtgctgtggatcggaacaaatagccgcaacacctctatggccatgacgtgcattgctgttggcgggatcacactgttccttggctttaccgtgcaggccgacatgggatgtgtcgtgtcctggagcggccgggagctcaagtgcgggtccggaattttcgtggtcgataatgttcatacctggacagaacaatacaaatttcagcccgagtctcctgcgagactggccagcgctatcctgaacgcccacaaggacggcgtgtgtgggattcgctccaccacacggctcgagaatgtgatgtggaaacagatcacgaacgaactgaattatgtcctttgggagggaggccacgacctgaccgtggttgctggcgatgtgaagggggtcctcacaaaaggaaagagagccctgaccccccctgtgtctgacctgaagtacagctggaaaacatggggcaaggcgaaaatcttcacccccgaagcccggaactccacgtttcttattgatgggccggacaccagcgagtgccctaatgaacgcagagcttggaactctctcgaggttgaggattacggattcggcatgttcacaaccaatatctggatgaagtttcgggaagggtccagcgaggtgtgtgaccatagactgatgtctgccgctattaaagatcagaaggccgtccacgccgacatgggatattggatcgaatccagcaaaaaccaaacatggcagattgagaaggcttctctgatcgaagtgaagacctgcctctggcccaaaacacataccctgtggagcaatggcgttcttgagtcccagatgctgatccctaagagctacgcgggccccttctctcagcacaactatcgccaagggtacgccacgcagacagtgggaccttggcacctcggcaaactggagattgattttggggaatgccccggaaccaccgtcacaatccaggaggactgtgatcatcggggcccgtccctgagaaccacgacagctagcgggaagcttgtgacccagtggtgctgtcgctcctgcacaatgcctcccctcagattcctgggagaagacggctgttggtatggcatggagattcggcccctgaacgagaaagaagagaatatggtgaagtctcaagtcaccgccgggcagggaacaagcgaaaccttttccatgggcctcctgtgccttacgctgttcgttgaggaatgtctccgcagacgggtgacccgcaagcacatgatgctggtggtcgtgatcacactgtgcgccattatccttgggggactcacctggatggatctgctgagagctctcatcatgctgggcgacacaatgtctgggcggattggaggccagatccatcttgccattatggcggtttttaaaatgagccctggctacgtgctgggggtcttcctccgcaagctgacctccagagagacggctctgatggtgatcggaatggccatgacaaccgttctttctattccgcacgacctgatggagctcatcgatggcatcagcctggggctcattctgcttaaaacagtgacccagtttgacaacacccaagtcggaacactggccctctccctgacgttcatccggagcaccatgcccctggtgatggcttggcgcacaattatggccgtcctttttgtggttaccctgatccctctctgtagaacatcttgcctgcagaagcagtcccattgggtggaaattaccgcgctcatcctgggcgctcaagcccttcccgtctatctgatgacgctcatgaaaggggccagccggagatcttggcctctgaatgagggaattatggctgtgggcctggtttcccttctgggcagcgccctcctgaagaacgatgtgcccctcgctgggcctatggtcgccggaggcctgcttctggcggcctacgtgatgtctgggtccagcgctgacctgtccctcgaaaaggccgctaatgtgcagtgggatgagatggccgacatcacaggaagctctcccatcattgaagttaaacaggatgaggacggcagcttctccatccgcgatgtcgaggaaaccaacatgattaccctgcttgtgaagctggccctcatcacagtgtctgggctgtacccgctcgctattcctgtcaccatgacactgtggtatatgtggcaggtgaaaacgcaacggagcggagcgctttgggacgttccctcccctgccgctacccagaaggccgccctgtctgagggcgtgtacagaatcatgcagcgcggcctgtttgggaaaacacaggtcggagtgggcatccacatggaaggggttttccacaccatgtggcatgtgacacggggaagcgtcatttgtcacgagaccggcagactcgaaccctcctgggctgatgtgcgcaatgacatgatctcttatgggggaggctggcggctgggcgataagtgggacaaggaggaggacgttcaagtgcttgccattgaaccggggaaaaaccctaagcatgtccagacgaaacccggactgttcaagaccctcacaggcgagatcggggcggtgaccctggattttaaacctggaacaagcggctcccccattatcaataagaaagggaaggtgatcggcctctacggaaacggcgtcgttaccaagagcggggactatgtgtctgctattacacaggccgaaagaatcggagagcccgattacgaggtggacgaagatattttccgcaaaaagcggctgacgatcatggaccttcaccctggcgccgggaaaaccaagagaattctgccgtccatcgtccgggaggctctgaaacgcagactccggacactgattcttgcccccacccgcgtggttgcggctgaaatggaggaagccctgagaggactccctatccggtatcagacccccgccgtgaagagcgagcatacaggcagagagatcgtcgatctgatgtgccacgctacgtttaccacacgcctcctgtcttccacccgggtgcctaattacaaccttattgttatggacgaagcccacttcacagatcccagctccgtggctgccagagggtacatctctacccgcgtcgagatgggcgaagcggccgctatttttatgacggccacacctccgggagctaccgaccccttccctcaaagcaattcccccatcgaggatattgaacgggagatccctgagagaagctggaacaccggctttgactggatcacagactatcaggggaagaccgtgtggttcgtcccctctattaaagccggaaatgatatcgccaactgcctgcgcaagtccggcaaaaaggtgattcagctgagccggaaaacatttgacaccgaatacccgaagacgaagctcacagattgggacttcgttgtgaccacagatatctctgagatgggggctaactttagagcgggacgcgtgattgaccctagacggtgtctgaaacccgtcatccttaccgatggccccgaacgcgttatcctggccgggcctattcccgtgacgcctgctagcgccgcccaaagacggggccgcatcggaagaaatccggctcaggaggacgatcagtatgtgttctccggcgaccccctcaagaacgatgaagaccatgcccactggaccgaggcgaaaatgctgctggataatatttacacacctgaggggatcattcccaccctcttcggacctgaacgggagaagacacaggctatcgacggcgaatttagacttcgcggggagcaacggaaaaccttcgtcgagctgatgagacgcggagacctgcccgtgtggctctcttataaggttgccagcgccggcatttcctacaaggatcgggaatggtgctttacaggcgagagaaacaatcagatcctggaagagaacatggaagtggagatctggacccgggagggggaaaaaaagaaacttcgcccgagatggctggacgctcgggtctatgccgatcctatggcgctcaaggacttcaaagagtttgcctctggacgcaagagcattacgctggatatcctgacagaaattgcttccctccccacctaccttagctctagagccaagctggctctggacaatatcgtgatgctccataccacagagcggggcgggcgcgcctaccagcacgctctgaacgaacttcctgagtccctggagaccctcatgctggtcgccctgctcggagcgatgacagccggcattttcctttttttcatgcaggggaaaggaatcggcaagctgagcatgggcctgatcgctattgccgtggcttccgggctcctgtgggttgccgaaatccaaccccagtggattgccgcttctatcattcttgagtttttcctgatggtgctcctgatccctgaacccgagaaacagagaacgccgcaggataatcaactgatctatgtcattctcaccatccttacaattatcggactgattgcggccaacgaaatgggcctgatcgagaagaccaaaacagactttgggttctaccaggtgaagaccgagacgaccattctcgatgttgacctgcggcctgctagcgcctggacactttatgccgtggctaccacaatcctgacccccatgctccgccacacgatcgaaaatacatccgccaacctgtctctggcggccattgctaatcaggccgctgtcctcatgggacttggcaaagggtggcccctgcatagaatggatctgggagtgcctctcctggccatgggctgttacagccaggtgaacccgaccacacttaccgcgtccctggttatgctcctggtccactatgccatcattggccccgggctgcaagctaaggccacccgggaggctcagaagagaacagccgctggaatcatgaaaaatcctacggtggacggcattaccgtgatcgatctcgaacccatcagctacgaccctaagtttgagaaacagcttgggcaagtcatgctgctggttctctgcgccggacagctgcttctgatgcgcacaacctgggcgttctgtgaggtgctcacactggccaccggccccattctgacgctctgggaagggaaccctggacggttctggaacacaaccatcgctgtgtctaccgccaatatttttagaggctcctatcttgctggcgccgggctggccttcagcctgatcaagaacgcgcagacaccgcgccggggaaccggcacaacgggggagaccctcggagaaaaatggaagagacagctgaattctcttgaccgcaaggagtttgaagagtacaaacggtccggcattctggaggtcgatagaacagaagctaagagcgccctcaaagacgggtctaagaccaaacatgctgtgagccgcggatcctctaagatccggtggatcgttgagagaggcatggtgaagcccaaaggcaaggtcgtggatctggggtgcggacgcggcgggtggagctactatatggccacactgaaaaacgttaccgaagtgaagggatacacgaaaggcgggcctggacacgaggaacccattcctatggccacctatggctggaatctcgtcaagcttcattccggcgtggacgtgttctacaagcccacagagcaagtcgataccctgctgtgtgacatcggggagagctcctctaacccgacaattgaagagggacggaccctcagagttctgaaaatggtggaaccttggcttagctccaagcccgagttttgcatcaaagtgctgaatccctatatgcctacagtcattgaagagctcgagaagctgcagcgcaaacacggcgggaacctggtgagatgtcccctctctcggaatagcacccacgaaatgtactgggtttccggagcttctggcaacatcgtgagctccgtcaatacgacaagcaagatgcttctgaaccgcttcaccaccagacatcggaaacctacatatgagaaggatgtggacctgggggccggaacgagatctgtttccaccgaaacagagaagccggatatgaccattatcggccggcgcctccagagactgcaggaggaacacaaagagacatggcattacgaccaagaaaatccctaccggacctgggcgtatcacggcagctacgaggccccttctacagggtccgctagctctatggtgaacggagtcgtgaagcttctgaccaaaccctgggatgttatccctatggtgacgcagctcgccatgaccgacacaaccccctttggccagcagcgcgtcttcaaggaaaaagtggacacaagaaccccgcaacctaagcccgggacgcggatgattatgacaaccacagctaattggctgtgggccctgctcggaaagaaaaagaaccctcgcctgtgcaccagagaggagtttatctccaaagtccggagcaatgcggccattggcgctgtgttccaggaagagcaggggtggacgtccgccagcgaagctgttaacgattctcgcttttgggagcttgtggacaaggaaagagccctgcaccaagagggcaaatgtgagagctgcgtctataacatgatgggaaagcgggaaaagaaactcggcgagttcgggcgcgctaagggatccagagccatctggtacatgtggctgggcgcgcggtttcttgaattcgaggccctggggttcctcaatgaagatcattggtttggacgcgagaactcttggagcggcgtggagggggaaggcctgcacagactgggatatattctcgaggaaatcgacaaaaaggatggcgacctgatgtacgctgatgacaccgccgggtgggatacacggatcaccgaggacgatcttcagaatgaggaactgattacagagcagatggctccccatcacaaaatcctcgccaaggccattttcaagctgacctatcagaacaaagtggttaaggtgcttagacctacaccccgcggagcggtcatggacatcatttcccggaaagatcaaagaggctctgggcaggtgggaacctacggcctgaatacgtttacaaacatggaagttcagctcatccgccagatggaggctgaaggggtgatcacccaagacgacatgcagaatccgaagggcctgaaagagcgggtcgagaagtggctgagagaatgcggagtggatcgcctcaaacggatggccattagcggcgacgattgtgtcgtgaagcctctggacgagagattcgggacctcccttctgtttctcaacgatatgggaaaggttcgcaaagacatcccccagtgggaaccctctaagggctggaaaaattggcaggaggtgcctttctgcagccatcactttcacaagattttcatgaaagatgggcggtccctggtcgtgccgtgtagaaaccaagacgaacttatcggacgcgcccggattagccagggcgctgggtggtctctgagagagacagcctgcctcggcaaggcttacgcccagatgtggtccctgatgtattttcatcggagagatctgcgcctcgcgagcatggccatctgttctgctgttcccaccgagtggttccctacatcccggacgacctggagcatccacgcccatcaccagtggatgacaaccgaagacatgctgaaggtgtggaatagagtctggattgaggataaccccaatatgacagacaaaacccctatccactcctgggaagacattccctaccttggaaagcgcgaggatctgtggtgcggctctctcatcgggctgagctccagagctacgtgggccaaaaacattcataccgcgatcacacaagtgcggaatcttattggaaaggaagagtatgtggactacatgcctgttatgaaacgctatagcgccccctctgagtccgaaggcgtcctgtga

SEQ ID NO: 20978 - RNA, 9867 nt, synthetic construct
  misc_feature 1..9867: note = derived and/or modified CDS sequence (opt5) from DENV-4__FJ810417__SS-prME
  source 1..9867: mol_type = other RNA
agcacaatcacgctgctttgcctgattcccacggtgatggccttccacctttccacccgggacggagagcctctgatgatcgtcgctaagcatgaacgggggcgcccgctcctgtttaagacaaccgagggaattaacaagtgtacacttatcgccatggatctgggcgaaatgtgcgaggacaccgttacatacaagtgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggatccttagaaatcctggcttcgctctgctcgccggctttatggcttacatgatcgggcagacaggcattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctagcatttctaatatcaccacagccacccgctgcccgacgcaaggagagccctatcttaaggaggaacaggaccagcagtacatttgtagacgggatgtggtggaccgcggctgggggaacggatgcggcctgttcgggaaaggaggcgtcgtgacatgcgcgaagttttcctgtagcggcaaaatcaccgggaatctcgttcaaattgagaacctggaatataccgtggtcgtgacagttcataatggagatacccacgccgtgggcaacgacacatctaatcacggggtcacggctaccatcacacctagatcccccagcgtggaggtcaaacttcctgattacggagaactgaccctcgactgcgagccccggtctggcatcgacttcaacgagatgattctgatgaagatgaaaaagaaaacatggctggtgcataagcagtggtttctcgatctgccgcttccttggaccgccggggctgacacgtccgaagttcactggaattacaaagagagaatggtgaccttcaaggtcccccatgccaaacgccaggatgtgacagttctgggcagccaggaaggagccatgcactccgctctcgcgggcgccaccgaggtggactctggggatggaaaccacatgtttgctggccatctgaagtgtaaggtccggatggaaaaacttagaatcaaggggatgagctatacaatgtgctccggaaaattcagcattgacaaggagatggccgagacccaacacggcacgacagtggtgaaagttaagtacgaaggggccggcgctccttgtaaggtccccatcgagattcgcgatgtgaataaagaaaaggtggtcggacgggtgatctcttccatccccctggccgagaacaccaacagcgttacaaatattgagctcgaacctccgttcggcgactcttatatcgtgattggggtcggaaacagcgcgctgaccctgcattggtttagaaaaggctcctctatcgggaagatgttcgagagcacctaccgcggagctaaacggatggccattctcggcgaaacagcctgggattttgggtccgtgggcggactgttcacgagccttggcaaggctgttcaccaggtgtttgggtctgtctataccacaatgttcggaggcgtgtcctggatgatcagaatcctgattgggtttctcgttctgtggatcggaaccaatagccgcaacacatctatggccatgacctgcattgctgtgggcgggatcacgctgttccttggctttacagtccaggccgacatgggatgtgtggtgtcctggagcggccgggagctcaagtgcgggtccggaattttcgtcgttgataatgtgcatacctggaccgaacaatacaaatttcagcccgagtctcctgcgagactggccagcgctatcctgaacgcccacaaggacggcgtgtgtgggattcgctccacaacccggctcgagaatgtcatgtggaaacagatcacaaacgaactgaattatgtgctttgggagggaggccacgacctgacggttgtggctggcgatgtcaagggggtgctcaccaaaggaaagagagccctgacaccccctgtttctgacctgaagtacagctggaaaacctggggcaaggcgaaaatcttcacacccgaagcccggaactccacctttcttattgatgggccggacacgagcgagtgccctaatgaacgcagagcttggaactctctcgaggtggaggattacggattcggcatgttcaccacaaatatctggatgaagtttcgggaagggtccagcgaggtctgtgaccatagactgatgtctgccgctattaaagatcagaaggccgtgcacgccgacatgggatattggatcgaatccagcaaaaaccaaacctggcagattgagaaggcttctctgatcgaagttaagacatgcctctggcccaaaacccatacactgtggagcaatggcgtgcttgagtcccagatgctgatccctaagagctacgcgggccccttctctcagcacaactatcgccaagggtacgccacccagacggtcggaccttggcacctcggcaaactggagattgattttggggaatgccccggaacaaccgtgaccatccaggaggactgtgatcatcggggcccgtccctgagaacaaccacggctagcgggaaacttgtgacacagtggtgctgtcgctcctgcaccatgcctcccctcagattcctgggagaagacggctgttggtatggcatggagattcggcccctgaacgagaaagaagagaatatggtcaagtctcaagttacagccgggcagggaaccagcgaaacattttccatgggcctcctgtgccttaccctgttcgtggaggaatgtctccgcagacgggtgacgcgcaagcacatgatcctggtcgtggttattaccctgtgcgccatcatccttgggggactcacatggatggatctgctgagagctctcattatgctgggcgacaccatgtctgggcggatcggaggccagattcatcttgccatcatggcggtgtttaaaatgagccctggctacgtcctgggggtgttcctccgcaagctgacatccagagagaccgctctgatggttattggaatggccatgacgacagtgctttctatcccgcacgacctgatggagctcatcgatggcattagcctggggctcatcctgcttaaaattgtcacccagtttgacaacacacaagtgggaaccctggccctctccctgaccttcatccggagcacaatgcccctggtcatggcttggcgcacgattatggccgtgctttttgttgtgaccctgatccctctctgtagaacatcttgcctgcagaagcagtcccattgggtcgaaattaccgcgctcatcctgggcgctcaagcccttcccgtgtatctgatgacactcatgaaaggggccagccggagatcttggcctctgaatgagggaatcatggctgttggcctggtgtcccttctgggcagcgccctcctgaagaacgatgtccccctcgctgggcctatggtggccggaggcctgcttctggcggcctacgtgatgtctgggtccagcgctgacctgtccctcgaaaaggccgctaatgttcagtgggatgagatggccgacattaccggaagctctcccatcattgaagtcaaacaggatgaggacggcagcttctccatccgcgatgtggaggaaacgaacatgattacactgcttgtgaagctggccctcatcaccgtctctgggctgtacccgctcgctatccctgtgaccatgacactgtggtatatgtggcaggttaaaacccaacggagcggagcgctttgggacgtgccctcccctgccgctacacagaaggccgccctgtctgagggcgtctacagaattatgcagcgcggcctgtttgggaaaacacaggtgggagttggcatccacatggaaggggtgttccacaccatgtggcatgtcacacggggaagcgtgatttgtcacgagaccggcagactcgaaccctcctgggctgatgttcgcaatgacatgatctcttatgggggaggctggcggctgggcgataagtgggacaaggaggaggacgtgcaagtccttgccattgaaccggggaaaaaccctaagcatgtgcagacaaaacccggactgttcaagaccctcacgggcgagatcggggcggtgaccctggattttaaacctggaacaagcggctcccccatcattaatagaaaggggaaagtcatcggcctctacggaaacggcgttgtgaccaagagcggggactatgtgtctgctattacacaggccgaacgcatcggagagcccgattacgaggtcgacgaagatattttccggaagaaaagactgaccatcatggaccttcaccctggcgccgggaagacaaaacggattctgccgtccatcgtgcgcgaggctctgaagagacggctccgcacgctgatccttgcccccaccagagttgtggcggctgaaatggaggaagccctgcggggactccctattagatatcagacacccgccgtcaaaagcgagcataccggccgcgagatcgtggatctgatgtgccacgctacctttacaacgcggctcctgtcttccaccagagttcctaattacaaccttattgtgatggacgaagcccacttcacagatcccagctccgtcgctgcccgcgggtacatctctacccgggtggagatgggcgaagcggccgctatttttatgacagccacccctccgggagctacggaccccttccctcaaagcaattcccccatcgaggatatcgaaagagagattcctgagcgcagctggaacacaggctttgactggatcaccgactatcaggggaagaccgtctggttcgtgccctctattaaggccggaaatgatatcgccaactgcctgcggaaatccggcaagaaagttattcagctgagcagaaagacatttgacaccgaatacccgaaaacaaagctcaccgattgggacttcgtggtgacgacagatatctctgagatgggggctaactttcgcgcgggaagagtcatcgaccctcggcgctgtctgaagcccgttattcttaccgatggccccgaaagagtgatcctggccgggcctattcccgtgacccctgctagcgccgcccaacggcgcggcagaatcggacggaatccggctcaggaggacgatcagtatgtcttctccggcgaccccctcaaaaacgatgaagaccatgcccactggaccgaggcgaagatgctgctggataatatttacacgcctgaggggatcattcccaccctcttcggacctgaaagagagaaaacacaggctatcgacggcgaatttcgccttagaggggaacaaagaaagaccttcgtggagctgatgcgccggggagacctgcccgtttggctctcttataaagtggccagcgccggcatctcctacaaggatagagaatggtgctttacaggcgagcggaacaatcagattctggaagagaacatggaagtcgagatctggacccgcgagggggaaaagaagaaacttagaccgcggtggctggacgctcgcgtgtatgccgatcctatggcgctcaaagacttcaaagagtttgcctctggaagaaaaagcattacactggatatcctgaccgaaattgcttccctccccacgtaccttagctctcgggccaagctggctctggacaatatcgtcatgctccatacaaccgagcgcggcgggagagcctaccagcacgctctgaacgaacttcctgagtccctggagaccctcatgctggtggccctgctcggagcgatgacagccggcatcttcctctttttcatgcaggggaagggaattggcaaactgagcatgggcctgatcgctattgccgttgcttccgggctcctgtgggtggccgaaatccaaccccagtggattgccgcttctatcatccttgagtttttcctgatggtcctcctgattcctgaacccgagaagcagcggaccccgcaggataatcaactgatctatgtgattctcacaatccttacgattatcggactgattgcggccaacgaaatgggcctgatcgagaaaaccaagacagactttgggttctaccaggttaaaaccgagacaaccatcctcgatgtggacctgcgccctgctagcgcctggacgctttatgccgtcgctaccacaattctgacccccatgctcagacacacaatcgaaaatacctccgccaacctgtctctggcggccattgctaatcaggccgctgtgctcatgggacttggcaaggggtggcccctgcatcggatggatctgggagtgcctctcctggccatgggctgttacagccaggttaacccgacgacacttaccgcgtccctggtcatgctcctggtgcactatgccatcattggccccgggctgcaagctaaagccacaagagaggctcagaagcgcaccgccgctggaatcatgaagaatcctaccgtggacggcatcacagtcattgatctcgaacccatcagctacgaccctaaatttgagaagcagcttgggcaagttatgctgctggtgctctgcgccggacagctgcttctgatgcggacgacctgggcgttctgtgaggtgctcacactggccaccggccccattctgacactctgggaagggaaccctggaagattctggaacaccacgatcgctgtctctacagccaatatttttcgcggctcctatcttgctggcgccgggctggccttcagcctgatcaaaaacgcgcagaccccgcggagaggaaccggcacaaccggggagacactcggagaaaagtggaaacgccagctcaattctcttgaccggaaggagtttgaagagtacaagagatccggcatcctggaggtggatcgcacggaagctaaaagcgccctcaaggacgggtctaaaaccaagcatgctgttagccggggatcctctaaaattagatggatcgtggagcgcggcatggtcaagcccaagggcaaagtggttgatctggggtgcggacggggcgggtggagctactatatggccacactgaagaacgtgaccgaagtcaaaggatacacaaagggcgggcctggacacgaggaacccattcctatggccacctatggctggaatctcgtgaaacttcattccggcgtggacgtcttctacaagcccacggagcaagttgataccctgctgtgtgacatcggggagagctcctctaacccgacaattgaagagggaagaaccctccgcgtgctgaagatggtggaaccttggcttagctccaaacccgagttttgcatcaaggtcctgaatccctatatgcctacagtgattgaagaactggagaaactgcagagaaagcacggcgggaacctggttcggtgtcccctctctcgcaatagcacccacgaaatgtactgggtgtccggagcttctggcaacatcgtcagctccgtgaatacaaccagcaaaatgcttctgaacagattcacgacacggcatagaaagcctacctatgagaaagatgttgacctgggggccggaacccggtctgtgtccacagaaacggagaagccggatatgaccatcattggccgcagactccagcggctgcaggaggaacacaaggagacatggcattacgaccaagaaaatccctaccgcacctgggcgtatcacggcagctacgaggccccttctacagggtccgctagctctatggtcaacggagtggttaaacttctgaccaagccctgggatgtgatccctatggtcacacagctcgccatgaccgacacgaccccctttggccagcagagagtgttcaaagaaaaggtcgacacacggaccccgcaacctaaacccgggacacgcatgattatgaccacgacagctaattggctgtgggccctgctcggaaagaagaaaaaccctagactgtgcacccgggaggagtttatctccaaggtgcgcagcaatgcggccattggcgctgttttccaggaggagcaggggtggacatccgccagcgaagctgtgaacgattctagattttgggagcttgtcgacaaagaacgggccctgcaccaagagggcaagtgtgagagctgcgtgtataacatgatgggaaaacgcgaaaagaagctcggcgagttcgggagagctaaaggatcccgggccatctggtacatgtggctgggcgcgcgctttcttgagttcgaggccctggggttcctcaatgaagatcattggtttggaagagagaactcttggagcggcgtggagggggaaggcctgcaccggctgggatatatcctcgaggaaattgacaagaaagatggcgacctgatgtacgctgatgacaccgccgggtgggatacgagaatcaccgaggacgatcttcagaatgaggaactgattacagagcagatggctccccatcacaagatcctcgccaaagccattttcaagctgacctatcagaacaaggttgtgaaagtccttcgccctacaccccggggagcggtgatggacatcatctccagaaaggatcaacgcggctctgggcaggttggaacctacggcctgaatacatttaccaacatggaagtgcagctcattcggcagatggaggctgaaggggtcatcacgcaagacgacatgcagaatccgaaaggcctgaaggagagagtggagaaatggctgcgcgaatgcggagtcgatcggctcaagagaatggccattagcggcgacgattgtgtggttaaacctctggacgagcgcttcgggacatcccttctgtttctcaacgatatgggaaaggtgcggaaggacatcccccagtgggaaccctctaaaggctggaagaattggcaggaggtccctttctgcagccatcactttcacaaaattttcatgaaggatgggagatccctggtggttccgtgtcgcaaccaagacgaacttatcggacgggccagaatcagccagggcgctgggtggtctctgcgggagaccgcctgcctcggcaaggcttacgcccagatgtggtccctgatgtattttcatagacgcgatctgcggctcgcgagcatggccatttgttctgctgtgcccaccgagtggttccctacatccagaaccacatggagcatccacgcccatcaccagtggatgacgaccgaagacatgctgaaggtctggaatcgcgtgtggattgaggataaccccaatatgacagacaagacccctatccactcctgggaagacattccctaccttggaaaaagagaggatctgtggtgcggctctctcatcgggctgagctcccgggctacatgggccaagaacattcataccgcgatcacgcaagtgcgcaatcttatcggaaaagaagagtatgttgactacatgcctgtcatgaagagatatagcgccccctctgagtccgaaggcgtgctgtga

SEQ ID NO: 20979 - RNA, 9867 nt, synthetic construct
  misc_feature 1..9867: note = derived and/or modified CDS sequence (opt5) from DENV-4__FJ850057__SS-prME
  source 1..9867: mol_type = other RNA
agcaccatcaccctgctttgcctgattcccacggccatggctttccatctttccacccgggacggagagcctctgatgatcgtggccaagcatgaacgggggcgcccgctcctgtttaagacaaccgaggggattaacaagtgtacccttatcgcgatggatctgggcgaaatgtgcgaggacaccgtcacatacaagtgtcccctcctggttaataccgaacctgaggatattgactgctggtgtaacctgacgtctacctgggtgatgtatgggacatgcacccagagcggagagagacggcgcgaaaagagatccgtggctctcacaccccactctggcatggggctggagacccgggccgaaacgtggatgagctccgagggagcctggaagcatgctcagcgcgtcgagtcttggatccttagaaatcctggcttcgccctgctcgctggctttatggcctacatgatcgggcagacaggcattcagcggaccgtgttctttgttctgatgatgcttgtggcgcccagctatggcatgcgctgtgtcggggtgggaaacagagatttcgttgaaggcgtgtccgggggagcctgggtcgacctggtgctcgagcacggcggctgcgtgacaaccatggctcaggggaagcctaccctggattttgaactgacaaagacgaccgccaaagaggtcgctctcctgcggacatactgtatcgaagccagcatttctaatatcaccacagcgacccgctgcccgacgcaaggagagccctatcttaaggaggaacaggaccagcagtacatttgtagacgggatgttgtggaccgcggctgggggaacggatgcggcctgttcgggaaaggaggcgtggtcacatgcgccaagttttcctgtagcggcaaaatcaccgggaatctcgtgcaaattgagaacctggaatataccgttgtggtcacagtgcataatggagatacccacgctgttggcaacgacacatctaatcacggggtgacggccaccatcacacctagatcccccagcgtcgaggtgaaacttcctgattacggagaactgaccctcgactgcgagccccggtctggcatcgacttcaacgagatgattctgatgaagatgaaaaagaaaacatggctggtccataagcagtggtttctcgatctgccgcttccttggaccgctggggccgacacgtccgaagtgcactggaattacaaagagagaatggttaccttcaaggtgccccatgccaaacgccaggatgtcacagtgctgggcagccaggaaggagctatgcactccgcgctcgccggcgctaccgaggttgactctggggatggaaaccacatgtttgccggccatctgaagtgtaaggtgcggatggaaaaacttagaatcaaggggatgagctatacaatgtgctccggaaaattcagcattgacaaggagatggccgagacccaacacggcacgacagtcgtgaaagtgaagtacgaaggggctggcgccccttgtaaggttcccatcgagattcgcgatgtcaataaagaaaaggtggtgggacgggtcatctcttccacacccctggcggagaacacaaacagcgtgaccaatatcgagctcgaacctccgttcggcgactcttatattgttatcggggtgggaaacagcgctctgaccctgcattggtttagaaaaggctcctctattgggaagatgttcgagagcacataccgcggagccaaacggatggccatcctcggcgaaacggcttgggattttgggtccgtcggcggactgttcaccagccttggcaaggccgtgcaccaggtttttgggtctgtgtatacaaccatgttcggaggcgtctcctggatgattagaatcctgatcgggtttctcgtgctgtggattggaacaaatagccgcaacacctctatggctatgacgtgcatcgccgttggcgggattacactgttccttggctttaccgtgcaggcggacatgggatgtgtcgtgtcctggagcggccgggagctcaagtgcgggtccggaatcttcgtggtcgataatgttcatacctggacagaacaatacaaatttcagcccgagtctcctgccagactggctagcgccattctgaacgctcacaaggacggcgtgtgtgggatccgctccaccacacggctcgagaatgtgatgtggaaacagattacgaacgaactgaattatgtcctttgggagggaggccacgacctgaccgtggttgccggcgatgtgaagggggtcctcacaaaaggaaagagagcgctgacaccccctgtgtctgacctgaagtacagctggaaaacatggggcaaggccaaaatcttcacccccgaagctcggaactccacgtttcttatcgatgggccggacaccagcgagtgccctaatgaacgcagagcctggaactctctcgaggttgaggattacggattcggcatgttcacaaccaatatttggatgaagtttcgggaagggtccagcgaggtgtgtgaccatagactgatgtctgctgccatcaaagatcagaaggccgtccacgctgacatgggatattggattgaatccagcaaaaaccaaacatggcagatcgagaaggcgtctctgattgaagtgaagacctgcctctggcccaaaacacataccctgtggagcaatggcgttcttgagtcccagatgctgatccctaagagctacgccggccccttctctcagcacaactatcgccaagggtacgctacgcagacagtgggaccttggcacctcggcaaactggagatcgattttggggaatgccccggaaccaccgtcacaattcaggaggactgtgatcatcggggcccgtccctgagaaccacgacagccagcgggaaacttgtgacccagtggtgctgtcgctcctgcacaatgcctcccctcagattcctgggagaagacggctgttggtatggcatggagatccggcccctgaacgagaaagaagagaatatggtgaagtctcaagtcaccgccgggcagggaacaagcgaaaccttttccatgggcctcctgtgccttacgctgttcgttgaggaatgtctccgcagacgggtgacccgcaagcacatgattctggtggtcgtgatcacactgtgcgctattatccttgggggactcacctggatggatctgctgagagccctcatcatgctgggcgacacaatgtctgggcggattggaggccagatccatcttgcgattatggctgtttttaaaatgagccctggctacgtgctgggggtcttcctccgcaagctgacctccagagagacggccctgatggtgatcggaatggccatgacaaccgttctttctattccgcacgacctgatggagctcatcgatggcatcagcctggggctcattctgcttaaaatcgtgacacagtttgacaacacccaagtcggaaccctggctctctccctgacattcattcggagcacgatgcccctggtgatggcctggcgcaccatcatggcggtcctttttgtggttacactgattcctctctgtagaacctcttgcctgcagaagcagtcccattgggtggaaatcacagctctcattctgggcgcccaagcccttcccgtctatctgatgaccctcatgaaaggggctagccggagatcttggcctctgaatgagggaatcatggccgtgggcctggtttcccttctgggcagcgctctcctgaagaacgatgtgcccctcgccgggcctatggtcgcgggaggcctgcttctggccgcttacgtgatgtctgggtccagcgccgacctgtccctcgaaaaggctgccaatgtgcagtgggatgagatggccgacatcacgggaagctctcccattatcgaagttaaacaggatgaggacggcagcttctccattcgcgatgtcgaggaaacaaacatgatcaccctgcttgtgaagctggctctcattaccgtgtctgggctgtacccgctcgcgatccctgtcacaatgaccctgtggtatatgtggcaagtgaaaacacaacggagcggagccctttgggacgttccctcccctgctgccacgcagaaggccgctctgtctgagggcgtgtacagaatcatgcagcgcggcctgtttgggaaaacccaggtcggagtgggcattcacatggaaggggttttccacacaatgtggcatgtgacccggggaagcgtcatctgtcacgagacaggcagactcgaaccctcctgggccgatgtgcgcaatgacatgatttcttatgggggaggctggcggctgggcgataagtgggacaaggaggaggacgttcaagtgcttgcgatcgaaccggggaaaaaccctaagcatgtccagaccaaacccggactgttcaagacgctcaccggcgagattggggctgtgacactggattttaaacctggaaccagcggctcccccatcatcaatagaaaggggaaagtgattggcctctacggaaacggcgtcgttacaaagagcggggactatgtgtctgccatcacccaggccgaacgcattggagagcccgattacgaggtggacgaagatatcttccggaagaaaagactgacaattatggaccttcaccctggcgctgggaagacgaaacggatcctgccgtccattgtccgcgaggccctgaagagacggctccgcaccctgatccttgcgcccacaagagtggttgctgccgaaatggaggaagccctgcggggactccctatcagatatcagacccccgctgtgaaaagcgagcataccggccgcgagattgtcgatctgatgtgccacgccacatttacgacccggctcctgtcttccacaagagtgcctaattacaaccttatcgttatggacgaagctcacttcaccgatcccagctccgtggccgcgcgcgggtacatttctacacgggtcgagatgggcgaagccgctgccatctttatgaccgctacgcctccgggagccacagaccccttccctcaaagcaattcccccattgaggatatcgaaagagagatccctgagcgcagctggaacaccggctttgactggattaccgactatcaggggaagacagtgtggttcgtcccctctatcaaggccggaaatgatattgctaactgcctgcggaaatccggcaagaaagtgatccagctgagcagaaagacctttgacacagaatacccgaaaaccaagctcacggattgggacttcgttgtgacaaccgatatttctgagatgggggcgaactttcgcgccggaagagtgatcgaccctcggcgctgtctgaagcccgtcatccttacagatggccccgaaagagttattctggctgggcctatccccgtgacccctgccagcgccgctcaacggcgcggcagaattggacggaatccggcccaggaggacgatcagtatgtgttctccggcgaccccctcaaaaacgatgaagaccatgcgcactggacggaggctaagatgctgctggataatatctacacccctgaggggattatccccacactcttcggacctgaaagagagaaaacccaggccattgacggcgaatttcgccttagaggggaacaaagaaagacattcgtcgagctgatgcgccggggagacctgcccgtgtggctctcttataaagttgccagcgctggcatctcctacaaggatagagaatggtgctttaccggcgagcggaacaatcagatcctggaagagaacatggaagtggagatttggacacgcgagggggaaaagaagaaacttagaccgcggtggctggacgcccgcgtctatgcggatcctatggccctcaaagacttcaaagagtttgcttctggaagaaaaagcatcaccctggatattctgacggaaatcgcctccctccccacataccttagctctcgggctaagctggccctggacaatattgtgatgctccataccaccgagcgcggcgggagagcttaccagcacgccctgaacgaacttcctgagtccctggagacactcatgctggtcgcgctgctcggagccatgaccgctggcatcttcctctttttcatgcaggggaagggaatcggcaaactgagcatgggcctgattgccatcgctgtggcctccgggctcctgtgggttgccgaaattcaaccccagtggatcgctgcgtctattatccttgagtttttcctgatggtgctcctgatccctgaacccgagaagcagcggacaccgcaggataatcaactgatttatgtcatcctcacgattcttaccatcattggactgatcgccgctaacgaaatgggcctgattgagaaaacaaagaccgactttgggttctaccaggtgaaaacagagaccacgatcctcgatgttgacctgcgccctgccagcgcctggaccctttatgctgtggccacaaccatcctgacacccatgctcagacacaccattgaaaatacgtccgcgaacctgtctctggccgctatcgccaatcaggctgccgtcctcatgggacttggcaaggggtggcccctgcatcggatggatctgggagtgcctctcctggcgatgggctgttacagccaggtgaacccgacaacccttacagcctccctggttatgctcctggtccactatgctattatcggccccgggctgcaagccaaagctaccagagaggcccagaagcgcaccgctgccggaattatgaagaatcctacagtggacggcatcacggtgatcgatctcgaacccattagctacgaccctaaatttgagaagcagcttgggcaagtcatgctgctggttctctgcgcgggacagctgcttctgatgcggaccacatgggccttctgtgaggtgctcaccctggctacaggccccaccctgacgctctgggaagggaaccctggaagattctggaacacaaccatcgccgtgtctaccgctaatatttttcgcggctcctatcttgccggcgccgggctggcgttcagcctgatcaaaaacgctcagacaccgcggagaggaaccggcacaacgggggagaccctcggagaaaagtggaaacgccagctcaattctcttgaccggaaggagtttgaagagtacaagagatccggcattctggaggtcgatcgcacagaagccaaaagcgctctcaaggacgggtctaaaaccaagcatgccgtgagccggggatcctctaaaatcagatggatcgttgagcgcggcatggtgaagcccaagggcaaagtcgtggatctggggtgcggacggggcgggtggagctactatatggccacactgaagaacgttaccgaagtgaaaggatacacgaagggcgggcctggacacgaggaacccattcctatggctacctatggctggaatctcgtcaaacttcattccggcgtggacgtgttctacaagcccacagagcaagtcgataccctgctgtgtgacatcggggagagctcctctaacccgacaattgaagagggaagaaccctccgcgttctgaagatggtggaaccttggcttagctccaaacccgagttttgcatcaaggtgctgaatccctatatgcctacagtcattgaagaactggagaaactgcagagaaagcacggcgggaacctggtgcggtgtcccctctctcgcaatagcacccacgaaatgtactgggtttccggagcctctggcaacatcgtgagctccgtcaatacgacaagcaaaatgcttctgaacagattcaccacccggcatagaaagcctacatatgagaaagatgtggacctgggggcgggaacgcggtctgtttccaccgaaacagagaagccggatatgaccattatcggccgcagactccagcggctgcaggaggaacacaaggagacatggcattacgaccaagaaaatccctaccgcacctgggcctatcacggcagctacgaggctccttctacagggtccgccagctctatggtgaacggagtcgtgaaacttctgaccaagccctgggatgttatccctatggtgacgcagctcgctatgaccgacacaaccccctttggccagcagagagtcttcaaagaaaaggtggacacacggaccccgcaacctaaacccgggacgcgcatgattatgacaaccacagccaattggctgtgggcgctgctcggaaagaagaaaaaccctagactgtgcacccgggaggagtttatctccaaggtccgcagcaatgccgctattggcgccgtgttccaggaggagcaggggtggacgtccgctagcgaagccgttaacgattctagattttgggagcttgtggacaaagaacgggctctgcaccaagagggcaagtgtgagagctgcgtctataacatgatgggaaaacgcgaaaagaagctcggcgagttcgggagagccaaaggatcccgggcgatctggtacatgtggctgggcgcccgctttcttgagttcgaggctctggggttcctcaatgaagatcattggtttggaagagagaactcttggagcggcgtggagggggaaggcctgcaccggctgggatatattctcgaggaaatcgacaagaaagatggcgacctgatgtacgccgatgacaccgctgggtgggatacaagaatcaccgaggacgatcttcagaatgaggaactgattacagagcagatggcgccccaccacaagatcctcgccaaagccattttcaagctgacctatcagaacaaggtggttaaagtgcttcgccctacaccccggggagctgtcatggacatcatttccagaaaggatcaacgcggctctggacaggtgggaacctacggcctgaatacgtttacaaacatggaagttcagctcatccggcagatggaggccgaaggggtgatcacccaagacgacatgcagaatccgaaaggcctgaaggagagagtcgagaaatggctgcgcgaatgcggagtggatcggctcaagagaatggccattagcggcgacgattgtgtcgtgaaacctctggacgagcgcttcgggacctcccttctgtttctcaacgatatgggaaaggttcggaaggacatcccccagtgggaaccctctaaaggctggaagaattggcaggaggtgcctttctgcagccatcactttcacaaaattttcatgaaggatgggagatccctggtcgtgccgtgtcgcaaccaagacgaacttatcggacgggctagaattagccagggcgccgggtggtctctgcgggagacagcttgcctcggcaaagcctacgcgcagatgtggtccctgatgtattttcatagacgcgatctgcggctcgccagcatggctatctgttctgccgttcccaccgagtggttccctacatccagaacgacctggagcatccacgctcatcaccagtggatgacaaccgaagacatgctgaaggtgtggaatcgcgtctggattgaggataaccccaatatgacagacaagacccctatccactcctgggaagacattccctaccttggaaaaagagaggatctgtggtgcggctctctcatcgggctgagctcccgggccacgtgggcgaagaacattcataccgccatcacacaagtgcgcaatcttattggaaaagaagagtatgtggactacatgcctgttatgaagagatatagcgctccctctgagtccgaaggcgtcctgtga

SEQ ID NO: 20980 - RNA, 9867 nt, synthetic construct
  misc_feature 1..9867: note = derived and/or modified CDS sequence (opt5) from DENV-4__GQ199881__SS-prME
  source 1..9867: mol_type = other RNA
agcaccatcaccctgctctgcctgattcccacggtgatggctttccacctttccacccgggacggcgagcctctgatgatcgtggctaagcatgaacgggggcgcccgctcctgtttaagaccaccgagggaattaacaagtgtacccttatcgccatggatctgggcgaaatgtgcgaggacaccgttacatacaagtgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaagcatgcccaacgcgtggagtcttggatccttagaaatcctggcttcgctctgctcgccggctttatggcttacatgatcgggcagacacggattcagcgcaccgttttctttgtgctgatgatgcttgtcgcccccagctatggaatgagatgtgtgggcgttgggaaccgggatttcgtggaaggagtctccggcggggcgtgggtggacctggtgctcgagcacggaggctgcgtcacaaccatggcccagggcaagcctaccctggattttgaactgacaaagacgaccgctaaagaggttgccctcctgcgcacatactgtatcgaagctagcatttctaatatcaccacagccaccagatgcccgacgcaaggggagccctatcttaaggaggaacaggaccagcagtacatttgtcggcgcgatgtggtggacagaggatggggcaacgggtgcggactgttcggcaaagggggagtcgtgacatgcgcgaagttttcctgtagcggcaaaatcaccggcaatctcgttcaaattgagaacctggaatataccgtggtcgtgacagttcataatggggatacccacgccgtgggaaacgacacatctaatcacggcgtcacggctaccatcacacctcggtcccccagcgtggaggtcaaacttcctgattacggggaactgaccctcgactgcgagcccagatctggaatcgacttcaacgagatgattctgatgaagatgaaaaagaaaacatggctggtgcataagcagtggtttctcgatctgccgcttccttggaccgccggcgctgacacgtccgaagttcactggaattacaaagagcgcatggtgaccttcaaggtcccccatgccaaacggcaggatgtgacagttctggggagccaggaaggcgccatgcactccgctctcgcgggagccaccgaggtggactctggcgatgggaaccacatgtttgctggacatctgaagtgtaaggtcagaatggaaaaacttcgcatcaagggcatgagctatacaatgtgctccgggaaattcagcattgacaaggagatggccgagacccaacacggaacgacagtggtgaaagttaagtacgaaggcgccggggctccttgtaaggtccccatcgagattcgggatgtgaataaagaaaaggtggtcggcagagtgatctcttccacacccctggccgagaacacaaacagcgttaccaatatcgagctcgaacctccgttcggagactcttatattgtgatcggcgtcgggaacagcgcgctgaccctgcattggtttcgcaaaggatcctctattggcaagatgttcgagagcacatacagaggggctaaaagaatggccatcctcggagaaacggcctgggattttggctccgtcgggggcctgttcaccagccttggaaaggctgttcaccaggtgtttggctctgtctatacaaccatgttcgggggagtgtcctggatgattcgcatcctgatcggctttctcgttctgtggattgggacaaatagccggaacacctctatggccatgacgtgcatcgctgtgggaggcattacactgttccttgggtttaccgtccaggccgacatgggctgtgtggtgtcctggagcggaagagagctcaagtgcggctccgggatcttcgtcgttgataatgtgcatacctggacagaacaatacaaatttcagcccgagtctcctgcgcgcctggccagcgctattctgaacgcccacaaggacggagtgtgtggcatccggtccaccacaagactcgagaatgtcatgtggaaacagattacgaacgaactgaattatgtgctttgggaagggggacacgacctgaccgttgtggctggcgatgtcaagggcgtgctcacaaaagggaagcgggccctgacaccccctgtttctgacctgaagtacagctggaaaacatggggaaaggcgaaaatcttcacccccgaagcccgcaactccacgtttcttatcgatggcccggacaccagcgagtgccctaatgaaagacgggcttggaactctctcgaggtggaggattacgggttcggaatgttcacaaccaatatttggatgaagtttagagaaggctccagcgaggtctgtgaccatcgcctgatgtctgccgctatcaaagatcagaaggccgtgcacgccgacatggggtattggattgaatccagcaaaaaccaaacatggcagatcgagaaggcttctctgattgaagttaagacctgcctctggcccaaaacacataccctgtggagcaatggagtgcttgagtcccagatgctgatccctaagagctacgcgggccccttctctcagcacaactatcggcaaggctacgccacgcagacagtcgggccttggcacctcggaaaactggagatcgattttggcgaatgccccgggaccaccgtgacaattcaggaggactgtgatcatagaggaccgtccctgcgcaccacgacagctagcggcaaacttgtgacccagtggtgctgtagatcctgcacaatgcctcccctccggttcctgggggaagacggatgttggtatggcatggagatccgccccctgtctgagaaagaagagaacatggtcaagagccaagttgccgccggccaggggacctccgaaacatttttcatgggactcctgtgccttaccctgtttgtggaggaatgtctcagacggcgcgtgacgagaaagcacatgattctggctgtcgtgatcaccctgtgcgccattatccttggcgggctcacatggatggatctgctgcgggcgctcatcatgctgggagacaccatgtctggccgcattgggggacagacacatcttgctatcatggccgttttcaaaatgagccctggctacgtgctgggcgtctttctcagaaagctgacctcccgggagacggccctgatggtgattgggatggctatgacaaccacactttctatcccgcacgacctgatggagctcattgatggaatcagcctgggcctcatcctgcttaaaattgttacccagttcgacaatacccaagtggggacactggccctctccctgacgtttatccgcagcaccatgtctctggtcatggcgtggagaacaattatggctgtgcttttcgtcgtgaccctgatccccctctgtcggacatcctgcctgcagaagcagagccattgggttgaaattaccgccctcatcctgggagcccaagcccttcctgtgtatctgatgacgctcatgaaaggcgcctctagacgctcctggcccctgaacgaggggatgatggctgtcggactggtgagccttctgggctctgccctcctgaagaatgatgttcctctcgcgggccccatggtggccgggggactgcttctggctgcctacgtcatgtccggcagctccgctgacctgagcctcgaaaaggccgccaacgtgcagtgggatgagatggctgacattacagggtctagccctatcatcgaagtgaaacaggatgaggacggatccttttctattcgggatgttgaggaaaccaatatgatcaccctgcttgtcaagctggcgctcattacagtgagcggcctgtaccccctcgccatcccggtgaccatgacactgtggtatatgtggcaggtcaaaacgcaaagatccggggctctttgggacgtgccttctcccgccgccacccagaaggctgccctgagcgagggagtttaccgcattatgcagcggggcctgttcggcaaaacacaggtgggggtcggaatccacatggaaggcgtgttccacaccatgtggcatgttacaagagggtccgtgatctgtcacgagaccggacgcctcgaaccttcttgggcggatgtccggaacgacatgattagctatggcgggggatggagactgggcgataagtgggacaaggaggaggacgtgcaagttcttgctatcgaacccggcaaaaatccgaagcatgtgcagacgaaacctgggctgtttaagaccctcacaggagagattggcgccgtcaccctggatttcaaacccgggtccagcggatctcctatcattaaccgcaagggcaaagtgatcgggctctacggcaatggagtggtcacaaagtccggcgactatgttagcgccatcacccaggctgaacggattggggagcccgattacgaggtggacgaagatatctttagaaagaaacggctgacaattatggaccttcaccccggagccggcaagacgaaacgcatcctgccttctattgtgagagaggcgctgaagcggcgcctcagaaccctgatccttgctccgacacgggtcgtggccgccgaaatggaggaagctctgagagggctccccattcgctatcagacccctgccgttaaatccgagcataccggacgggagatcgtggatctgatgtgccacgctacattcacgaccagactcctgagctccacacgcgtccccaactacaatcttatcgtgatggacgaagcccactttaccgatccttctagcgttgcggcccggggctacatttccacaagagtggagatgggggaagctgccgctatcttcatgaccgccacgccccctggcgccacagacccgtttccccaaagcaactctcctattgaggatatcgaacgcgagattcccgagcggtcctggaataccggattcgactggatcaccgactatcagggcaagacagtctggtttgtgcctagcatcaaggctgggaacgatattgcgaattgcctgagaaaatctggaaagaaagtcatccagctgagccgcaagaccttcgacacagaataccccaaaaccaagctcacggattgggactttgtggttacaaccgatatttccgagatgggcgccaacttcagagctgggcgggtgatcgacccgcgcagatgtctgaagcctgtgattcttacagatggacccgaacgggtcatcctggccggccccatccctgttacccccgcctctgctgcccaacgcagagggcggattggcagaaaccctgcgcaggaggacgatcagtatgtgttcagcggagacccgctcaaaaatgatgaagaccatgctcactggacggaggccaagatgctgctggataacatctacacccccgagggcattatccctacactctttgggcccgaacgcgagaaaacccaggccattgacggagagttccggcttagaggcgagcaacgcaagacatttgtggagctgatgcggagaggggacctgcctgtctggctctcctataaagtggcttctgccggaatcagctacaaggatcgggaatggtgcttcaccggcgagcgcaataaccagattctggaagagaatatggaagttgagatctggacaagagagggcgaaaagaagaaacttcggccccgctggctggacgcgagagtgtatgccgatccgatggctctcaaagactttaaagagttcgcctccgggcggaaaagcatcaccctggatattctgacggaaatcgcttctctccctacatacctttccagccgcgccaagctggctctggacaacattgtcatgctccataccaccgagagaggaggccgggcctaccagcacgcgctgaatgaacttcccgagtccctggagacactcatgctggtggccctgctcggggctatgaccgccggaatctttcttttctttatgcagggcaaggggattggaaaactgtctatgggcctgatcacaatcgctgtcgccagcggcctcctgtgggtggccgaaattcaacctcagtggatcgctgcgtccattatccttgagttctttctgatggttctcctgattcccgaacctgagaagcagcgcacgccccaggataaccaactgatctatgtgatcctcgccattcttaccatcattgggctgatcgctgccaatgaaatgggactgattgagaaaacaaagaccgacttcggcttttaccaggtcaaaacagagaccacgatcctcgatgtggacctgagaccggcctctgcttggaccctttatgccgttgcgacaaccattctgacacctatgctccggcacaccatcgaaaacacgagcgccaatctgtccctggctgccatcgctaaccaggccgcggtgctcatggggcttggaaagggctggcccctgcatagaatggatctgggggtccccctcctggccatgggatgttacagccaggtgaatcctacaacccttacagcttctctggtgatgctcctggttcactatgccattatcggcccgggcctgcaagctaaagccacccgcgaggctcagaagcggaccgccgcggggattatgaagaaccccacagtcgacggaatcacggtgattgatctcgaacctatctcctacgaccccaaattcgagaagcagcttggccaagtgatgctgctggtcctctgcgccgggcagctgcttctgatgagaaccacatgggctttctgtgaggttctcaccctggccacaggacctatcctgaccctctgggaaggcaatcccgggcgcttttggaacacgacaattgctgtgagcaccgccaacatcttccggggatcttatcttgccggcgcgggcctggctttttccctgattaaaaatgcccagacccctagacgcgggacaggaaccacaggcgagacgctcggggaaaagtggaaacggcagctgaacagccttgacagaaaggagttcgaagagtacaagcgctctggaatcctggaggtggatcggaccgaagctaaaagcgccctcaaggacggctccaaaattaagcatgccgtctctagagggagctccaaaatccgctggatcgtggagcggggaatggttaagccgaagggcaaagtggtcgatctgggctgcgggagaggaggctggagctactatatggctacactgaagaatgtgaccgaagttaaagggtacacaaagggaggccccgggcacgaggaacctattcccatggccacctatggatggaacctcgtgaaacttcattccggcgtcgacgtgttttacaagcctacggagcaagtggataccctgctgtgtgacatcggcgagtctagctccaatcccacaattgaagaggggcgcaccctcagagtcctgaagatggttgaaccgtggctttctagcaaacctgagttctgcatcaaggtgctgaacccctatatgcccacagtgattgaggaactcgagaaactgcagcggaagcacggaggcaatctggtccgctgtcctctctccagaaactctacccacgaaatgtactgggtgagcggggcgtccggaaatatcgttagctctgtgaacacaacctccaaaatgcttctgaatcggtttacgacaagacatcggaagcccacctatgagaaagatgtcgacctgggcgccgggacccgcagcgtgtctacagaaacggagaagcctgatatgaccattatcggaagacggctccagcgcctgcaggaggaacacaaggagacatggcattacgaccaagaaaacccgtacagaacctgggcttatcacggctcctacgaggcccccagcacaggctctgcttccagcatggttaatggggtggtcaaacttctgaccaagccttgggatgtgatccccatggttacacagctcgccatgaccgacacgacccctttcggacagcagcgggtgtttaaagaaaaggtcgacacacgcacaccccaaccgaaacctggcacaagaatggtgatgaccacgacagcgaactggctgtgggccctgctcgggaagaagaaaaatccccggctgtgcacccgcgaggagttcatttccaaggtcagaagcaacgctgccatcggagctgtgtttcaggaggaacagggctggacatctgccagcgaagctgttaatgattcccggttctgggagcttgtggacaaagaacgcgccctgcaccaagaggggaagtgtgagtcttgcgtctataacatgatgggcaaaagagaaaagaagctcggagagtttggccgggcgaaagggagccgcgccatttggtacatgtggctgggagctagattccttgagttcgaggccctgggctttctcaacgaagatcattggttcgggcgggaaaattcctggtctggagtggagggcgaagggctgcacagactgggctatatcctcgaggaaattgacaagaaagatggagacctgatgtacgctgatgacaccgccggctgggatacgcgcatcaccgaggacgatcttcagaacgaggaactgatcacagagcagatggcccctcatcacaagattctcgcgaaagctatctttaagctgacctatcagaataaggtggttaaagtgcttcggcccacacctagaggggccgtcatggacattatcagccgcaaggatcaacggggatccggccaggtggggacctacggactgaacacattcaccaatatggaagttcagctcattagacagatggaggccgaaggcgtgatcacgcaagacgacatgcagaaccccaaagggctgaaggagcgcgtcgagaaatggctgcgggaatgcggcgtggatagactcaagcgcatggctatctctggagacgattgtgtcgtgaaaccgctggacgagcggtttggcacaagccttctgttcctcaatgatatggggaaggttagaaaggacattcctcagtgggaaccctccaaaggatggaagaactggcaggaggtgcccttttgcagccatcacttccacaaaatctttatgaaggatggccgctctctggtcgtgccttgtcggaatcaagacgaacttattgggagagcccggatctcccagggagctggctggagcctgagagagaccgcctgcctcgggaaagcgtacgcccagatgtggtctctgatgtatttccatcgccgggatctgagactcgcttccatggccatttgtagcgctgttccgaccgagtggtttcccacatcccgcaccacatggtctatccacgcccatcaccagtggatgacgaccgaagacatgctgaaggtgtggaacagagtctggatcgaggataatcctaacatgattgacaagacacccgtgcacagctgggaagacatcccttaccttggcaaacgggaggatctgtggtgcggatccctcattggcctgagctctcgcgcgacctgggccaagaatatccatacagctattacccaagtgagaaaccttatcgggaaagaagagtatgttgactacatgcccgtcatgaagcggtattccgcccctagcgagtctgaaggagtgctgtga

SEQ ID NO: 20981 - RNA, 9867 nt, synthetic construct
  misc_feature 1..9867: note = derived and/or modified CDS sequence (opt5) from DENV-4__GQ199882__SS-prME
  source 1..9867: mol_type = other RNA
agcaccatcaccctgctttgcctgattcccacggtgatggctttccatctttccacccgggacggagagcctctgatgatcgtcgctaagcatgaacgggggcgcccgctcctgtttaagaccaccgaggggattaacaagtgtacccttatcgccatggatctgggcgaaatgtgcgaggacaccgttacatacaagtgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaagcatgcccaacgcgtggagtcttggatccttagaaatcctggcttcgctctgctcgccggctttatggcttacatgatcgggcagacaggcattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctagcatttctaatatcaccacagccacccgctgcccgacgcaaggagagccctatcttaaggaggaacaggaccagcagtacatttgtagacgggatgtggtggaccgcggctgggggaacggatgcggcctgttcgggaaaggaggcgtcgtgacatgcgcgaagttttcctgtagcggcaaaatcaccgggaatctcgttcaaattgagaacctggaatataccgtggtcgtgacagttcataatggagatacccacgccgtgggcaacgacacatctaatcacggggtcacggctaccatcacacctagatcccccagcgtggaggtcaaacttcctgattacggagaactgaccctcgactgcgagccccggtctggcatcgacttcaacgagatgattctgatgaagatgaaaaagaaaacatggctggtgcataagcagtggtttctcgatctgccgcttccttggaccgccggggctgacacgtccgaagttcactggaattacaaagagagaatggtgaccttcaaggtcccccatgccaaacgccaggatgtgacagttctgggcagccaggaaggagccatgcactccgctctcgcgggcgccaccgaggtggactctggggatggaaaccacatgtttgctggccatctgaagtgtaaggtccggatggaaaaacttagaatcaaggggatgagctatacaatgtgctccggaaaattcagcattgacaaggagatggccgagacccaacacggcacgacagtggtgaaagttaagtacgaaggggccggcgctccttgtaaggtccccatcgagattcgcgatgtgaataaagaaaaggtggtcggacgggtgatctcttccacacccctggccgagaacacaaacagcgttaccaatatcgagctcgaacctccgttcggcgactcttatattgtgatcggggtcggaaacagcgcgctgaccctgcattggtttagaaaaggctcctctattgggaagatgttcgagagcacataccgcggagctaaacggatggccatcctcggcgaaacggcctgggattttgggtccgtgggcggactgttcaccagccttggcaaggctgttcaccaggtgtttgggtctgtctatacaaccatgttcggaggcgtgtcctggatgattagaatcctgatcgggtttctcgttctgtggattggaacaaatagccgcaacacctctatggccatgacgtgcatcgctgtgggcgggattacactgttccttggctttaccgtccaggccgacatgggatgtgtggtgtcctggagcggccgggagctcaagtgcgggtccggaatcttcgtcgttgataatgtgcatacctggacagaacaatacaaatttcagcccgagtctcctgcgagactggccagcgctattctgaacgcccacaaggacggcgtgtgtgggatccgctccaccacacggctcgagaatgtcatgtggaaacagattacgaacgaactgaattatgtgctttgggagggaggccacgacctgaccgttgtggctggcgatgtcaagggggtgctcacaaaaggaaagagagccctgacaccccctgtttctgacctgaagtacagctggaaaacatggggcaaggcgaaaatcttcacccccgaagcccggaactccacgtttcttatcgatgggccggacaccagcgagtgccctaatgaacgcagagcttggaactctctcgaggtggaggattacggattcggcatgttcacaaccaatatttggatgaagtttcgggaagggtccagcgaggtctgtgaccatagactgatgtctgccgctatcaaagatcagaaggccgtgcacgccgacatgggatattggattgaatccagcaaaaaccaaacatggcagatcgagaaggcttctctgattgaagttaagacctgcctctggcccaaaacacataccctgtggagcaatggcgtgcttgagtcccagatgctgatccctaagagctacgcgggccccttctctcagcacaactatcgccaagggtacgccacgcagacagtcggaccttggcacctcggcaaactggagatcgattttggggaatgccccggaaccaccgtgacaattcaggaggactgtgatcatcggggcccgtccctgagaaccacgacagctagcgggaaacttgtgacccagtggtgctgtcgctcctgcacaatgcctcccctcagattcctgggagaagacggctgttggtatggcatggagatccggcccctgtctgagaaagaagagaacatggtcaagagccaagttgccgccgggcagggaacctccgaaacattttctatgggcctcctgtgccttaccctgttcgtggaggaatgtctccgcagacgggtgacgcgcaagcacatgattctggctgtcgtgatcaccctgtgcgccattatccttgggggactcacatggatggatctgctgagagcgctcatcatgctgggcgacaccatgagcgggcggattggaggccagacacatcttgctatcatggccgtttttaaaatgtcccctggctacgtgctgggggtcttcctccgcaagctgacctctagagagacggccctgatggtgattggaatggctatgacaaccacacttagcatcccgcacgacctgatggagctcattgatggcatctccctggggctcatcctgcttaaaattgttacccagtttgacaatacccaagtgggaacactggccctcagcctgacgttcatccggtctaccatgtccctggtcatggcgtggcgcacaattatggctgtgctttttgtcgtgaccctgatccccctctgtagaacaagctgcctgcagaagcagtctcattgggttgaaattaccgccctcatcctgggcgcccaagcccttcctgtgtatctgatgacgctcatgaaaggggcctcccggagaagctggcccctgaacgagggaattatggctgtcggcctggtgtctcttctgggctccgccctcctgaagaatgatgttcctctcgcggggcccatggtggccggaggcctgcttctggctgcctacgtcatgagcgggtccagcgctgacctgtctctcgaaaaggccgccaacgtgcagtgggatgagatggctgacatcacaggaagctcccctatcattgaagtgaaacaggatgaggacggctctttcagcatccgcgatgttgaggaaaccaatatgattaccctgcttgtcaagctggcgctcatcacagtgtccgggctgtaccccctcgccattccggtgaccatgacactgtggtatatgtggcaggtcaaaacgcaacggtctggagctctttgggacgtgcctagccccgccgccacccagaaggctgccctgtccgagggcgtttacagaatcatgcagcgcggcctgtttgggaaaacacaggtgggagtcggcatccacatggaaggggtgttccacaccatgtggcatgttacacggggatctgtgatttgtcacgagaccggcagactcgaacctagctgggcggatgtccgcaacgacatgatctcctatgggggaggctggcggctgggcgataagtgggacaaggaggaggacgtgcaagttcttgctattgaacccgggaaaaatccgaagcatgtgcagacgaaacctggactgttcaagaccctcacaggcgagatcggggccgtcaccctggattttaaacccggaacaagcggctctcctattatcaacagaaaggggaaagtgatcggcctctacggaaatggcgtggtcaccaagtccggggactatgttagcgccattacacaggctgaacgcatcggagagcccgattacgaggtggacgaagatattttccggaagaaaagactgacgatcatggaccttcaccccggcgccgggaagaccaaacggattctgccttctatcgtgcgcgaggcgctgaagagacggctccgcacactgattcttgctccgaccagagtcgtggccgccgaaatggaggaagctctgcggggactccccatcagatatcagacccctgccgttaaatccgagcatacaggccgcgagatcgtggatctgatgtgccacgctacgtttaccacacggctcctgagctccaccagagtccccaactacaatcttattgtgatggacgaagcccacttcacagatccttctagcgttgcggcccgcgggtacatctccacccgggtggagatgggcgaagctgccgctatttttatgacggccacaccccctggagccaccgacccgttcccccaaagcaactctcctatcgaggatattgaaagagagatccccgagcgctcctggaataccggctttgactggatcacagactatcaggggaagaccgtctggttcgtgcctagcattaaggctggaaacgatatcgcgaattgcctgcggaaatctggcaagaaagtcattcagctgagcagaaagacatttgacaccgaataccccaaaacgaagctcacagattgggacttcgtggttaccacagatatctccgagatgggggccaactttcgcgctggaagagtgattgacccgcggcgctgtctgaagcctgtgatccttaccgatggctctgaaagagtcatcctggccgggcccattcccgttacgcctgccagcgctgcccaacggcgcggcagaatcggacggaaccccgcgcaggaggacgatcagtatgtgttctccggcgaccctctcaaaaatgatgaagaccatgctcactggaccgaggccaagatgctgctggataacatttacacaccggaggggatcattcccaccctcttcggacctgaaagagagaaaacacaggccatcgacggcgaatttcgccttagaggggaacaaagaaagaccttcgtggagctgatgcgccggggagacctgcccgtctggctctcttataaagtggctagcgccggcatttcctacaaggatagagaatggtgctttacaggcgagcggaataaccagatcctggaagagaatatggaagttgagatctggacccgcgagggggaaaagaagaaacttagacctcggtggctggacgcgcgcgtgtatgccgatcccatggctctcaaagacttcaaagagtttgccagcggaagaaaatctattacgctggatatcctgacagaaattgcttccctcccgacctaccttagctcccgggccaagctggctctggacaacatcgtcatgctccataccacagagcgcggcgggagagcctaccagcacgcgctgaatgaacttcctgagtctctggagaccctcatgctggtggccctgctcggagctatgacagccggcattttcctctttttcatgcaggggaagggaatcggcaaactgagcatgggcctgatcacgattgctgtcgcctccgggctcctgtgggtggccgaaatccaaccccagtggattgctgcgtctatcattcttgagtttttcctgatggttctcctgatccctgaacccgagaagcagcggacccctcaggataaccaactgatctatgtgattctcacaatccttaccattatcggactgattgccgctaatgaaatgggcctgatcgagaaaacaaagaccgactttgggttctaccaggtcaaaacggagaccacaattctcgatgtggacctgcgccccgccagcgcctggaccctttatgctgttgccacaaccatcctgacgccgatgctcagacacacaatcgaaaacacctccgcgaatctgagcctggccgctattgccaaccaggctgccgtgctcatgggacttggcaaggggtggcctctgcatcggatggatctgggagtccccctcctggcgatgggctgttactctcaggtgaatcccacaacccttaccgcctccctggtgatgctcctggttcactatgctatcattggccctgggctgcaagccaaagctacaagagaggcccagaagcgcacggctgccggaatcatgaagaacccgaccgtcgacggcattacagtgatcgatctcgaacccatcagctacgaccctaaatttgagaagcagcttgggcaagtgatgctgctggtcctctgcgcgggacagctgcttctgatgcggaccacatgggccttctgtgaggttctcaccctggctacgggccccattctgacactctgggaagggaatcctggaagattctggaacaccaccatcgccgtgtctacagctaacatttttcgcggctcctatcttgccggcgccgggctggcgttcagcctgatcaaaaatgctcagacaccccggagaggaacaggcacgaccggggagacactcggagaaaagtggaaacgccagctgaactctcttgaccggaaggagtttgaagagtacaagagaagcggcattctggaggtggatcgcaccgaagccaaatccgctctcaaggacgggtctaaaatcaagcatgccgtcagccggggatccagcaaaatcagatggattgtggagcgcggcatggttaagcctaagggcaaagtggtcgatctggggtgcggacggggcgggtggtcctactatatggccacactgaagaatgtgaccgaagttaaaggatacacgaagggcgggccgggacacgaggaacccatccctatggctacctatggctggaacctcgtgaaacttcattctggcgtcgacgtgttctacaagcccacagagcaagtggataccctgctgtgtgacattggggagagctcctctaatcctacaatcgaagagggaagaaccctccgcgtcctgaagatggttgaaccctggcttagctccaaaccggagttttgcattaaggtgctgaacccttatatgcccacagtgatcgaggaactcgagaaactgcagagaaagcacggcgggaatctggtccggtgtcccctctctcgcaacagcacccacgaaatgtactgggtgtccggagccagcggcaatattgtttcttccgtgaacacgacaagcaaaatgcttctgaatagattcaccacccggcatagaaagcctacatatgagaaagatgtcgacctgggggcgggaacgcggtctgtgtccaccgaaacagagaagcccgatatgaccatcatcggccgcagactccagcggctgcaggaggaacacaaggagacatggcattacgaccaagaaaacccttaccgcacctgggcctatcacggcagctacgaggctccgtctacagggtccgccagctccatggttaatggagtggtcaaacttctgaccaagccctgggatgtgattcctatggttacgcagctcgctatgaccgacacaaccccctttggccagcagagagtgttcaaagaaaaggtcgacacacggacccctcaacccaaaccggggacgcgcatggtgatgacaaccacagccaactggctgtgggcgctgctcggaaagaagaaaaatcctagactgtgcacccgggaggagtttatcagcaaggtccgctctaacgccgctattggcgccgtgttccaggaggagcaggggtggacgagcgcttccgaagccgttaatgattctagattttgggagcttgtggacaaagaacgggctctgcaccaagagggcaagtgtgagagctgcgtctataacatgatgggaaaacgcgaaaagaagctcggcgagttcgggagagccaaaggatcccgggcgatctggtacatgtggctgggcgcccgctttcttgagttcgaggctctggggttcctcaacgaagatcattggtttggaagagaaaattcttggagcggcgtggagggggaaggcctgcaccggctgggatatattctcgaggaaatcgacaagaaagatggcgacctgatgtacgccgatgacaccgctgggtgggatacaagaatcaccgaggacgatcttcagaacgaggaactgattacagagcagatggcgccccaccacaagatcctcgccaaagccattttcaagctgacctatcagaataaggtggttaaagtgcttcgccctacaccccggggagctgtcatggacatcatttccagaaaggatcaacgcggctctggacaggtgggaacctacggcctgaacacgtttacaaatatggaagttcagctcatccggcagatggaggccgaaggggtgatcacccaagacgacatgcagaaccctaaaggcctgaaggagagagtcgagaaatggctgcgcgaatgcggagtggatcggctcaagagaatggccattagcggcgacgattgtgtcgtgaaacccctggacgagcgcttcgggacctcccttctgtttctcaatgatatgggaaaggttcggaaggacatcccgcagtgggaacctagcaaaggctggaagaactggcaggaggtgcccttctgctctcatcactttcacaaaattttcatgaaggatgggagatccctggtcgtgccctgtcgcaatcaagacgaacttatcggacgggctagaattagccagggcgccgggtggtctctgcgggagacagcttgcctcggcaaagcctacgcgcagatgtggtccctgatgtattttcatagacgcgatctgcggctcgccagcatggctatctgttccgccgttcctaccgagtggttcccgacatctagaacgacctggagcatccacgctcatcaccagtggatgacaaccgaagacatgctgaaggtgtggaaccgcgtctggattgaggataatcccaacatgatcgacaagacacctgtgcactcctgggaagacattccctaccttggaaaaagagaggatctgtggtgcggcagcctcatcgggctgtcttcccgggccacctgggcgaagaatattcatacggccatcacccaagtgcgcaaccttattggaaaagaagagtatgttgactacatgcctgtcatgaagagatatagcgctccctctgagagcgaaggcgtgctgtga

SEQ ID NO: 20982 - RNA, 9867 nt, synthetic construct
  misc_feature 1..9867: note = derived and/or modified CDS sequence (opt5) from DENV-4__GQ199883__SS-prME
  source 1..9867: mol_type = other RNA
agcaccatcaccctgctttgcctgattcccacggtgatggccttccacctttccacccgggacggagagcctctgatgatcgtggctaagcatgaacgggggcgcccgctcctgtttaagaccaccgagggaattaacaagtgtacccttatcgccatggatctgggcgaaatgtgcgaggacaccgttacatacaagtgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaagcatgcccagcgcgtggagtcttggatccttagaaatcctggcttcgctctgctcgccggctttatggcttacatgatcgggcagacaggcattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctagcatttctaatatcaccacagccacccgctgcccgacgcaaggagagccctatcttaaggaggaacaggaccagcagtacatttgtagacgggatgtggtggaccgcggctgggggaacggatgcggcctgttcgggaaaggaggcgtcgtgacatgcgcgaagttttcctgtagcggcaaaatcaccgggaatctcgttcaaattgagaacctggaatataccgtggtcgtgacagttcataatggagatacccacgccgtgggcaacgacacatctaatcacggggtcacggctaccatcacacctagatcccccagcgccgaggtgaaacttcctgattacggagaactgaccctcgactgcgagccccggtctggcatcgacttcaacgagatgattctgatgaagatgaaaaagaaaacatggctggtccataagcagtggtttctcgatctgccgcttccttggaccgctggggccgacacgtccgaagtgcactggaattacaaagagagaatggttaccttcaaggtgccccatgccaaacgccaggatgtcacagtgctgggcagccaggaaggagctatgcactccgcgctcgccggcgctaccgaggttgactctggggatggaaaccacatgtttgccggccatctgaagtgtaaggtgcggatggaaaaacttagaatcaaggggatgagctatacaatgtgctccggaaaattcagcattgacaaggagatggccgagacccaacacggcacgacagtcgtgaaagtgaagtacgaaggggctggcgccccttgtaaggttcccatcgagattcgcgatgtcaataaagaaaaggtggtgggacgggtcatctcttccacacccctggcggagaacacaaacagcgtgaccaatatcgagctcgaacctccgttcggcgactcttatattgttatcggggtgggaaacagcgctctgaccctgcattggtttagaaaaggctcctctattgggaagatgttcgagagcacataccgcggagccaaacggatggccatcctcggcgaaacggcttgggattttgggtccgtcggcggactgttcaccagccttggcaaggccgtgcaccaggtttttgggtctgtgtatacaaccatgttcggaggcgtctcctggatgattagaatcctgatcgggtttctcgtgctgtggattggaacaaatagccgcaacacctctatggctatgacgtgcatcgccgttggcgggattacactgttccttggctttaccgtgcaggcggacatgggatgtgtcgtgtcctggagcggccgggagctcaagtgcgggtccggaatcttcgtggtcgataatgttcatacctggacagaacaatacaaatttcagcccgagtctcctgccagactggctagcgccattctgaacgctcacaaggacggcgtgtgtgggatccgctccaccacacggctcgagaatgtgatgtggaaacagattacgaacgaactgaattatgtcctttgggagggaggccacgacctgaccgtggttgccggcgatgtgaagggggtcctcacaaaaggaaagagagcgctgacaccccctgtgtctgacctgaagtacagctggaaaacatggggcaaggccaaaatcttcacccccgaagctcggaactccacgtttcttatcgatgggccggacaccagcgagtgccctaatgaacgcagagcctggaactctctcgaggttgaggattacggattcggcatgttcacaaccaatatttggatgaagtttcgggaagggtccagcgaggtgtgtgaccatagactgatgtctgctgccatcaaagatcagaaggccgtccacgctgacatgggatattggattgaatccagcaaaaaccaaacatggcagatcgagaaggcgtctctgattgaagtgaagacctgcctctggcccaaaacacataccctgtggagcaatggcgttcttgagtcccagatgctgatccctaagagctacgccggccccttctctcagcacaactatcgccaagggtacgctacgcagacagtgggaccttggcacctcggcaaactggagatcgattttggggaatgccccggaaccaccgtcacaattcaggaggactgtgatcatcggggcccgtccctgagaaccacgacagccagcgggaaacttgtgacccagtggtgctgtcgctcctgcacaatgcctcccctcagattcctgggagaagacggctgttggtatggcatggagatccggcccctgtctgagaaagaagagaacatggtcaagagccaagtcgccgctgggcagggaacctccgaaacattttctatgggcctcctgtgccttaccctgttcgttgaggaatgtctccgcagacgggtgacgcgcaagcacatgattctggccgtggtcatcaccctgtgcgcgattatccttgggggactcacatggatggatctgctgagagctctcatcatgctgggcgacaccatgagcgggcggattggaggccagacacatcttgccatcatggccgtgtttaaaatgtcccctggctacgttctgggggtgttcctccgcaagctgacctctagagagacggctctgatggtcattggaatggccatgacaaccacacttagcatcccgcacgacctgatggagctcattgatggcatctccctggggctcatcctgcttaaaattgtgacccagtttgacaatacccaagttggaacactggcgctcagcctgacgttcatccggtctaccatgtccctggtgatggcttggcgcacaattatggccgtcctttttgtggtcaccctgatccccctctgtagaacaagctgcctgcagaagcagtctcattgggtggaaattaccgccctcatcctgggcgctcaagcccttcctgtttatctgatgacgctcatgaaaggggcttcccggagaagctggcccctgaacgagggaattatggccgtgggcctggtctctcttctgggctccgcgctcctgaagaatgatgtgcctctcgccgggcccatggttgctggaggcctgcttctggccgcttacgtgatgagcgggtccagcgccgacctgtctctcgaaaaggccgctaacgtccagtgggatgagatggcggacatcacaggaagctcccctatcattgaagtgaaacaggatgaggacggctctttcagcatccgcgatgtggaggaaaccaatatgattaccctgcttgttaagctggccctcatcacagtctccgggctgtaccccctcgctattccggtgaccatgacactgtggtatatgtggcaagtgaaaacgcaacggtctggagccctttgggacgtccctagccccgccgctacccagaaggccgcgctgtccgagggcgtgtacagaatcatgcagcgcggcctgtttgggaaaacacaggttggagtgggcatccacatggaaggggtcttccacaccatgtggcatgtgacacggggatctgttatttgtcacgagaccggcagactcgaacctagctgggctgatgtgcgcaacgacatgatctcctatgggggaggctggcggctgggcgataagtgggacaaggaggaggacgtccaagtgcttgccattgaacccgggaaaaatccgaagcatgttcagacgaaacctggactgttcaagaccctcacaggcgagatcggggccgtgaccctggattttaaacccggaacaagcggctctcctattatcaacagaaaggggaaagtcatcggcctctacggaaatggcgtggtgaccaagtccggggactatgtcagcgctattacacaggccgaacgcatcggagagcccgattacgaggttgacgaagatattttccggaagaaaagactgacgatcatggaccttcaccccggcgcggggaagaccaaacggattctgccttctatcgtgcgcgaggctctgaagagacggctccgcacactgattcttgccccgaccagagtggtcgccgctgaaatggaggaagccctgcggggactccccatcagatatcagacccctgctgtgaaatccgagcatacaggccgcgagatcgttgatctgatgtgccacgccacgtttaccacacggctcctgagctccaccagagtgcccaactacaatcttattgtcatggacgaagcgcacttcacagatccttctagcgtggccgctcgcgggtacatctccacccgggttgagatgggcgaagccgctgccatttttatgacggccacaccccctggagctaccgacccgttcccccaaagcaactctcctatcgaggatattgaaagagagatccccgagcgctcctggaataccggctttgactggatcacagactatcaggggaagaccgtgtggttcgtccctagcattaaggcgggaaacgatatcgccaattgcctgcggaaatctggcaagaaagtgattcagctgagcagaaagacatttgacaccgaataccccaaaacgaagctcacagattgggacttcgtcgtgaccacagatatctccgagatgggggctaactttcgcgccggaagagttattgacccgcggcgctgtctgaagcctgtgatccttaccgatggccccgaaagagtgatcctggccgggcccattcctgtcacgcccgcttctgccgcgcaacggcgcggcagaatcggacggaaccctgctcaggaggacgatcagtatgttttcagcggcgacccgctcaaaaatgatgaagaccatgcccactggaccgaggccaagatgctgctggataacatttacacacccgaggggatcattcctaccctcttcggacccgaaagagagaaaacacaggctatcgacggcgaatttcgccttagaggggaacaaagaaagaccttcgtggagctgatgcgccggggagacctgcctgtgtggctctcctataaagtcgcctctgcgggcattagctacaaggatagagaatggtgctttacaggcgagcggaataaccagatcctggaagagaatatggaagtggagatctggacccgcgagggggaaaagaagaaacttagaccccggtggctggacgcccgcgtttatgctgatccgatggccctcaaagacttcaaagagtttgcttccggaagaaaaagcattacgctggatatcctgacagaaattgcctctctccctacctacctttccagccgggctaagctggccctggacaacatcgtgatgctccataccacagagcgcggcgggagagcgtaccagcacgccctgaatgaacttcccgagtccctggagaccctcatgctggtcgctctgctcggagccatgacagctggcattttcctctttttcatgcaggggaagggaatcggcaaactgtctatgggcctgatcacgattgccgtggccagcgggctcctgtgggtcgctgaaatccaacctcagtggattgcggcctccatcattcttgagtttttcctgatggtgctcctgatccccgaacctgagaagcagcggacaccccaggataaccaactgatctatgttattctcgctatccttacaattatcggactgattgccgccaatgaaatgggcctgatcgagaaaaccaagacagactttgggttctaccaggtgaaaaccgagacgaccattctcgatgtcgacctgcgcccggcttctgcctggacactttatgcggtggccaccacaatcctgacccctatgctcagacacacgatcgaaaacacaagcgctaatctgtccctggccgctattgccaaccaggcggccgttctcatgggacttggcaaggggtggcccctgcatcggatggatctgggagtgcccctcctggctatgggctgttacagccaggtcaatcctaccacacttaccgcctctctggtgatgctcctggtgcactatgctatcattggcccggggctgcaagccaaagctaccagagaggcccagaagcgcacagcggccggaatcatgaagaaccccacggttgacggcattaccgtcatcgatctcgaacctatctcctacgaccccaaatttgagaagcagcttgggcaagtgatgctgctggtgctctgcgctggacagctgcttctgatgcggacaacctgggccttctgtgaggtcctcacactggctaccggccctattctgacgctctgggaagggaatcccggaagattctggaacacaaccatcgccgttagcaccgccaacatttttcgcggctcttatcttgcgggcgctgggctggccttctccctgatcaaaaatgctcagacacctcggagaggaaccggcacaacgggggagaccctcggagaaaagtggaaacgccagctgaacagccttgaccggaaggagtttgaagagtacaagagatctggcattctggaggtggatcgcacagaagccaaaagcgccctcaaggacgggtccaaaatcaagcatgctgtgtctcggggaagctccaaaatcagatggattgtcgagcgcggcatggtgaagccgaagggcaaagttgtggatctggggtgcggacggggcgggtggagctactatatggccaccctgaagaatgtcacagaagtgaaaggatacaccaagggcgggcccggacacgaggaacctatccccatggcgacgtatggctggaacctcgttaaacttcattccggcgtggacgtcttctacaagcctaccgagcaagtggatacactgctgtgtgacattggggagtctagctccaatcccaccatcgaagagggaagaacactccgcgtgctgaagatggtcgaaccgtggctttctagcaaacctgagttttgcattaaggttctgaacccctatatgcccaccgtgatcgaggaactcgagaaactgcagagaaagcacggcgggaatctggtgcggtgtcctctctcccgcaactctacacacgaaatgtactgggtcagcggagcctccggcaatattgtgagctctgttaacaccacgtccaaaatgcttctgaatagattcacaacccggcatagaaagcccacctatgagaaagatgtggacctgggggctggaacacggagcgtctctacggaaaccgagaagcctgatatgacaatcatcggccgcagactccagcggctgcaggaggaacacaaggagacctggcattacgaccaagaaaacccgtaccgcacatgggcctatcacggctcctacgaggctcccagcaccgggtctgcctccagcatggtgaatggagttgtgaaacttctgacaaagccttgggatgtcattcccatggtgacccagctcgcgatgacggacaccacaccttttggccagcagagagttttcaaagaaaaggtggacacccggacaccccaaccgaaacctgggacccgcatggtcatgacgacaaccgccaactggctgtgggctctgctcggaaagaagaaaaatcccagactgtgcacacgggaggagtttatctccaaggtgcgcagcaacgccgctattggcgccgtcttccaggaggagcaggggtggacctctgctagcgaagccgtgaatgattccagattttgggagcttgttgacaaagaacgggcgctgcaccaagagggcaagtgtgagtcttgcgtgtataacatgatgggaaaacgcgaaaagaagctcggcgagttcgggagagccaaaggaagccgggctatctggtacatgtggctgggcgcccgctttcttgagttcgaggctctggggttcctcaacgaagatcattggtttggaagagaaaattcctggtctggcgtcgagggggaaggcctgcaccggctgggatatattctcgaggaaatcgacaagaaagatggcgacctgatgtacgccgatgacacggccgggtgggataccagaatcacagaggacgatcttcagaacgaggaactgattaccgagcagatggcgcctcatcacaagatcctcgctaaagccattttcaagctgacatatcagaataaggtggtgaaagttcttcgccccacccctcggggagccgtgatggacatcattagcagaaaggatcaacgcggctccgggcaggtcggaacatacggcctgaacacctttacgaatatggaagtgcagctcatccggcagatggaggctgaaggggttatcacacaagacgacatgcagaaccccaaaggcctgaaggagagagtggagaaatggctgcgcgaatgcggagtcgatcggctcaagagaatggccatttctggcgacgattgtgtggtcaaaccgctggacgagcgcttcgggaccagccttctgtttctcaatgatatgggaaaggtgcggaaggacatccctcagtgggaaccctccaaaggctggaagaactggcaggaggttcccttctgcagccatcactttcacaaaattttcatgaaggatgggagatctctggtggtcccttgtcgcaatcaagacgaacttatcggacgggctagaatttcccagggcgccgggtggagcctgcgggagaccgcgtgcctcggcaaagcctacgctcagatgtggtctctgatgtattttcatagacgcgatctgcggctcgcctccatggctatctgtagcgccgtgccgacagagtggttccccacctccagaacaacgtggtctatccacgcgcatcaccagtggatgaccacagaagacatgctgaaggtttggaaccgcgtgtggattgaggataatcctaacatgatcgacaagacccccgtccacagctgggaagacattccttaccttggaaaaagagaggatctgtggtgcggctccctcatcgggctgagctctcgggccacatgggctaagaatattcataccgccatcacgcaagtgcgcaaccttattggaaaagaagagtatgtggactacatgcccgttatgaagagatattccgctcctagcgagtctgaaggcgtcctgtga

SEQ ID NO: 20983 - RNA, 9867 nt, synthetic construct
  misc_feature 1..9867: note = derived and/or modified CDS sequence (opt5) from DENV-4__GQ199884__SS-prME
  source 1..9867: mol_type = other RNA
agcaccatcaccctgctttgcctgattcccacggtgatggctttccacctttccacccgggacggagagcctctgatgatcgtcgctaagcatgaacgggggcgcccgctcctgtttaagaccaccgaggggattaacaagtgtacccttatcgccatggatctgggcgaaatgtgcgaggacaccgttacatacaagtgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaagcatgcccaacgcgtggagtcttggatccttagaaatcctggcttcgctctgctcgccggctttatggcttacatgatcgggcagacaggcattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctagcatttctaatatcaccacagccacccgctgcccgacgcaaggagagccctatcttaaggaggaacaggaccagcagtacatttgtagacgggatgtggtggaccgcggctgggggaacggatgcggcctgttcgggaaaggaggcgtcgtgacatgcgcgaagttttcctgtagcggcaaaatcaccgggaatctcgttcaaattgagaacctggaatataccgtggtcgtgacagttcataatggagatacccacgccgtgggcaacgacacatctaatcacggggtcacggctaccatcacacctagatcccccagcgtggaggtcaaacttcctgattacggagaactgaccctcgactgcgagccccggtctggcatcgacttcaacgagatgattctgatgaagatgaaaaagaaaacatggctggtgcataagcagtggtttctcgatctgccgcttccttggaccgccggggctgacacgtccgaagttcactggaattacaaagagagaatggtgaccttcaaggtcccccatgccaaacgccaggatgtgacagttctgggcagccaggaaggagccatgcactccgctctcgcgggcgccaccgaggtggactctggggatggaaaccacatgtttgctggccatctgaagtgtaaggtccggatggaaaaacttagaatcaaggggatgagctatacaatgtgctccggaaaattcagcattgacaaggagatggccgagacccaacacggcacgacagtggtgaaagttaagtacgaaggggccggcgctccttgtaaggtccccatcgagattcgcgatgtgaataaagaaaaggtggtcggacgggtgatctcttccacacccctggccgagaacacaaacagcgttaccaatatcgagctcgaacctccgttcggcgactcttatattgtgatcggggtcggaaacagcgcgctgaccctgcattggtttagaaaaggctcctctattgggaagatgttcgagagcacataccgcggagctaaacggatggccatcctcggcgaaacggcctgggattttgggtccgtgggcggactgttcaccagccttggcaaggctgttcaccaggtgtttgggtctgtctatacaaccatgttcggaggcgtgtcctggatgattagaatcctgatcgggtttctcgttctgtggattggaacaaatagccgcaacacctctatggccatgacgtgcatcgctgtgggcgggattacactgttccttggctttaccgtccaggccgacatgggatgtgtggtgtcctggagcggccgggagctcaagtgcgggtccggaatcttcgtcgttgataatgtgcatacctggacagaacaatacaaatttcagcccgagtctcctgcgagactggccagcgctattctgaacgcccacaaggacggcgtgtgtgggatccgctccaccacacggctcgagaatgtcatgtggaaacagattacgaacgaactgaattatgtgctttgggagggaggccacgacctgaccgttgtggctggcgatgtcaagggggtgctcacaaaaggaaagagagccctgacaccccctgtttctgacctgaagtacagctggaaaacatggggcaaggcgaaaatcttcacccccgaagcccggaactccacgtttcttatcgatgggccggacaccagcgagtgccctaatgaacgcagagcttggaactctctcgaggtggaggattacggattcggcatgttcacaaccaatatttggatgaagtttcgggaagggtccagcgaggtctgtgaccatagactgatgtctgccgctatcaaagatcagaaggccgtgcacgccgacatgggatattggattgaatccagcaaaaaccaaacatggcagatcgagaaggcttctctgattgaagttaagacctgcctctggcccaaaacacataccctgtggagcaatggcgtgcttgagtcccagatgctgatccctaagagctacgcgggccccttctctcagcacaactatcgccaagggtacgccacgcagacagtcggaccttggcacctcggcaaactggagatcgattttggggaatgccccggaaccaccgtgacaattcaggaggactgtgatcatcggggcccgtccctgagaaccacgacagctagcgggaaacttgtgacccagtggtgctgtcgctcctgcacaatgcctcccctcagattcctgggagaagacggctgttggtatggcatggagatccggcccctgtctgagaaagaagagaacatggtcaagagccaagttgccgccgggcagggaacctccgaaacattttctatgggcctcctgtgccttaccctgttcgtggaggaatgtctccgcagacgggtgacgcgcaagcacatgattctggctgtcgtgatcaccctgtgcgccattatccttgggggactcacatggatggatctgctgagagcgctcatcatgctgggcgacaccatgagcgggcggattggaggccagacacatcttgctatcatggccgtttttaaaatgtcccctggctacgtgctgggggtcttcctccgcaagctgacctctagagagacggccctgatggtgattggaatggctatgacaaccacacttagcatcccgcacgacctgatggagctcattgatggcatctccctggggctcatcctgcttaaaattgttacccagtttgacaatacccaagtgggaacactggccctcagcctgacgttcatccggtctaccatgtccctggtcatggcgtggcgcacaattatggctgtgctttttgtcgtgaccctgatccccctctgtagaacaagctgcctgcagaagcagtctcattgggttgaaattaccgccctcatcctgggcgcccaagcccttcctgtgtatctgatgacgctcatgaaaggggcctcccggagaagctggcccctgaacgagggaattatggctgtcggcctggtgtctcttctgggctccgccctcctgaagaatgatgttcctctcgcggggcccatggtggccggaggcctgcttctggctgcctacgtcatgagcgggtccagcgctgacctgtctctcgaaaaggccgccaacgtgcagtgggatgagatggctgacatcacaggaagctcccctatcattgaagtgaaacaggatgaggacggctctttcagcatccgcgatgttgaggaaaccaatatgattaccctgcttgtcaagctggcgctcatcacagtgtccgggctgtaccccctcgccattccggtgaccatgacactgtggtatatgtggcaggtcaaaacgcaacggtctggagctctttgggacgtgcctagccccgccgccacccagaaggctgccctgtccgagggcgtttacagaatcatgcagcgcggcctgtttgggaaaacacaggtgggagtcggcatccacatggaaggggtgttccacaccatgtggcatgttacacggggatctgtgatttgtcacgagaccggcagactcgaacctagctgggcggatgtccgcaacgacatgatctcctatgggggaggctggcggctgggcgataagtgggacaaggaggaggacgtgcaagttcttgctattgaacccgggaaaaatccgaagcatgtgcagacgaaacctggactgttcaagaccctcacaggcgagatcggggccgtcaccctggattttaaacccggaacaagcggctctcctattatcaacagaaaggggaaagtgatcggcctctacggaaatggcgtggtcaccaagtccggggactatgttagcgccattacacaggctgaacgcatcggagagcccgattacgaggtggacgaagatattttccggaagaaaagactgacgatcatggaccttcaccccggcgccgggaagaccaaacggattctgccttctatcgtgcgcgaggcgctgaagagacggctccgcacactgattcttgctccgaccagagtcgtggccgccgaaatggaggaagctctgcggggactccccatcagatatcagacccctgccgttaaatccgagcatacaggccgcgagatcgtggatctgatgtgccacgctacgtttaccacacggctcctgagctccaccagagtccccaactacaatcttattgtgatggacgaagcccacttcacagatccttctagcgttgcggcccgcgggtacatctccacccgggtggagatgggcgaagctgccgctatttttatgacggccacaccccctggagccaccgacccgttcccccaaagcaactctcctatcgaggatattgaaagagagatccccgagcgctcctggaataccggctttgactggatcacagactatcaggggaagaccgtctggttcgtgcctagcattaaggctggaaacgatatcgcgaattgcctgcggaaatctggcaagaaagtcattcagctgagcagaaagacatttgacaccgaataccccaaaacgaagctcacagattgggacttcgtggttaccacagatatctccgagatgggggccaactttcgcgctggaagagtgattgacccgcggcgctgtctgaagcctgtgatccttaccgatggccccgaaagagtcatcctggccgggcccattcctgttacgcccgcctctgctgcccaacggcgcggcagaatcggacggaaccctgcgcaggaggacgatcagtatgtgttcagcggcgacccgctcaaaaatgatgaagaccatgctcactggaccgaggccaagatgctgctggataacatttacacacccgaggggatcattcctaccctcttcggacccgaaagagagaaaacacaggccatcgacggcgaatttcgccttagaggggaacaaagaaagaccttcgtggagctgatgcgccggggagacctgcctgtctggctctcctataaagtggcttctgccggcattagctacaaggatagagaatggtgctttacaggcgagcggaataaccagatcctggaagagaatatggaagttgagatctggacccgcgagggggaaaagaagaaacttagaccccggtggctggacgcgcgcgtgtatgccgatccgatggctctcaaagacttcaaagagtttgcctccggaagaaaaagcattacgctggatatcctgacagaaattgcttctctccctacctacctttccagccgggccaagctggctctggacaacatcgtcatgctccataccacagagcgcggcgggagagcctaccagcacgcgctgaatgaacttcccgagtccctggagaccctcatgctggtggccctgctcggagctatgacagccggcattttcctctttttcatgcaggggaagggaatcggcaaactgtctatgggcctgatcacgattgctgtcgccagcgggctcctgtgggtggccgaaatccaacctcagtggattgctgcgtccatcattcttgagtttttcctgatggttctcctgatccccgaacctgagaagcagcggacaccccaggataaccaactgatctatgtgattctcgccatccttacaattatcggactgattgctgccaatgaaatgggcctgatcgagaaaaccaagacagactttgggttctaccaggtcaaaaccgagacgaccattctcgatgtggacctgcgcccggcctctgcttggacactttatgccgttgcgaccacaatcctgacccctatgctcagacacacgatcgaaaacacaagcgccaatctgtccctggctgccattgctaaccaggccgcggtgctcatgggacttggcaaggggtggcccctgcatcggatggatctgggagtccccctcctggccatgggctgttacagccaggtgaatcctaccacacttaccgcttctctggtgatgctcctggttcactatgccatcattggcccggggctgcaagctaaagccaccagagaggctcagaagcgcacagccgcgggaatcatgaagaaccccacggtcgacggcattaccgtgatcgatctcgaacctatctcctacgaccccaaatttgagaagcagcttgggcaagtgatgctgctggtcctctgcgccggacagctgcttctgatgcggacaacctgggctttctgtgaggttctcacactggccaccggccctattctgacgctctgggaagggaatcccggaagattctggaacacaaccatcgctgtgagcaccgccaacatttttcgcggctcttatcttgccggcgcggggctggctttctccctgatcaaaaatgcccagacacctcggagaggaaccggcacaacgggggagaccctcggagaaaagtggaaacgccagctgaacagccttgaccggaaggagtttgaagagtacaagagatctggcattctggaggtggatcgcacagaagctaaaagcgccctcaaggacgggtccaaaatcaagcatgccgtctctcggggaagctccaaaatcagatggattgtggagcgcggcatggttaagccgaagggcaaagtggtcgatctggggtgcggacggggcgggtggagctactatatggctaccctgaagaatgtgacagaagttaaaggatacaccaagggcgggcccggacacgaggaacctatccccatggccacgtatggctggaacctcgtgaaacttcattccggcgtcgacgtgttctacaagcctaccgagcaagtggatacactgctgtgtgacattggggagtctagctccaatcccaccatcgaagagggaagaacactccgcgtcctgaagatggttgaaccgtggctttctagcaaacctgagttttgcattaaggtgctgaacccctatatgcccaccgtgatcgaggaactcgagaaactgcagagaaagcacggcgggaatctggtccggtgtcctctctcccgcaactctacacacgaaatgtactgggtgagcggagcgtccggcaatattgttagctctgtgaacaccacgtccaaaatgcttctgaatagattcacaacccggcatagaaagcccacctatgagaaagatgtcgacctgggggccggaacacggagcgtgtctacggaaaccgagaagcctgatatgacaatcatcggccgcagactccagcggctgcaggaggaacacaaggagacctggcattacgaccaagaaaacccgtaccgcacatgggcttatcacggctcctacgaggcccccagcaccgggtctgcttccagcatggttaatggagtggtcaaacttctgacaaagccttgggatgtgattcccatggttacccagctcgccatgacggacaccacaccttttggccagcagagagtgttcaaagaaaaggtcgacacccggacaccccaaccgaaacctgggacccgcatggtgatgacgacaaccgcgaactggctgtgggccctgctcggaaagaagaaaaatcccagactgtgcacacgggaggagtttatctccaaggtccgcagcaacgctgccattggcgctgtgttccaggaggagcaggggtggacctctgccagcgaagctgttaatgattccagattttgggagcttgtggacaaagaacgggccctgcaccaagagggcaagtgtgagtcttgcgtctataacatgatgggaaaacgcgaaaagaagctcggcgagttcgggagagcgaaaggaagccgggccatctggtacatgtggctgggcgctcgctttcttgagttcgaggccctggggttcctcaacgaagatcattggtttggaagagaaaattcctggtctggcgtggagggggaaggcctgcaccggctgggatatattctcgaggaaatcgacaagaaagatggcgacctgatgtacgctgatgacacggccgggtgggataccagaatcacagaggacgatcttcagaacgaggaactgattaccgagcagatggcccctcatcacaagatcctcgcgaaagctattttcaagctgacatatcagaataaggtggttaaagtgcttcgccccacccctcggggagccgtcatggacatcattagcagaaaggatcaacgcggctccggacaggtgggaacatacggcctgaacacctttacgaatatggaagttcagctcatccggcagatggaggccgaaggggtgatcacacaagacgacatgcagaaccccaaaggcctgaaggagagagtcgagaaatggctgcgcgaatgcggagtggatcggctcaagagaatggctatttctggcgacgattgtgtcgtgaaaccgctggacgagcgcttcgggaccagccttctgtttctcaatgatatgggaaaggttcggaaggacatccctcagtgggaaccctccaaaggctggaagaactggcaggaggtgcccttctgcagccatcactttcacaaaattttcatgaaggatgggagatctctggtcgtgccttgtcgcaatcaagacgaacttatcggacgggccagaatttcccagggcgctgggtggagcctgcgggagaccgcctgcctcggcaaagcgtacgcccagatgtggtctctgatgtattttcatagacgcgatctgcggctcgcttccatggccatctgtagcgctgttccgacagagtggttccccacctccagaacaacgtggtctatccacgcccatcaccagtggatgaccacagaagacatgctgaaggtgtggaaccgcgtctggattgaggataatcctaacatgatcgacaagacccccgtgcacagctgggaagacattccttaccttggaaaaagagaggatctgtggtgcggctccctcatcgggctgagctctcgggcgacatgggccaagaatattcataccgctatcacgcaagtgcgcaaccttattggaaaagaagagtatgttgactacatgcccgtcatgaagagatattccgcccctagcgagtctgaaggcgtgctgtga

SEQ ID NO: 20984 - RNA, 9867 nt, synthetic construct
  misc_feature 1..9867: note = derived and/or modified CDS sequence (opt5) from DENV-4__FJ882595__SS-prME
  source 1..9867: mol_type = other RNA
agcaccatcaccctgctttgcctgattcccacggccatggctttccacctttccaccagagacggagagcctctgatgatcgtggccaagcatgaacgggggcgcccgctcctgtttaagacaaccgagggaattaacaagtgtacccttatcgcgatggatctgggagaaatgtgcgaggacaccgtgacatacaagtgtcccctcctggttaataccgaacctgaggatattgactgctggtgtaacctgacgtctacctgggtgatgtatgggacatgcacccagagcggagagagacggcgcgaaaagagatccgtggctctcacaccccactctggcatggggctggagacccgggccgaaacgtggatgagctccgagggagcctggaagcatgctcagcgcgtcgagtcttggatccttagaaatcctggcttcgccctgctcgctggctttatggcctacatgatcgggcagacaggcattcagcggaccgtgttctttgttctgatgatgcttgtggcgcccagctatggcatgcgctgtgtcggggtgggaaacagagatttcgttgaaggcgtgtccgggggagcctgggtcgacctggtgctcgagcacggcggctgcgtgacaaccatggctcaggggaagcctaccctggattttgaactgacaaagacgaccgccaaagaggtcgctctcctgcggacatactgtatcgaagccagcatttctaatatcaccacagcgacccgctgcccgacgcaaggagagccctatcttaaggaggaacaggaccagcagtacatttgtagacgggatgttgtggaccgcggctgggggaacggatgcggcctgttcgggaaaggaggcgtggtcacatgcgccaagttttcctgtagcggcaaaatcaccgggaatctcgtgcaaattgagaacctggaatataccgttgtggtcacagtgcataatggagatacccacgctgttggcaacgacacatctaatcacggggtgacggccaccatcacacctagatcccccagcgtcgaggtgaaacttcctgattacggagaactgaccctcgactgcgagccccggtctggcatcgacttcaacgagatgattctgatgaagatgaaaaagaaaacatggctggtccataagcagtggtttctcgatctgccgcttccttggaccgctggggccgacacgtccgaagtgcactggaattacaaagagagaatggttaccttcaaggtgccccatgccaaacgccaggatgtcacagtgctgggcagccaggaaggagctatgcactccgcgctcgccggcgctaccgaggttgactctggggatggaaaccacatgtttgccggccatctgaagtgtaaggtgcggatggaaaaacttagaatcaaggggatgagctatacaatgtgctccggaaaattcagcattgacaaggagatggccgagacccaacacggcacgacagtcgtgaaagtgaagtacgaaggggctggcgccccttgtaaggttcccatcgagattcgcgatgtcaataaagaaaaggtggtgggacgggtcatctcttccacacccctggcggagaacacaaacagcgtgaccaatatcgagctcgaacctccgttcggcgactcttatattgttatcggggtgggaaacagcgctctgaccctgcattggtttagaaaaggctcctctattgggaagatgttcgagagcacataccgcggagccaaacggatggccatcctcggcgaaacggcttgggattttgggtccgtcggcggactgttcaccagccttggcaaggccgtgcaccaggtttttgggtctgtgtatacaaccatgttcggaggcgtctcctggatgattagaatcctgatcgggtttctcgtgctgtggattggaacaaatagccgcaacacctctatggctatgacgtgcatcgccgttggcgggattacactgttccttggctttaccgtgcaggcggacatgggatgtgtcgtgtcctggagcggccgggagctcaagtgcgggtccggaatcttcgtggtcgataatgttcatacctggacagaacaatacaaatttcagcccgagtctcctgccagactggctagcgccattctgaacgctcacaaggacggcgtgtgtgggatccgctccaccacacggctcgagaatgtgatgtggaaacagattacgaacgaactgaattatgtcctttgggagggaggccacgacctgaccgtggttgccggcgatgtgaagggggtcctcacaaaaggaaagagagcgctgacaccccctgtgtctgacctgaagtacagctggaaaacatggggcaaggccaaaatcttcacccccgaagctcggaactccacgtttcttatcgatgggccggacaccagcgagtgccctaatgaacgcagagcctggaactctctcgaggttgaggattacggattcggcatgttcacaaccaatatttggatgaagtttcgggaagggtccagcgaggtgtgtgaccatagactgatgtctgctgccatcaaagatcagaaggccgtccacgctgacatgggatattggattgaatccagcaaaaaccaaacatggcagatcgagaaggcgtctctgattgaagtgaagacctgcctctggcccaaaacacataccctgtggagcaatggcgttcttgagtcccagatgctgatccctaagagctacgccggccccttctctcagcacaactatcgccaagggtacgctacgcagacagtgggaccttggcacctcggcaaactggagatcgattttggggaatgccccggaaccaccgtcacaattcaggaggactgtgatcatcggggcccgtccctgagaaccacgacagccagcgggaaacttgtgacccagtggtgctgtcgctcctgcacaatgcctcccctcagattcctgggagaagacggctgttggtatggcatggagatccggcccctgtctgagaaagaagagaacatggtcaagagccaagtcgccgctgggcagggaacctccgaaacattttctatgggcctcctgtgccttaccctgttcgttgaggaatgtctccgcagacgggtgacgcgcaagcacatgattctggccgtggtcatcaccctgtgcgcgattatccttgggggactcacatggatggatctgctgagagctctcatcatgctgggcgacaccatgagcgggcggattggaggccagacacatcttgccatcatggccgtgtttaaaatgtcccctggctacgttctgggggtgttcctccgcaagctgacctctagagagacggctctgatggtcattggaatggccatgacaaccacacttagcatcccgcacgacctgatggagctcattgatggcatctccctggggctcatcctgcttaaaattgtgacccagtttgacaatacccaagttggaacactggcgctcagcctgacgttcatccggtctaccatgtccctggtgatggcttggcgcacaattatggccgtcctttttgtggtcaccctgatccccctctgtagaacaagctgcctgcagaagcagtctcattgggtggaaattaccgccctcatcctgggcgctcaagcccttcctgtttatctgatgacgctcatgaaaggggcttcccggagaagctggcccctgaacgagggaattatggccgtgggcctggtctctcttctgggctccgcgctcctgaagaatgatgtgcctctcgccgggcccatggttgctggaggcctgcttctggccgcttacgtgatgagcgggtccagcgccgacctgtctctcgaaaaggccgctaacgtccagtgggatgagatggcggacatcacaggaagctcccctatcattgaagtgaaacaggatgaggacggctctttcagcatccgcgatgtggaggaaaccaatatgattaccctgcttgttaagctggccctcatcacagtctccgggctgtaccccctcgctattccggtgaccatgacactgtggtatatgtggcaagtgaaaacgcaacggtctggagccctttgggacgtccctagccccgccgctacccagaaggccgcgctgtccgagggcgtgtacagaatcatgcagcgcggcctgtttgggaaaacacaggttggagtgggcatccacatggaaggggtcttccacaccatgtggcatgtgacacggggatctgttatttgtcacgagaccggcagactcgaacctagctgggctgatgtgcgcaacgacatgatctcctatgggggaggctggcggctgggcgataagtgggacaaggaggaggacgtccaagtgcttgccattgaacccgggaaaaatccgaagcatgttcagacgaaacctggactgttcaagaccctcacaggcgagatcggggccgtgaccctggattttaaacccggaacaagcggctctcctattatcaacagaaaggggaaagtcatcggcctctacggaaatggcgtggtgaccaagtccggggactatgtcagcgctattacacaggccgaacgcatcggagagcccgattacgaggttgacgaagatattttccggaagaaaagactgacgatcatggaccttcaccccggcgcggggaagaccaaacggattctgccttctatcgtgcgcgaggctctgaagagacggctccgcacactgattcttgccccgaccagagtggtcgccgctgaaatggaggaagccctgcggggactccccatcagatatcagacccctgctgtgaaatccgagcatacaggccgcgagatcgttgatctgatgtgccacgccacgtttaccacacggctcctgagctccaccagagtgcccaactacaatcttattgtcatggacgaagcgcacttcacagatccttctagcgtggccgctcgcgggtacatctccacccgggttgagatgggcgaagccgctgccatttttatgacggccacaccccctggagctaccgacccgttcccccaaagcaactctcctatcgaggatattgaaagagagatccccgagcgctcctggaataccggctttgactggatcacagactatcaggggaagaccgtgtggttcgtccctagcattaaggcgggaaacgatatcgccaattgcctgcggaaatctggcaagaaagtgattcagctgagcagaaagacatttgacaccgaataccccaaaacgaagctcacagattgggacttcgtcgtgaccacagatatctccgagatgggggctaactttcgcgccggaagagttattgacccgcggcgctgtctgaagcctgtgatccttaccgatggccccgaaagagtgatcctggccgggcccattcctgtcacgcccgcttctgccgcgcaacggcgcggcagaatcggacggaaccctgctcaggaggacgatcagtatgttttcagcggcgacccgctcaaaaatgatgaagaccatgcccactggaccgaggccaagatgctgctggataacatttacacacccgaggggatcattcctaccctcttcggacccgaaagagagaaaacacaggctatcgacggcgaatttcgccttagaggggaacaacggaagaccttcgtggagctgatgcgccggggagacctgcctgtgtggctctcctataaagtcgcctctgcgggcattagctacaaggatagagaatggtgctttacaggcgagcggaataaccagatcctggaagagaatatggaagtggagatctggacccgcgagggggaaaagaagaaacttagaccccggtggctggacgcccgcgtttatgctgatccgatggccctcaaagacttcaaagagtttgcttccggaagaaaaagcattacgctggatatcctgacagaaattgcctctctccctacctacctttccagccgggctaagctggccctggacaacatcgtgatgctccataccacagagcgcggcgggagagcgtaccagcacgccctgaatgaacttcccgagtccctggagaccctcatgctggtcgctctgctcggagccatgacagctggcattttcctctttttcatgcaggggacgggaatcggcaagctgtctatgggcctgatcaccattgccgtggccagcgggctcctgtgggtcgctgaaatccaacctcagtggattgcggcctccatcattcttgagtttttcctgatggtgctcctgatccccgaacctgagaaacagcggacaccccaggataaccaactgatctatgttattctcaccatccttacaattatcggactgattgctgccaatgaaatgggcctgatcgagaagaccaaaacggactttgggttctaccaggtgaagaccgagacaaccattctcgatgtcgacctgcgcccggcctctgcttggacactttatgccgtggcgaccacgatcctgacacctatgctcagacacaccatcgaaaacacaagcgccaatctgtccctggctgccattgctaaccaggccgcggttctcatgggacttggcaaagggtggcccctgcatcggatggatctgggagtgcccctcctggccatgggctgttacagccaggtcaatcctaccacccttacagcttctctggtgatgctcctggtgcactatgccatcattggcccggggctgcaagctaaggccacgagagaggctcagaaacgcaccgccgcgggaatcatgaagaaccccacagttgacggcattaccgtcatcgatctcgaacctatctcctacgaccccaagtttgagaaacagcttgggcaagtgatgctgctggtgctctgcgccggacagctgcttctgatgcggacaacctgggctttctgtgaggtcctcacgctggccacaggccctattctgaccctctgggaagggaatcccggaagattctggaacaccacaatcgctgttagcaccgccaacatttttcgcggctcttatcttgccggcgcggggctggctttctccctgatcaagaatgcccagacacctcggagaggaacgggcaccacaggggagaccctcggagaaaaatggaagcgccagctgaacagccttgaccggaaagagtttgaagagtacaagagatctggcattctggaggtggatcgcacagaagctaagagcgccctcaaagacgggtccaagatcaaacatgccgtgtctcggggaagctccaagatcagatggattgtcgagcgcggcatggtgaaaccgaagggcaaggttgtggatctggggtgcggacggggcgggtggagctactatatggctaccctgaaaaatgtcacggaagtgaagggatacaccaaaggcgggcccggacacgaggaacctatccccatggccacatatggctggaacctcgttaaacttcattccggcgtggacgtcttctacaaacctaccgagcaagtggatacactgctgtgtgacattggggagtctagctccaatcccaccatcgaagagggaagaacactccgcgtgctgaagatggtcgaaccgtggctttctagcaagcctgagttttgcattaaagttctgaacccctatatgcccaccgtgatcgaggaactcgagaagctgcagagaaaacacggcgggaatctggtgcggtgtcctctctcccgcaactctacgcacgaaatgtactgggtcagcggagcgtccggcaatattgtgagctctgttaacacaacctccaagatgcttctgaatagattcaccacacggcatagaaaacccacgtatgagaaggatgtggacctgggggccggaacccggagcgtctctacagaaaccgagaaacctgatatgacaatcatcggccgcagactccagcggctgcaggaggaacacaaggagacctggcattacgaccaagaaaacccgtaccgcacatgggcttatcacggctcctacgaggcccccagcaccgggtctgcttccagcatggtgaatggagttgtgaaacttctgacgaaaccttgggatgtcattcccatggtgacccagctcgccatgacagacaccacaccttttggccagcagagagttttcaaggaaaaagtggacacccggacgccccaaccgaagcctgggacacgcatggtcatgaccacaaccgcgaactggctgtgggccctgctcggcaagaagaagaatcccagactgtgcacgcgggaggagtttatctccaaagtgcgcagcaacgctgccattggcgctgtcttccaggaggaacaggggtggacctctgccagcgaagctgtgaatgattccagattttgggagcttgttgacaaggaacgggccctgcaccaagagggcaaatgtgagtcttgcgtgtataacatgatgggaaagcgcgagaagaagctcggcgagttcgggagagcgaagggaagccgggccatctggtacatgtggctgggcgctcgctttcttgagttcgaggccctggggttcctcaacgaagatcattggtttggaagagaaaattcctggtctggcgtcgagggggaaggcctgcaccggctgggatatattctcgaggaaatcgacaaaaaggatggcgacctgatgtacgctgatgacacagccgggtgggataccagaatcacagaggacgatcttcagaacgaggaactgattaccgagcagatggcccctcatcacaaaatcctcgcgaaggctattttcaaactgacatatcagaataaggtggtgaaggttcttcgccccacccctcggggagccgtgatggacatcattagcagaaaagatcaacgcggctccgggcaggtcggaacgtacggcctgaacacatttaccaatatggaagtgcagctcatccggcagatggaggccgaaggggttatcacccaagacgacatgcagaaccccaagggcctgaaagagagagtggagaagtggctgcgcgaatgcggagtcgatcggctcaaaagaatggctatttctggcgacgattgtgtggtcaagccgctggacgagcgcttcgggacaagccttctgtttctcaatgatatgggaaaagtgcggaaggacatccctcagtgggaaccctccaagggctggaaaaactggcaggaggttcccttctgcagccatcactttcacaagattttcatgaaagatgggagatctctggtggtcccttgtcgcaatcaagacgaacttatcggacgggccagaatttcccagggcgctgggtggagcctgcgggagaccgcctgcctcggcaaggcgtacgcccagatgtggtctctgatgtattttcatagacgcgatctgcggctcgcttccatggccatctgtagcgctgtgccgacagagtggttccccacgtccagaaccacatggtctatccacgcccatcaccagtggatgaccacagaagacatgctgaaagtttggaaccgcgtgtggattgaggataatcctaacatgatcgacaagacccccgtccacagctgggaagacattccttaccttggaaagagagaggatctgtggtgcggctccctcatcgggctgagctctcgggcgacgtgggccaaaaatattcataccgctatcacacaagtgcgcaaccttattggaaaggaagagtatgtggactacatgcccgttatgaaaagatattccgcccctagcgagtctgaaggcgtcctgtga

SEQ ID NO: 20985 - RNA, 9867 nt, synthetic construct
  misc_feature 1..9867: note = derived and/or modified CDS sequence (opt5) from DENV-4__FJ882596__SS-prME
  source 1..9867: mol_type = other RNA
agcaccatcacactgctctgcctgattcccacggtgatggccttccacctttccaccagagacggcgagcctctgatgatcgtcgctaagcatgaacgggggcgcccgctcctgtttaaaacaaccgagggaattaacaagtgtacacttatcgccatggatctgggcgaaatgtgcgaggacaccgttacatacaaatgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggatccttagaaatcctggcttcgctctgctcgccggctttatggcttacatgatcgggcagacaggaattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctagcatttctaatatcaccacagccacccgctgcccgacgcaaggagagccctatcttaaggaggaacaggaccagcagtacatttgtagacgggatgtggtggaccgcggctgggggaacggatgcggcctgttcgggaaaggaggcgtcgtgacatgcgcgaagttttcctgtagcggcaaaatcaccgggaatctcgttcaaattgagaacctggaatataccgtggtcgtgacagttcataatggagatacccacgccgtgggcaacgacacatctaatcacggggtcacggctaccatcacacctagatcccccagcgtggaggtcaagcttcctgattacggagaactgaccctcgactgcgagccccggtctggcatcgacttcaacgagatgattctgatgaagatgaaaaagaaaacatggctggtgcataagcagtggtttctcgatctgccgcttccttggaccgccggggctgacacgtccgaagttcactggaattacaaagagagaatggtgaccttcaaggtcccccatgccaaacgccaggatgtgacagttctgggcagccaggaaggagccatgcactccgctctcgcgggcgccaccgaggtggactctggggatggaaaccacatgtttgctggccatctgaagtgtaaggtccggatggaaaaacttagaatcaaggggatgagctatacaatgtgctccggaaaattcagcattgacaaggagatggccgagacccaacacggcacgacagtggtgaaagttaagtacgaaggggccggcgctccttgtaaggtccccatcgagattcgcgatgtgaataaagaaaaggtggtcggacgggtgatctcttccacccccctggccgagaacacaaacagcgttaccaatatcgagctcgaacctccgttcggcgactcttatattgtgatcggggtcggaaacagcgcgctgaccctgcattggtttagaaaaggctcctctattgggaagatgttcgagagcacataccgcggagctaaacggatggccatcctcggcgaaacggcctgggattttgggtccgtgggcggactgttcaccagccttggcaaggctgttcaccaggtgtttgggtctgtctatacaaccatgttcggaggcgtgtcctggatgattagaatcctgatcgggtttctcgttctgtggattggaacaaatagccgcaacacctctatggccatgacgtgcatcgctgtgggcgggattacactgttccttggctttaccgtccaggccgacatgggatgtgtggtgtcctggagcggccgggagctcaagtgcgggtccggaatcttcgtcgttgataatgtgcatacctggacagaacaatacaaatttcagcccgagtctcctgcgagactggccagcgctattctgaacgcccacaaggacggcgtgtgtgggatccgctccaccacacggctcgagaatgtcatgtggaaacagattacgaacgaactgaattatgtgctttgggagggaggccacgacctgaccgttgtggctggcgatgtcagaggggtgctcacaaagggaaaacgggccctgaccccccctgtttctgacctgaagtacagctggaagacatggggcaaagcgaagatcttcacccccgaagcccgcaactccacgtttcttatcgatgggccggacaccagcgagtgccctaatgaaagacgggcttggaactctctcgaggtggaggattacggattcggcatgttcacaaccaatatttggatgaaatttagagaagggtccagcgaggtctgtgaccatcgcctgatgtctgccgctatcaaggatcagaaagccgtgcacgccgacatgggatattggattgaatccagcaagaaccaaacatggcagatcgagaaagcttctctgattgaagttaagacctgcctctggcccaagacacataccctgtggagcaatggcgtgcttgagtcccagatgctgatccctaaaagctacgcgggccccttctctcagcacaactatcggcaagggtacgccacgcagacagtcggaccttggcacctcggcaagctggagatcgattttggggaatgccccggaaccaccgtgacaattcaggaggactgtgatcatagaggcccgtccctgcgcaccacgacagctagcgggaaacttgtgacccagtggtgctgtagatcctgcacaatgcctcccctccggttcctgggagaagacggctgttggtatggcatggagatccgccccctgtctgagaaggaagagaacatggtcaaaagccaagttgccgccgggcagggaacctccgaaacattttctatgggcctcctgtgccttaccctgttcgtggaggaatgtctcagacggcgcgtgacgagaaagcacatgattctggctgtcgtgatcaccctgtgcgccattatccttgggggactcacatggatggatctgctgcgggcgctcatcatgctgggcgacaccatgagcgggcgcattggaggccagacacatcttgctatcatggccgtttttaagatgtcccctggctacgtgctgggggtcttcctcagaaaactgacctctcgggagacggccctgatggtgattggaatggctatgacaaccacacttagcatcccgcacgacctgatggagctcattgatggcatctccctggggctcatcctgcttaagattgttacccagtttgacaatacccaagtgggaacactggccctcagcctgacgttcatccgctctaccatgtccctggtcatggcgtggagaacaattatggctgtgctttttgtcgtgaccctgatccccctctgtcggacaagctgcctgcagaaacagtctcattgggttgaaattaccgccctcatcctgggcgcccaagctcttcctgtgtatctgatgacgctcatgaagggggcctccagacgcagctggcccctgaacgagggaattatggctgtcggcctggtgtctcttctgggctccgccctcctgaaaaatgatgttcctctcgcggggcccatggtggccggaggcctgcttctggctgcctacgtcatgagcgggtccagcgctgacctgtctctcgaaaaggccgccaacgtgcagtgggatgagatggctgacatcacaggaagctcccctatcattgaagtgaagcaggatgaggacggctctttcagcatccgggatgttgaggaaaccaatatgattaccctgcttgtcaaactggcgctcatcacagtgtccgggctgtaccccctcgccattccggtgaccatgacactgtggtatatgtggcaggtcaagacgcaaagatctggagctctttgggacgtgcctagccccgccgccacccagaaagctgccctgtccgagggcgtttaccgcatcatgcagcggggcctgtttgggaagacacaggtgggagtcggcatccacatggaaggggtgttccacaccatgtggcatgttacaagaggatctgtgatttgtcacgagaccggccgcctcgaacctagctgggcggatgtccggaacgacatgatctcctatgggggaggctggagactgggcgataaatgggacaaggaggaggacgtgcaagttcttgctattgaacccgggaagaatccgaaacatgtgcagacgaagcctggactgttcaaaaccctcacaggcgagatcggggccgtcaccctggattttaagcccggaacaagcggctctcctattatcaaccgcaaagggaaggtgatcggcctctacggaaatggcgtggtcaccaaatccggggactatgttagcgccattacacaggctgaacggatcggagagcccgattacgaggtggacgaagatattttcagaaagaagcggctgacgatcatggaccttcaccccggcgccgggaaaaccaagcgcattctgccttctatcgtgagagaggcgctgaaacggcgcctcagaacactgattcttgctccgacccgggtcgtggccgccgaaatggaggaagctctgagaggactccccatccgctatcagacccctgccgttaagtccgagcatacaggccgggagatcgtggatctgatgtgccacgctacgtttaccacaagactcctgagctccacccgcgtccccaactacaatcttattgtgatggacgaagcccacttcacagatccttctagcgttgcggcccgggggtacatctccaccagagtggagatgggcgaagctgccgctatttttatgacggccacaccccctggagccaccgacccgttcccccaaagcaactctcctatcgaggatattgaacgcgagatccccgagcggtcctggaataccggctttgactggatcacagactatcaggggaaaaccgtctggttcgtgcctagcattaaggctggaaacgatatcgcgaattgcctgagaaagtctggcaaaaaggtcattcagctgagccgcaaaacatttgacaccgaataccccaagacgaaactcacagattgggacttcgtggttaccacagatatctccgagatgggggccaactttagagctggacgggtgattgacccgcgcagatgtctgaagcctgtgatccttaccgatggccccgaacgggtcatcctggccgggcccattcctgttacgcccgcctctgctgcccaacgcagaggccggatcggaagaaaccctgcgcaggaggacgatcagtatgtgttcagcggcgacccgctcaagaatgatgaagaccatgctcactggaccgaggccaaaatgctgctggataacatttacacacccgaggggatcattcctaccctcttcggacccgaacgcgagaagacacaggccatcgacggcgaatttcggcttagaggggagcaacgcaaaaccttcgtggagctgatgcggagaggagacctgcctgtctggctctcctataaggtggcttctgccggcattagctacaaagatcgggaatggtgctttacaggcgagcgcaataaccagatcctggaagagaatatggaagttgagatctggaccagagagggggaaaagaagaaacttcggccccgctggctggacgcgagagtgtatgccgatccgatggctctcaaggacttcaaagagtttgcctccggacggaagagcattacgctggatatcctgacagaaattgcttctctccctacctacctttccagccgcgccaaactggctctggacaacatcgtcatgctccataccacagagagaggcgggcgggcctaccagcacgcgctgaatgaacttcccgagtccctggagaccctcatgctggtggccctgctcggagctatgacagccggcattttcctttttttcatgcaggggaagggaatcggcaagctgtctatgggcctgatcacgattgctgtcgccagcgggctcctgtgggtggccgaaatccaacctcagtggattgctgcgtccatcattcttgagtttttcctgatggttctcctgatccccgaacctgagaaacagcgcaccccccaggataaccaactgatctatgtgattctcacaatccttaccattatcggactgattgccgctaatgaaatgggcctgatcgagaagacaaaaaccgactttgggttctaccaggtcaagacggagaccacaattctcgatgtggacctgagaccggcctctgcctggaccctttatgctgttgccacaaccatcctgacgcctatgctccggcacacaatcgaaaacaccagcgcgaatctgtccctggccgctattgccaaccaggctgccgtgctcatgggacttggcaaagggtggcccctgcatagaatggatctgggagtccccctcctggcgatgggctgttacagccaggtgaatcctacaacccttaccgcctctctggtgatgctcctggttcactatgctatcattggcccggggctgcaagccaaggctacacgcgaggcccagaaacggacggctgccggaatcatgaagaaccccaccgtcgacggcattacagtgatcgatctcgaacctatctcctacgaccccaagtttgagaaacagcttgggcaagtgatgctgctggtcctctgcgcgggacagctgcttctgatgagaaccacatgggccttctgtgaggttctcaccctggctacgggccctattctgacactctgggaagggaatcccggacgcttctggaacaccaccatcgccgtgagcacagctaacatttttcggggctcttatcttgccggcgccgggctggcgttctccctgatcaagaatgctcagacccctagacgcggaacaggcacgaccggggagacactcggagaaaaatggaagcggcagctgaacagccttgacagaaaagagtttgaagagtacaagcgctctggcattctggaggtggatcggaccgaagccaagagcgctctcaaagacgggtccaagatcaaacatgccgtctctagaggaagctccaagatccgctggattgtggagcggggcatggttaaaccgaagggcaaggtggtcgatctggggtgcggaagaggcgggtggagctactatatggccacactgaaaaatgtgaccgaagttaagggatacacgaaaggcgggcccggacacgaggaacctatccccatggctacctatggctggaacctcgtgaagcttcattccggcgtcgacgtgttctacaaacctacagagcaagtggataccctgctgtgtgacattggggagtctagctccaatcccacaatcgaagagggacgcaccctcagagtcctgaagatggttgaaccgtggctttctagcaagcctgagttttgcattaaagtgctgaacccctatatgcccacagtgatcgaagagctcgagaagctgcagcggaaacacggcgggaatctggtccgctgtcctctctccagaaactctacccacgaaatgtactgggtgagcggagcctccggcaatattgttagctctgtgaacacgacatccaagatgcttctgaatcggttcaccaccagacatcggaaacccacatatgagaaggatgtcgacctgggggcgggaacgcgcagcgtgtctaccgaaacagagaaacctgatatgaccatcatcggcagacggctccagcgcctgcaggaggaacacaaggagacatggcattacgaccaagaaaacccgtacagaacctgggcctatcacggctcctacgaggctcccagcacagggtctgcctccagcatggttaatggagtggtcaagcttctgaccaaaccttgggatgtgattcccatggttacgcagctcgctatgaccgacacaaccccttttggccagcagcgggtgttcaaggaaaaagtcgacacacgcaccccccaaccgaagcctgggacgagaatggtgatgacaaccacagccaactggctgtgggcgctgctcggaaaaaagaagaatccccggctgtgcacccgcgaggagtttatctccaaagtcagaagcaacgccgctattggcgccgtgttccaggaagagcaggggtggacgtctgctagcgaagccgttaatgattcccggttttgggagcttgtggacaaggaacgcgctctgcaccaagagggcaaatgtgagtcttgcgtctataacatgatgggaaagagagaaaaaaagctcggcgagttcgggcgggccaagggaagccgcgcgatctggtacatgtggctgggcgccagatttcttgaattcgaggctctggggttcctcaacgaagatcattggtttggacgggagaattcctggtctggcgtggagggggaaggcctgcacagactgggatatattctcgaggaaatcgacaaaaaggatggcgacctgatgtacgccgatgacaccgctgggtgggatacacgcatcaccgaggacgatcttcagaacgaggaactgattacagagcagatggcccctcatcacaaaatcctcgccaaggcgattttcaaactgacctatcagaataaggtggttaaggtgcttcggcccacacctagaggagctgtcatggacatcattagccgcaaagatcaacggggctccgggcaggtgggaacctacggcctgaacacgtttacaaatatggaagttcagctcatcagacagatggaggccgaaggggtgatcacccaagacgacatgcagaaccccaagggcctgaaagagcgcgtcgagaagtggctgcgggaatgcggagtggatagactcaaacgcatggccatttctggcgacgattgtgtcgtgaagccgctggacgagcggttcgggaccagccttctgtttctcaatgatatgggaaaagttagaaaggacatccctcagtgggaaccctccaagggctggaaaaactggcaggaggtgcccttctgcagccatcactttcacaagattttcatgaaagatgggcgctctctggtcgtgccttgtcggaatcaagacgaacttatcggaagagctcggatttcccagggcgccgggtggagcctgagagagacagcttgcctcggcaaggcctacgcgcagatgtggtctctgatgtattttcatcgccgggatctgagactcgcctccatggctatctgtagcgccgttccgaccgagtggttccccacatcccgcacgacctggtctatccacgctcatcaccagtggatgacaaccgaagacatgctgaaagtgtggaacagagtctggattgaggataatcctaacatgatcgacaagacacccgtgcacagctgggaagacattccttaccttggaaagcgggaggatctgtggtgcggctccctcatcgggctgagctctcgcgccacctgggcgaaaaatattcatacggccatcacccaagtgagaaaccttattggaaaggaagagtatgttgactacatgcccgtcatgaaacggtattccgctcctagcgagtctgaaggcgtgctgtga

SEQ ID NO: 20986 - RNA, 9867 nt, synthetic construct
  misc_feature 1..9867: note = derived and/or modified CDS sequence (opt5) from DENV-4__FJ850059__SS-prME
  source 1..9867: mol_type = other RNA
agcaccatcacactgctttgcctgattcccacggtgatggccttccacctttccaccagagacggagagcctctgatgatcgtcgctaagcatgaacgggggcgcccgctcctgtttaagaccaccgagggaattaataagtgtacccttatcgccatggatctgggagaaatgtgcgaggacaccgttacatacaagtgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggatccttagaaatcctggcttcgctctgctcgccggctttatggcttacatgatcgggcagacaggcattcagcggaccgttttctttgtgctgatgatgcttgtcgcccccagctatggcatgcgctgtgtgggggttggaaacagagatttcgtggaaggcgtctccgggggagtgtgggtggacctggtcctcgagcacggcggctgcgttacaaccatggcgcaggggaagcctaccctggattttgaactgacaaagacgaccgccaaagaggtggctctcctgcggacatactgtatcgaagccagcatttctaatatcaccacagctacccgctgcccgacgcaaggagagccctatcttaaggaggaacaggaccagcagtacatttgtagacgggatgtggtcgaccgcggctgggggaacggatgcggcctgttcgggaaaggaggcgtggttacatgcgccaagttttcctgtagcggcaaaatcaccgggaatctcgtgcaaattgagaacctggaatataccgtcgtggttacagtgcataatggagatacccacgcggtcggcaacgacacatctaatcacggggtgacggccaccatcacacctagatcccccagcgtcgaggtgaaacttcctgattacggagaactgaccctcgactgcgagccccggtctggcatcgacttcaacgagatgattctgatgaagatgaaaaagaaaacatggctggttcataagcagtggtttctcgatctgccgcttccttggaccgctggggccgacacgtccgaagtgcactggaattacaaagagagaatggtcaccttcaaggtgccccatgctaaacgccaggatgttacagtgctgggcagccaggaaggagccatgcactccgccctcgctggcgcgaccgaggtcgactctggggatggaaaccacatgtttgccggccatctgaagtgtaaggtgcggatggaaaaacttagaatcaaggggatgagctatacaatgtgctccggaaaattcagcattgacaaggagatggctgagacccaacacggcacgacagtggttaaagtcaagtacgaaggggccggcgccccttgtaaggtgcccatcgagattcgcgatgtgaataaagaaaaggtcgtgggacgggttatctcttccacacccctggctgagaacacaaacagcgtgaccaatatcgagctcgaacctccgttcggcgactcttatattgtcatcggggtgggaaacagcgccctgaccctgcattggtttagaaaaggctcctctattgggaagatgttcgagagcacataccgcggagcgaaacggatggctatcctcggcgaaacggcctgggattttgggtccgttggcggactgttcaccagccttggcaaggccgtgcaccaggtctttgggtctgtgtatacaaccatgttcggaggcgtttcctggatgattagaatcctgatcgggtttctcgtgctgtggattggaacaaatagccgcaacacctctatggctatgacgtgcatcgccgtcggcgggattacactgttccttggctttaccgtgcaggctgacatgggatgtgtggtctcctggagcggccgggagctcaagtgcgggtccggaatcttcgttgtggataatgtgcatacctggacagaacaatacaaatttcagcccgagtctcctgccagactggcgagcgccattctgatcgctcacaaggacggcgtctgtgggattcgctccaccacacggctcgagaacgtgatgtggaaacagatcacgaatgaactgaactatgttctttgggagggaggccacgacctgaccgtggtcgccggcgatgctaagggggtgctcacaaaaggaaagagagccctgacaccccctgtttctgacctgaagtacagctggaaaacatggggcaaggcgaaaatcttcacccccgaagccagaaattccacgtttcttattgatgggccggacaccagcgagtgccctaacgaacgcagagcttggaactctctcgaggtggaggattacggattcggcatgttcacaaccaacatctggatgaagtttcgggaagggtccagcgaggtctgtgaccatagactgatgtctgccgctattaaagatcagaaggccgtgcacgccgacatgggatattggatcgaatccagcaaaaatcaaacatggcagattgagaaggcttctctgatcgaagttaagacctgcctctggcccaaaacacataccctgtggagcaacggcgtgcttgagtcccagatgctgatccctaagagctacgcgggccccttctctcagcacaattatcgccaagggtacgccacgcagacagtcggaccttggcacctcggcaaactggagattgattttggggaatgccccggaaccaccgtgacaatccaggaggactgtgatcatcggggcccgtccctgagaaccacgacagctagcgggaaacttgtgacccagtggtgctgtcgctcctgcacaatgcctcccctcagattcctgggagaagacggctgttggtatggcatggagattcggcccctgtctgagaaagaagagaacatggtcaagagccaagttaccgccgggcagggaacatccgaaaccttttctatgggcctcctgtgccttacgctgttcgtggaggaatgtctccgcagacgggtgacccgcaagcacatgatcctggccgtcgtgattacactgtgcgctatcatccttgggggactcacctggatggatctgctgagagccctcattatgctgggcgacacaatgagcgggcggatcggaggccagacccatcttgcgattatggctgtttttaaaatgtcccctggctacgtgctgggggtcttcctccgcaagctgacgtctagagagacagccctgatggtgatcggaatggccatgaccacaacccttagcattccgcacgacctgatggagctcatcgatggcatctccctggggctcattctgcttaaaatcgttacccagtttgacaacacacaagtgggaacgctggctctcagcctgaccttcattcggtctacaatgtccctggtcatggcctggcgcaccatcatggcggtgctttttgtcgtgacactgattcccctctgtagaaccagctgcctgcagaagcagtctcattgggttgaaatcacggctctcattctgggcgcccaagcccttcctgtgtatctgatgacactcatgaaaggggcttcccggagaagctggcccctgaatgagggaatcatggccgtcggcctggtgtctcttctgggctccgctctcctgaagaacgatgttcctctcgccgggcccatggtggcgggaggcctgcttctggccgcttacgtcatgagcgggtccagcgccgacctgtctctcgaaaaggctgccaatgtgcagtgggatgagatggccgacatcaccggaagctcccctattatcgaagtgaaacaggatgaggacggctctttcagcattcgcgatgttgaggaaaccaacatgatcacactgcttgtcaagctggctctcattaccgtgtccgggctgtaccccctcgcgatcccggtgacaatgacgctgtggtatatgtggcaggtcaaaacccaacggtctggagccctttgggacgtgcctagccccgctgccacacagaaggccgctctgtccgagggcgtttacagaatcatgcagcgcggcctgtttgggaaaacccaggtgggagtcggcattcacatggaaggggtgttccacacaatgtggcatgttacccggggatctgtgatctgtcacgagacgggcagactcgaacctagctgggccgatgtccgcaatgacatgatttcctatgggggaggctggcggctgggcgataagtgggacaaggaggaggacgtgcaagttcttgcgatcgaacccgggaaaaacccgaagcatgtgcagaccaaacctggactgttcaagacactcaccggcgagattggggctgtcacactggattttaaacccggaaccagcggctctcctatcatcaatagaaaggggaaagtgattggcctctacggaaacggcgtggtcacaaagtccggggactatgttagcgccatcacgcaggccgaacgcattggagagcccgattacgaggtggacgaagatatcttccggaagaaaagactgaccattatggaccttcaccccggcgctgggaagacaaaacggatcctgccttctattgtgcgcgaggccctgaagagacggctccgcaccctgatccttgcgccgaccagagtcgtggctgccgaaatggaggaagccctgcggggactccccatcagatatcagacccctgctgttaaatccgagcatacgggccgcgagattgtggatctgatgtgccacgccacctttacaacccggctcctgagctccacaagagtccccaattacaaccttatcgtgatggacgaagctcacttcaccgatccttctagcgttgccgcgcgcgggtacatttccacgcgggtggagatgggcgaagccgctgccatctttatgacagctacaccccctggagccaccgacccgttcccccaaagcaattctcctattgaggatatcgaaagagagatccccgagcgctcctggaacacaggctttgactggattaccgactatcaggggaagacagtctggttcgtgcctagcatcaaggccggaaatgatattgctaactgcctgcggaaatctggcaagaaagtcatccagctgagcagaaagacctttgacacggaataccccaaaacaaagctcaccgattgggacttcgtggttacaaccgatatttccgagatgggggcgaattttcgcgccggaagagtgatcgacccgcggcgctgtctgaagcctgtgatccttacggatggccccgaaagagtcattctggctgggcccatccctgttacccccgcctctgccgctcaacggcgcggcagaattggacggaaccctgcccaggaggacgatcagtatgtgttcagcggcgacccgctcaaaaacgatgaagaccatgcgcactggacagaggctaagatgctgctggataatatctacacccccgaggggattatccctacactcttcggacccgaaagagagaaaacccaggccattgacggcgaatttcgccttagaggggaacaacggaagacattcgtggagctgatgcgccggggagacctgcctgtctggctctcctataaagtggcctctgctggcatcagctacaaggatagagaatggtgctttaccggcgagcggaacaatcagatcctggaagagaacatggaagttgagatttggacgcgcgagggggaaaagaagaaacttagaccccggtggctggacgcccgcgtgtatgcggatccgatggccctcaaagacttcaaagagtttgcttccggaagaaaaagcatcacactggatattctgaccgaaatcgcctctctccctacctacctttccagccgggctaagctggccctggacaatattgtcatgctccatacaaccgagcgcggcgggagagcttaccagcacgccctgaacgaacttcccgagtccctggagacactcatgctggtggcgctgctcggagccatgacggctggcatcttcctctttttcatgcaggggaagggaatcggcaaactgtctatgggcctgattaccatcgccgtcgctagcgggctcctgtgggtggccgaaattcaacctcagtggatcgccgcttccattatccttgagtttttcctgatggttctcctgatccccgaacctgagaagcagcggacaccccaggataatcaactgatttatgtgatcctcaccattcttacaatcattggactgatcgcggccaacgaaatgggcctgattgagaaaaccaagacggactttgggttctaccaggtcaaaaccgagacaaccatcctcgatgtggacctgcgcccggcttctgcctggacactttatgccgttgctaccacgatcctgacacctatgctcagacacaccattgaaaatacaagcgccaacctgtccctggcggccatcgctaatcaggccgctgtgctcatgggacttggcaaggggtggcccctgcatcggatggatctgggagtccccctcctggccatgggctgttacagccaggtgaaccctaccacccttacagcgtctctggtgatgctcctggttcactatgccattatcggcccggggctgcaagctaaagccacgagagaggctcagaagcgcaccgccgctggaattatgaagaatcccacagtcgacggcatcaccgtgatcgatctcgaacctatttcctacgaccccaaatttgagaagcagcttgggcaagtgatgctgctggtcctctgcgccggacagctgcttctgatgcggacaacctgggcgttctgtgaggttctcacgctggccacaggccctatcctgaccctctgggaagggaaccccggaagattctggaataccacaattgctgtgagcaccgccaacatctttcgcggctcttatcttgctggcgccgggctggccttctccctgattaaaaacgcgcagacacctcggagaggaacgggcaccacaggggagaccctcggagaaaagtggaaacgccagctgaatagccttgaccggaaggagtttgaagagtacaagagatctggcatcctggaggtggatcgcacagaagctaaaagcgccctcaaggacgggtccaaaatcaagcatgctgtctctcggggaagctccaaaattagatggatcgtggagcgcggcatggttaagccgaagggcaaagtggtcgatctggggtgcggacggggcgggtggagctactatatggccaccctgaagaacgtgacggaagttaaaggatacaccaagggcgggcccggacacgaggaacctattcccatggccacatatggctggaatctcgtgaaacttcattccggcgtcgacgtgttctacagacctaccgagcaagtggatacactgctgtgtgacatcggggagtctagctccaaccccaccattgaagagggacgcacactcagagtcctgaagatggttgaaccgtggctttctagcaagcctgagttttgcatcaaagtgctgaatccctatatgcccaccgtgattgaagaactcgagaagctgcagcggaaacacggcgggaacctggtccgctgtcctctctccagaaattctacgcacgaaatgtactgggtgagcggagcttccggcaacatcgttagctctgtgaatacaacctccaagatgcttctgaaccggttcaccacaagacatcggaaacccacgtatgagaaggatgtcgacctgggggccggaacccgcagcgtgtctacagaaaccgagaaacctgatatgacaatcattggcagacggctccagcgcctgcaggaggaacacaaggagacctggcattacgaccaagaaaatccgtacagaacatgggcgtatcacggctcctacgaggcccccagcaccgggtctgcttccagcatggttaacggagtggtcaaacttctgacgaaaccttgggatgtgatccccatggttacccagctcgccatgacagacaccacaccttttggccagcagcgggtgttcaaggaaaaagtcgacacccgcacgccccaaccgaagcctgggacaagaatggtgatgaccacaaccgctaattggctgtgggccctgctcggcaagaagaagaacccccggctgtgcacgcgcgaggagtttatttccaaagtcagaagcaatgcggccatcggcgctgtgttccaggaggaacaggggtggacctctgccagcgaagctgttaacgattcccggttttgggagcttgtggacaaggaacgcgccctgcaccaagagggcaaatgtgagtcttgcgtctataatatgatgggaaagagagagaagaagctcggcgagttcgggcgggctaagggaagccgcgccatttggtacatgtggctgggcgcgagatttcttgagttcgaggccctggggttcctcaacgaagatcattggtttggacgggagaactcctggtctggcgtggagggggaaggcctgcacagactgggatatatcctcgaggaaatcgacaaaaaggatggcgacctgatgtacgctgatgacacagccgggtgggatacccgcattacagaggacgatcttcagaatgaggaactgatcaccgagcagatggctcctcatcacaaaattctcgccaaggccatcttcaaactgacatatcagaacaaggtggttaaggtgcttcggcccacccctagaggagcggtcatggacattatcagccgcaaagatcaacggggctccggacaggtgggaacgtacggcctgaatacatttaccaacatggaagttcagctcatcagacagatggaggctgaaggggtgattacccaagacgacatgcagaatcccaagggcctgaaagagcgcgtcgagaagtggctgcgggaatgcggagtggatagactcaaacgcatggccatctctggcgacgattgtgtcgtgaagccgctggacgagcggttcgggacaagccttctgtttctcaacgatatgggaaaagttagaaaggacattcctcagtgggaaccctccaagggctggaaaaattggcaggaggtgcccttctgcagccatcactttcacaagatcttcatgaaagatgggcgctctctggtcgtgccttgtcggaaccaagacgaacttattgggcgggcccggatctcccagggcgctgggtggagcctgagagagaccgcctgcctcggcaaggcttacgcccagatgtggtctctgatgtattttcatcgccgggatctgagactcgcgtccatggccatctgtagcgctgttccgacagagtggttccccacgtcccgcaccacatggtctattcacgcccatcaccagtggatgaccacagaagacatgctgaaagtgtggaatagagtctggatcgaggataaccctaatatgattgacaagacccccgtgcacagctgggaagacatcccttaccttggaaagcgggaggatctgtggtgcggctccctcattgggctgagctctcgcgctacgtgggccaaaaacatccataccgcgattacacaagtgagaaatcttatcggaaaggaagagtatgttgactacatgcccgtcatgaaacggtattccgcccctagcgagtctgaaggcgtgctgtga

SEQ ID NO: 20987 - RNA, 9867 nt, synthetic construct
  misc_feature 1..9867: note = derived and/or modified CDS sequence (opt5) from DENV-4__FJ882598__SS-prME
  source 1..9867: mol_type = other RNA
agcaccatcaccctgctttgcctgattcccacggccatggctttccacctttccacccgggacggagagcctctgatgatcgtggccaagcatgaacgggggcgcccgctcctgtttaagaccaccgagggaattaacaagtgtacccttatcgcgatggatctgggcgaaatgtgcgaggacaccgtgacctacaagtgtcccctcctggttaataccgaacctgaggatattgactgctggtgtaacctgacgtctacctgggtgatgtatgggacatgcacccagagcggagagagacggcgcgaaaagagatccgtggctctcacaccccactctggcatggggctggagacccgggccgaaacgtggatgagctccgagggagcctggaagcatgctcaacgcgtcgagtcttggatccttagaaatcctggcttcgccctgctcgctggctttatggcctacatgatcgggcagacaggcattcagcggaccgtgttctttgttctgatgatgcttgtggcgcccagctatggcatgcgctgtgtcggggtgggaaacagagatttcgttgaaggcgtgtccgggggagcctgggtcgacctggtgctcgagcacggcggctgcgtgacaaccatggctcaggggaagcctaccctggattttgaactgacaaagacgaccgccaaagaggtcgctctcctgcggacatactgtatcgaagccagcatttctaatatcaccacagcgacccgctgcccgacgcaaggagagccctatcttaaggaggaacaggaccagcagtacatttgtagacgggatgttgtggaccgcggctgggggaacggatgcggcctgttcgggaaaggaggcgtggtcacatgcgccaagttttcctgtagcggcaaaatcaccgggaatctcgtgcaaattgagaacctggaatataccgttgtggtcacagtgcataatggagatacccacgctgttggcaacgacacatctaatcacggggtgacggccaccatcacacctagatcccccagcgtcgaggtgaaacttcctgattacggagaactgaccctcgactgcgagccccggtctggcatcgacttcaacgagatgattctgatgaagatgaaaaagaaaacatggctggtccataagcagtggtttctcgatctgccgcttccttggaccgctggggccgacacgtccgaagtgcactggaattacaaagagagaatggttaccttcaaggtgccccatgccaaacgccaggatgtcacagtgctgggcagccaggaaggagctatgcactccgcgctcgccggcgctaccgaggttgactctggggatggaaaccacatgtttgccggccatctgaagtgtaaggtgcggatggaaaaacttagaatcaaggggatgagctatacaatgtgctccggaaaattcagcattgacaaggagatggccgagacccaacacggcacgacagtcgtgaaagtgaagtacgaaggggctggcgccccttgtaaggttcccatcgagattcgcgatgtcaataaagaaaaggtggtgggacgggtcatctcttccacacccctggcggagaacacaaacagcgtgaccaatatcgagctcgaacctccgttcggcgactcttatattgttatcggggtgggaaacagcgctctgaccctgcattggtttagaaaaggctcctctattgggaagatgttcgagagcacataccgcggagccaaacggatggccatcctcggcgaaacggcttgggattttgggtccgtcggcggactgttcaccagccttggcaaggccgtgcaccaggtttttgggtctgtgtatacaaccatgttcggaggcgtctcctggatgattagaatcctgatcgggtttctcgtgctgtggattggaacaaatagccgcaacacctctatggctatgacgtgcatcgccgttggcgggattacactgttccttggctttaccgtgcaggcggacatgggatgtgtcgtgtcctggagcggccgggagctcaagtgcgggtccggaatcttcgtggtcgataatgttcatacctggacagaacaatacaaatttcagcccgagtctcctgccagactggctagcgccattctgaacgctcacaaggacggcgtgtgtgggatccgctccaccacacggctcgagaatgtgatgtggaaacagattacgaacgaactgaattatgtcctttgggagggaggccacgacctgaccgtggttgccggcgatgtgaagggggtcctcacaaaaggaaagagagcgctgacaccccctgtgtctgacctgaagtacagctggaaaacatggggcaaggccaaaatcttcacccccgaagctcggaactccacgtttcttatcgatgggccggacaccagcgagtgccctaatgaacgcagagcctggaactctctcgaggttgaggattacggattcggcatgttcacaaccaatatttggatgaagtttcgggaagggtccagcgaggtgtgtgaccatagactgatgtctgctgccatcaaagatcagaaggccgtccacgctgacatgggatattggattgaatccagcaaaaaccaaacatggcagatcgagaaggcgtctctgattgaagtgaagacctgcctctggcccaaaacacataccctgtggagcaatggcgttcttgagtcccagatgctgatccctaagagctacgccggccccttctctcagcacaactatcgccaagggtacgctacgcagacagtgggaccttggcacctcggcaaactggagatcgattttggggaatgccccggaaccaccgtcacaattcaggaggactgtgatcatcggggcccgtccctgagaaccacgacagccagcgggaaacttgtgacccagtggtgctgtcgctcctgcacaatgcctcccctcagattcctgggagaagacggctgttggtatggcatggagatccggcccctgtctgagaaagaagagaacatggtcaagagccaagtcgccgctgggcagggaacctccgaaacattttctatgggcctcctgtgccttaccctgttcgttgaggaatgtctccgcagacgggtgacgcgcaagcacatgattctggccgtggtcatcaccctgtgcgcgattatccttgggggactcacatggatggatctgctgagagctctcatcatgctgggcgacaccatgagcgggcggattggaggccagacacatcttgccatcatggccgtgtttaaaatgtcccctggctacgttctgggggtgttcctccgcaagctgacctctagagagacggctctgatggtcattggaatggccatgacaaccacacttagcatcccgcacgacctgatggagctcattgatggcatctccctggggctcatcctgcttaaaattgtgacccagtttgacaatacccaagttggaacactggcgctcagcctgacgttcatccggtctaccatgtccctggtgatggcttggcgcacaattatggccgtcctttttgtggtcaccctgatccccctctgtagaacaagctgcctgcagaagcagtctcattgggtggaaattaccgccctcatcctgggcgctcaagcccttcctgtttatctgatgacgctcatgaaaggggcttcccggagaagctggcccctgaacgagggaattatggccgtgggcctggtctctcttctgggctccgcgctcctgaagaatgatgtgcctctcgccgggcccatggttgctggaggcctgcttctggccgcttacgtgatgagcgggtccagcgccgacctgtctctcgaaaaggccgctaacgtccagtgggatgagatggcggacatcacaggaagctcccctatcattgaagtgaaacaggatgaggacggctctttcagcatccgcgatgtggaggaaaccaatatgattaccctgcttgttaagctggccctcatcacagtctccgggctgtaccccctcgctattccggtgaccatgacactgtggtatatgtggcaagtgaaaacgcaacggtctggagccctttgggacgtccctagccccgccgctacccagaaggccgcgctgtccgagggcgtgtacagaatcatgcagcgcggcctgtttgggaaaacacaggttggagtgggcatccacatggaaggggtcttccacaccatgtggcatgtgacacggggatctgttatttgtcacgagaccggcagactcgaacctagctgggctgatgtgcgcaacgacatgatctcctatgggggaggctggcggctgggcgataagtgggacaaggaggaggacgtccaagtgcttgccattgaacccgggaaaaatccgaagcatgttcagacgaaacctggactgttcaagaccctcacaggcgagatcggggccgtgaccctggattttaaacccggaacaagcggctctcctattatcaacagaaaggggaaagtcatcggcctctacggaaatggcgtggtgaccaagtccggggactatgtcagcgctattacacaggccgaacgcatcggagagcccgattacgaggttgacgaagatattttccggaagaaaagactgacgatcatggaccttcaccccggcgcggggaagaccaaacggattctgccttctatcgtgcgcgaggctctgaagagacggctccgcacactgattcttgccccgaccagagtggtcgccgctgaaatggaggaagccctgcggggactccccatcagatatcagacccctgctgtgaaatccgagcatacaggccgcgagatcgttgatctgatgtgccacgccacgtttaccacacggctcctgagctccaccagagtgcccaactacaatcttattgtcatggacgaagcgcacttcacagatccttctagcgtggccgctcgcgggtacatctccacccgggttgagatgggcgaagccgctgccatttttatgacggccacaccccctggagctaccgacccgttcccccaaagcaactctcctatcgaggatattgaaagagagatccccgagcgctcctggaataccggctttgactggatcacagactatcaggggaagaccgtgtggttcgtccctagcattaaggcgggaaacgatatcgccaattgcctgcggaaatctggcaagaaagtgattcagctgagcagaaagacatttgacaccgaataccccaaaacgaagctcacagattgggacttcgtcgtgaccacagatatctccgagatgggggctaactttcgcgccggaagagttattgacccgcggcgctgtctgaagcctgtgatccttaccgatggccccgaaagagtgatcctggccgggcccattcctgtcacgcccgcttctgccgcgcaacggcgcggcagaatcggacggaaccctgctcaggaggacgatcagtatgttttcagcggcgacccgctcaaaaatgatgaagaccatgcccactggaccgaggccaagatgctgctggataacatttacacacccgaggggatcattcctaccctcttcggacccgaaagagagaaaacacaggctatcgacggcgaatttcgccttagaggggaacaaagaaagaccttcgtggagctgatgcgccggggagacctgcctgtgtggctctcctataaagtcgcctctgcgggcattagctacaaggatagagaatggtgctttacaggcgagcggaataaccagatcctggaagagaatatggaagtggagatctggacccgcgagggggaaaagaagaaacttagaccccggtggctggacgcccgcgtttatgctgatccgatggccctcaaagacttcaaagagtttgcttccggaagaaaaagcattacgctggatatcctgacagaaattgcctctctccctacctacctttccagccgggctaagctggccctggacaacatcgtgatgctccataccacagagcgcggcgggagagcgtaccagcacgccctgaatgaacttcccgagtccctggagaccctcatgctggtcgctctgctcggagccatgacagctggcattttcctctttttcatgcaggggaagggaatcggcaaactgtctatgggcctgatcacgattgccgtggccagcgggctcctgtgggtcgctgaaatccaacctcagtggattgcggcctccatcattcttgagtttttcctgatggtgctcctgatccccgaacctgagaagcagcggacaccccaggataaccaactgatctatgttattctcacaatccttaccattatcggactgattgctgccaatgaaatgggcctgatcgagaaaacaaagaccgactttgggttctaccaggtgaaaacggagaccacaattctcgatgtcgacctgcgcccggcctctgcttggaccctttatgccgtggcgacaaccatcctgacgcctatgctcagacacacaatcgaaaacaccagcgccaatctgtccctggctgccattgctaaccaggccgcggttctcatgggacttggcaaggggtggcccctgcatcggatggatctgggagtgcccctcctggccatgggctgttacagccaggtcaatcctacaacccttaccgcttctctggtgatgctcctggtgcactatgccatcattggcccggggctgcaagctaaagccacaagagaggctcagaagcgcacggccgcgggaatcatgaagaaccccaccgttgacggcattacagtcatcgatctcgaacctatctcctacgaccccaaatttgagaagcagcttgggcaagtgatgctgctggtgctctgcgccggacagctgcttctgatgcggaccacatgggctttctgtgaggtcctcaccctggccacgggccctattctgacactctgggaagggaatcccggaagattctggaacaccaccatcgctgttagcacagccaacatttttcgcggctcttatcttgccggcgcggggctggctttctccctgatcaaaaatgcccagacccctcggagaggaacaggcacgaccggggagacactcggagaaaagtggaaacgccagctgaacagccttgaccggaaggagtttgaagagtacaagagatctggcattctggaggtggatcgcaccgaagctaaaagcgccctcaaggacgggtccaaaatcaagcatgccgtgtctcggggaagctccaaaatcagatggattgtcgagcgcggcatggtgaagccgaagggcaaagttgtggatctggggtgcggacggggcgggtggagctactatatggctacactgaagaatgtcaccgaagtgaaaggatacacgaagggcgggcccggacacgaggaacctatccccatggccacctatggctggaacctcgttaaacttcattccggcgtggacgtcttctacaagcctacagagcaagtggataccctgctgtgtgacattggggagtctagctccaatcccacaatcgaagagggaagaaccctccgcgtgctgaagatggtcgaaccgtggctttctagcaaacctgagttttgcattaaggttctgaacccctatatgcccacagtgatcgaggaactcgagaaactgcagagaaagcacggcgggaatctggtgcggtgtcctctctcccgcaactctacccacgaaatgtactgggtcagcggagcgtccggcaatattgtgagctctgttaacacgacatccaaaatgcttctgaatagattcaccacccggcatagaaagcccacatatgagaaagatgtggacctgggggccggaacgcggagcgtctctaccgaaacagagaagcctgatatgaccatcatcggccgcagactccagcggctgcaggaggaacacaaggagacatggcattacgaccaagaaaacccgtaccgcacctgggcttatcacggctcctacgaggcccccagcacagggtctgcttccagcatggtgaatggagttgtgaaacttctgaccaagccttgggatgtcattcccatggtgacgcagctcgccatgaccgacacaaccccttttggccagcagagagttttcaaagaaaaggtggacacacggacaccccagccgaaacctgggacgcgcatggtcatgacaaccacagcgaactggctgtgggccctgctcggaaagaagaaaaatcccagactgtgcacccgggaggagtttatctccaaggtgcgcagcaacgctgccattggcgctgtcttccaggaggagcaggggtggacgtctgccagcgaagctgtgaatgattccagattttgggagcttgttgacaaagaacgggccctgcaccaagagggcaagtgtgagtcttgcgtgtataacatgatgggaaaacgcgaaaagaagctcggcgagttcgggagagcgaaaggaagccgggccatctggtacatgtggctgggcgctcgctttcttgagttcgaggccctggggttcctcaacgaagatcattggtttggaagagaaaattcctggtctggcgtcgagggggaaggcctgcaccggctgggatatattctcgaggaaatcgacaagaaagatggcgacctgatgtacgctgatgacaccgccgggtgggatacaagaatcaccgaggacgatcttcagaacgaggaactgattacagagcagatggcccctcatcacaagatcctcgcgaaagctattttcaagctgacctatcagaataaggtggtgaaagttcttcgccccacacctcggggagccgtgatggacatcattagcagaaaggatcaacgcggctccgggcaggtcggaacctacggcctgaacacgtttacaaatatggaagtgcagctcatccggcagatggaggccgaaggggttatcacccaagacgacatgcagaaccccaaaggcctgaaggagagagtggagaaatggctgcgcgaatgcggagtcgatcggctcaagagaatggctatttctggcgacgattgtgtggtcaaaccgctggacgagcgcttcgggaccagccttctgtttctcaatgatatgggaaaggtgcggaaggacatccctcagtgggaaccctccaaaggctggaagaactggcaggaggttcccttctgcagccatcactttcacaaaattttcatgaaggatgggagatctctggtggtcccttgtcgcaatcaagacgaacttatcggacgggccagaatttcccagggcgctgggtggagcctgcgggagacagcctgcctcggcaaagcgtacgcccagatgtggtctctgatgtattttcatagacgcgatctgcggctcgcttccatggccatctgtagcgctgtgccgaccgagtggttccccacatccagaacgacctggtctatccacgcccatcaccagtggatgacaaccgaagacatgctgaaggtttggaaccgcgtgtggattgaggataatcctaacatgatcgacaagacacccgtccacagctgggaagacattccttaccttggaaaaagagaggatctgtggtgcggctccctcatcgggctgagctctcgggcgacctgggccaagaatattcatacggctatcacccaagtgcgcaaccttattggaaaagaagagtatgtggactacatgcccgttatgaagagatattccgcccctagcgagtctgaaggcgtcctgtga

SEQ ID NO: 20988 - RNA, 9867 nt, synthetic construct
  misc_feature 1..9867: note = derived and/or modified CDS sequence (opt5) from DENV-4__FJ882601__SS-prME
  source 1..9867: mol_type = other RNA
agcaccatcaccctgctctgcctgattcccacggtgatggctttccacctttccacccgggacggagagcctctgatgatcgtcgctaagcatgaacgggggcgcccgcttctgtttaagaccaccgaggggattaacaagtgtacccttatcgccatggatctgggcgaaatgtgcgaggacaccgttacctacaagtgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaagcatgcccaacgcgtggagtcttggatccttagaaatcctggcttcgctctgctcgccggctttatggcttacatgatcgggcagacaggcattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctagcatttctaatatcaccacagccacccgctgcccgacgcaaggagagccctatcttaaggaggaacaggaccagcagtacatttgtagacgggatgtggtggaccgcggctgggggaacggatgcggcctgttcgggaaaggaggcgtcgtgacatgcgcgaagttttcctgtagcggcaaaatcaccgggaatctcgttcaaattgagaacctggaatataccgtggtcgtgacagttcataatggagatacccacgccgtgggcaacgacacatctaatcacggggtcacggctaccatcacacctagatcccccagcgtggaggtcaaacttcctgattacggagaactgaccctcgactgcgagccccggtctggcatcgacttcaacgagatgattctgatgaagatgaaaaagaaaacatggctggtgcataagcagtggtttctcgatctgccgcttccttggaccgccggggctgacacgtccgaagttcactggaattacaaagagagaatggtgaccttcaaggtcccccatgccaaacgccaggatgtgacagttctgggcagccaggaaggagccatgcactccgctctcgcgggcgccaccgaggtggactctggggatggaaaccacatgtttgctggccatctgaagtgtaaggtccggatggaaaaacttagaatcaaggggatgagctatacaatgtgctccggaaaattcagcattgacaaggagatggccgagacccaacacggcacgacagtggtgaaagttaagtacgaaggggccggcgctccttgtaaggtccccatcgagattcgcgatgtgaataaagaaaaggtggtcggacgggtgatctcttccacacccctggccgagaacacaaacagcgttaccaatatcgagctcgaacctccgttcggcgactcttatattgtgatcggggtcggaaacagcgcgctgaccctgcattggtttagaaaaggctcctctattgggaagatgttcgagagcacataccgcggagctaaacggatggccatcctcggcgaaacggcctgggattttgggtccgtgggcggactgttcaccagccttggcaaggctgttcaccaggtgtttgggtctgtctatacaaccatgttcggaggcgtgtcctggatgattagaatcctgatcgggtttctcgttctgtggattggaacaaatagccgcaacacctctatggccatgacgtgcatcgctgtgggcgggattacactgttccttggctttaccgtccaggccgacatgggatgtgtggtgtcctggagcggccgggagctcaagtgcgggtccggaatcttcgtcgttgataatgtgcatacctggacagaacaatacaaatttcagcccgagtctcctgcgagactggccagcgctattctgaacgcccacaaggacggcgtgtgtgggatccgctccaccacacggctcgagaatgtcatgtggaaacagattacgaacgaactgaattatgtgctttgggagggaggccacgacctgaccgttgtggctggcgatgtcaagggggtgctcacaaaaggaaagagagccctgacaccccctgtttctgacctgaagtacagctggaaaacatggggcaaggcgaaaatcttcacccccgaagcccggaactccacgtttcttatcgatgggccggacaccagcgagtgccctaatgaacgcagagcttggaactctctcgaggtggaggattacggattcggcatgttcacaaccaatatttggatgaagtttcgggaagggtccagcgaggtctgtgaccatagactgatgtctgccgctatcaaagatcagaaggccgtgcacgccgacatgggatattggattgaatccagcaaaaaccaaacatggcagatcgagaaggcttctctgattgaagttaagacctgcctctggcccaaaacacataccctgtggagcaatggcgtgcttgagtcccagatgctgatccctaagagctacgcgggccccttctctcagcacaactatcgccaagggtacgccacgcagacagtcggaccttggcacctcggcaaactggagatcgattttggggaatgccccggaaccaccgtgacaattcaggaggactgtgatcatcggggcccgtccctgagaaccacgacagctagcgggaaacttgtgacccagtggtgctgtcgctcctgcacaatgcctcccctcagattcctgggagaagacggctgttggtatggcatggagatccggcccctgtctgagaaagaagagaacatggtcaagagccaagttgccgccgggcagggaacctccgaaacattttctatgggcctcctgtgccttaccctgttcgtggaggaatgtctccgcagacgggtgacgcgcaagcacatgattctggctgtcgtgatcaccctgtgcgccattatccttgggggactcacatggatggatctgctgagagcgctcatcatgctgggcgacaccatgagcgggcggattggaggccagacacatcttgctatcatggccgtttttaaaatgtcccctggctacgtgctgggggtcttcctccgcaagctgacctctagagagacggccctgatggtgattggaatggctatgacaaccacacttagcatcccgcacgacctgatggagctcattgatggcatctccctggggctcatcctgcttaaaattgttacccagtttgacaatacccaagtgggaacactggccctcagcctgacgttcatccggtctaccatgtccctggtcatggcgtggcgcacaattatggctgtgctttttgtcgtgaccctgatccccctctgtagaacaagctgcctgcagaagcagtctcattgggttgaaattaccgccctcatcctgggcgcccaagcccttcctgtgtatctgatgacgctcatgaaaggggcctcccggagaagctggcccctgaacgagggaattatggctgtcggcctggtgtctcttctgggctccgccctcctgaagaatgatgttcctctcgcggggcccatggtggccggaggcctgcttctggctgcctacgtcatgagcgggtccagcgctgacctgtctctcgaaaaggccgccaacgtgcagtgggatgagatggctgacatcacaggaagctcccctatcattgaagtgaaacaggatgaggacggctctttcagcatccgcgatgttgaggaaaccaatatgattaccctgcttgtcaagctggcgctcatcacagtgtccgggctgtaccccctcgccattccggtgaccatgacactgtggtatatgtggcaggtcaaaacgcaacggtctggagctctttgggacgtgcctagccccgccgccacccagaaggctgccctgtccgagggcgtttacagaatcatgcagcgcggcctgtttgggaaaacacaggtgggagtcggcatccacatggaaggggtgttccacaccatgtggcatgttacacggggatctgtgatttgtcacgagaccggcagactcgaacctagctgggcggatgtccgcaacgacatgatctcctatgggggaggctggcggctgggcgataagtgggacaaggaggaggacgtgcaagttcttgctattgaacccgggaaaaatccgaagcatgtgcagacgaaacctggactgttcaagaccctcacaggcgagatcggggccgtcaccctggattttaaacccggaacaagcggctctcctattgtgaacagaaaggggaaagtgatcggcctctacggaaatggcgtcgttaccaagtccggggactatgtgagcgccatcacacaggctgaacgcattggagagcccgattacgaggtggacgaagatatcttccggaagaaaagactgacgattatggaccttcaccccggcgccgggaagaccaaacggatcctgccttctattgtccgcgaggcgctgaagagacggctccgcacactgatccttgctccgaccagagtggttgccgccgaaatggaggaagctctgcggggactccccattagatatcagacccctgccgtgaaatccgagcatacaggccgcgagatcgtcgatctgatgtgccacgctacgtttaccacacggctcctgagctccaccagagtgcccaactacaatcttatcgttatggacgaagcccacttcacagatccttctagcgtggcggcccgcgggtacatttccacccgggtcgagatgggcgaagctgccgctatctttatgacggccacaccccctggagccaccgacccgttcccccaaagcaactctcctattgaggatatcgaaagagagattcccgagcgctcctggaataccggctttgactggatcacagactatcaggggaagaccgtgtggttcgtccctagcatcaaggctggaaacgatattgcgaattgcctgcggaaatctggcaagaaagtgatccagctgagcagaaagacatttgacaccgaataccccaaaacgaagctcacagattgggacttcgttgtgaccacagatatttccgagatgggggccaactttcgcgctggaagagtgatcgacccgcggcgctgtctgaagcctgtcattcttaccgatggccccgaaagagttatcctggccgggcccatccctgtgacgcccgcctctgctgcccaacggcgcggcagaattggacggaaccctgcgcaggaggacgatcagtatgtgttcagcggcgacccgctcaaaaatgatgaagaccatgctcactggaccgaggccaagatgctgctggataacatctacacacccgaggggattatccctaccctcttcggacccgaaagagagaaaacacaggccattgacggcgaatttcgccttagaggggaacaaagaaagaccttcgtcgagctgatgcgccggggagacctgcctgtgtggctctcctataaagttgcttctgccggcatcagctacaaggatagagaatggtgctttacaggcgagcggaataaccagattctggaagagaatatggaagtggagatctggacccgcgagggggaaaagaagaaacttagaccccggtggctggacgcgcgcgtctatgccgatccgatggctctcaaagacttcaaagagtttgcctccggaagaaaaagcatcacgctggatattctgacagaaatcgcttctctccctacctacctttccagccgggccaagctggctctggacaacattgtgatgctccataccacagagcgcggcgggagagcctaccagcacgcgctgaatgaacttcccgagtccctggagaccctcatgctggtcgccctgctcggagctatgacagccggcatcttcctctttttcatgcaggggaagggaattggcaaactgtctatgggcctgatcacgatcgctgtggccagcgggctcctgtgggttgccgaaattcaacctcagtggatcgctgcgtccattatccttgagtttttcctgatggtgctcctgattcccgaacctgagaagcagcggacaccccaggataaccaactgatctatgtcatcctcgccattcttacaatcattggactgatcgctgccaatgaaatgggcctgattgagaaaaccaagacagactttgggttctaccaggagaaaaccgaaacgaccatcctcgatgtggacctgcgcccggcctctgcttggacactttatgccgttgcgaccacaattctgacccctatgctcagacacacgatcgagaacacaagcgccaatctgtccctgaccgctatcgccaaccaggctgccgtgctcatgggacttggcaaggggtggcccctgcatcggatggatctgggagtccccctcctggcgatgggctgttacagccaggtgaatcctacaacccttaccgcctctctggtgatgctcctggttcactatgctattatcggcccggggctgcaagccaaagctacaagagaagccctcaagcgcacggctgccggaattatgaagaaccccaccgtcgacggcatcacagtgattgatcttgagcctatctcctacgaccccaaatttgagaagcagctgggacaggtgatgctgctcgtcctgtgcgcgggacaacttctgctcatgcggaccacatgggccttctgtgaagttctgaccctggctacgggccctatcctcacactttgggaggggaatcccggaagattctggaacaccaccattgccgtgagcacagctaacatctttcgcggctcttatctggccggcgccgggctggcgttctccctcattaaaaatgtgcagacccctcggagaggaacaggcacgaccggggaaacactgggagagaagtggaaacgccagcttaacagcctggaccggaaggaatttgaggagtacaagagatctggcatcctcgaagtcgatcgcaccgaggctaaaagcgccctgaaggacgggtccaaaattaagcatgctgtgtctcggggaagctccaaaatcagatggatcgttgaacgcggcatggtgaagccgaagggcaaagtcgtggatctggggtgcggacggggcgggtggagctactatatggccacactcaagaatgttaccgaggtgaaaggatacacgaagggcgggcccggacacgaggaacctattcccatggccacctatggctggaaccttgtcaaactgcattccggcgtggacgtgttctacaagcctacagagcaggtcgataccctgctctgtgacatcggggaatctagctccaatcccacaattgaggaaggaagaaccctgcgcgttcttaagatggtggagccgtggctgtctagcaaacctgaattttgcatcaaggtgctcaacccctatatgcccacagtcattgaggagctggaaaaactgcaaagaaagcacggcgggaatctcgtgcggtgtcctctttcccgcaactctacccacgagatgtactgggttagcggagcttccggcaatatcgtgagctctgtcaacacgacatccaaaatgctgctgaatagattcaccacccggcatagaaagcccacatatgaaaaagatgtggacctcggggccggaacgcggagcgtttctaccgagacagagaagcctgatatgaccattatcggccgcagactgcagcggcttcaggaggagcacaaggaaacatggcattacgaccaggagaacccgtaccgcacctgggcgtatcacggctcctacgaagcccccagcacagggtctgcttccagcatggtgaatggagtcgtgaaactgctcaccaagccttgggatgttatccccatggtgacgcaactggccatgaccgacacaaccccttttggccagcagagagtcttcaaagagaaggtggacacacggacaccccagccgaaacctgggacgcgcatggtcatgacaaccacagctaactggctgtgggccctcctgggaaagaagaaaaatcccagactttgcacccgggaggaatttatttccaaggtgcgcagcaacgcggccatcggcgctgttttccaagaggaacaggggtggacgtctgccagcgaggctgtgaatgattccagattttgggaactggtcgacaaagagcgggccctccaccaggagggcaagtgtgaatcttgcgtgtataacatgatgggaaaacgcgagaagaagctgggcgagttcgggagagctaaaggaagccgggccatttggtacatgtggcttggcgcgcgctttctggagttcgaagccctcgggttcctgaacgaggatcattggtttggaagagaaaattcctggtctggcgtggaaggggagggcctgcaccggctcggatatatcctggaagagattgacaagaaagatggcgaccttatgtacgctgatgacaccgccgggtgggatacaagaatcaccgaggacgatctgcaaaacgaggaactcgttacagaacagatggctcctcatcacaagatcctggccaaagccattttcaaacttacctatcagaataaggtggtcaaagtgctgcgccccacacctcggggagcggttatggacatcattagcagaaaggatcagcgcggctccgggcaagtgggaacctacggcctcaacacgtttacaaatatggaggtccagctgatccggcagatggaagctgagggggtgattacccaggacgacatgcaaaaccccaaaggcctgaaggagagagtcgaaaaatggctccgcgagtgcggagtggatcggctgaagagaatggccatctctggcgacgattgtgttgtgaaaccgcttgacgaacgcttcgggaccagcctgctctttctgaatgatatgggaaaggtccggaaggacatccctcagtgggagccctccaaaggctggaagaactggcaggaagtgcccttctgcagccatcactttcacaaaattttcatgaaggatgggagatctcttgttgtgccttgtcgcaatcaggacgagctgatcggacgggccagaatttcccaaggcgctgggtggagcctccgggagacagcctgcctgggcaaggcttacgcccagatgtggtctctgatgtattttcatagacgcgatctccggctggcgtccatggccatctgtagcgctgtcccgaccgaatggttccccacatccagaacgacctggtctattcacgcccatcaccagtggatgacaaccgaggacatgcttaaggtgtggaaccgcgtgtggatcgaagataatcctaacatgatcgacaagacacccgttcacagctgggaggacattccttacctgggaaaaagagaagatctctggtgcggctccctgatcgggcttagctctcgggctacctgggccaagaatattcatacggcgatcacccaggtccgcaacctgattggaaaagaggagtatgtggactacatgcccgtgatgaagagatattccgcccctagcgaatctgagggcgtcctctga

SEQ ID NO: 20989 - RNA, 9867 nt, synthetic construct
  misc_feature 1..9867: note = derived and/or modified CDS sequence (opt5) from DENV-4__FJ226067__SS-prME
  source 1..9867: mol_type = other RNA
agcaccatcacactgctctgcctgattcccacggtgatggccttccacctttccaccagagacggcgagcctctgatgatcgtcgctaagcatgaacgggggcgcccgctcctgtttaaaacaaccgagggaattaacaagtgtacacttatcgccatggatctgggcgaaatgtgcgaggacaccgttacatacaaatgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggatccttagaaatcctggcttcgctctgctcgccggctttatggcttacatgatcgggcagacaggaattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctagcatttctaatatcaccacagccacccgctgcccgacgcaaggagagccctatcttaaggaggaacaggaccagcagtacatttgtagacgggatgtggtggaccgcggctgggggaacggatgcggcctgttcgggaaaggaggcgtcgtgacatgcgcgaagttttcctgtagcggcaaaatcaccgggaatctcgttcaaattgagaacctggaatataccgtggtcgtgacagttcataatggagatacccacgccgtgggcaacgacacatctaatcacggggtcacggctaccatcacacctagatcccccagcgtggaggtcaagcttcctgattacggagaactgaccctcgactgcgagccccggtctggcatcgacttcaacgagatgattctgatgaagatgaaaaagaaaacatggctggtgcataagcagtggtttctcgatctgccgcttccttggaccgccggggctgacacgtccgaagttcactggaattacaaagagagaatggtgaccttcaaggtcccccatgccaaacgccaggatgtgacagttctgggcagccaggaaggagccatgcactccgctctcgcgggcgccaccgaggtggactctggggatggaaaccacatgtttgctggccatctgaagtgtaaggtccggatggaaaaacttagaatcaaggggatgagctatacaatgtgctccggaaaattcagcattgacaaggagatggccgagacccaacacggcacgacagtggtgaaagttaagtacgaaggggccggcgctccttgtaaggtccccatcgagattcgcgatgtgaataaagaaaaggtggtcggacgggtgatctcttccacccccctggccgagaacacaaacagcgttaccaatatcgagctcgaacctccgttcggcgactcttatattgtgatcggggtcggaaacagcgcgctgaccctgcattggtttagacgcggctcctctattgggaaaatgttcgagagcacataccggggagctaagagaatggccatcctcggcgaaacggcctgggattttgggtccgtgggcggactgttcaccagccttggcaaagctgttcaccaggtgtttgggtctgtctatacaaccatgttcggaggcgtgtcctggatgattcgcatcctgatcgggtttctcgttctgtggattggaacaaatagccggaacacctctatggccatgacgtgcatcacagtgggcgggattaccctgttccttggctttaccgtccaggctgacatgggatgtgtggtgtcctggagcggcagagagctcaagtgcgggtccggaatcttcgtcgttgataatgtgcatacatggaccgaacaatacaagtttcagcccgagtctcctgcccgcctggcgagcgccattctgaacgctcacaaagacggcgtgtgtgggatccggtccacaacgagactcgagaatgtcatgtggaagcagattaccaacgaactgaattatgccctttgggagggaggccacgacctgacagtggttgctggcgatgtgaaaggggtcctcaccaagggaaaacgggccctgacaccccctgtgtctgacctgaagtacagctggaagacctggggcaaagcgaagatcttcacgcccgaagcccgcaactccacctttcttatcgatgggccggacacaagcgagtgccctaatgaaagacgggcttggaactctctcgaggttgaggattacggattcggcatgttcaccacaaatatttggatgaaatttagagaagggtccagcgaggtgtgtgaccatcgcctgatgtctgccgctatcaaggatcagaaagccgtccacgccgacatgggatattggattgaatccagcaagaaccaaacctggcagatcgagaaagcttctctgattgaagtgaagacatgcctctggcccaagacccatacgctgtggagcaatggcgttcttgagtcccagatgctgatccctaaaagctacgcgggccccttctctcagcacaactatcggcaagggtacgccacacagaccgtgggaccttggcacctcggcaagctggagatcgattttggggaatgccccggaaccacagtcaccattcaggaggactgtgatcatagaggcccgtccctgcgcacgacaaccgctagcgggaaacttgtgacacagtggtgctgtagatcctgcaccatgcctcccctccggttcctgggagaagacggctgttggtatggcatggagatccgccccctgtctgagaaggaagagaacatggtgaaaagccaagtcacagccgggcagggaacctccgaaacgttttctatgggcctcctgtgccttaccctgttcgttgaggaatgtctcagacggcgcgtgacaagaaagcacatgattctggtggtcgtgatcaccctgtgcgccattatccttgggggactcacatggatggatctgctgcgggctctcatcatgctgggcgacaccatgagcgggcgcattggaggccagatccatcttgccattatggcggtttttaagatgtcccctggctacgtgctgggggtcttcctcagaaaactgacgtctcgggagacagctctgatggtgatcggaatggccatgaccacagttcttagcattccgcacgacctgatggagctcatcgatggcatctccctggggctcattctgcttaagatcgtgacccagtttgacaatacccaagtcggaacactggccctcagcctgacgttcattcgctctaccatgcccctggtgatggcttggagaacaatcatggccgtcctttttgtggttaccctgattcctctctgtcggacatcctgcctgcagaaacagagccattgggtggaaatcaccgcgctcattctgggcgctcaagcccttcccgtctatctgatgacgctcatgaagggggcctctagacgctcctggcctctgaacgagggaatcatggctgtgggcctggttagccttctgggctctgccctcctgaaaaatgatgtgcccctcgctgggcctatggtcgccggaggcctgcttctggcggcctacgtgatgtccgggagctccgctgacctgagcctcgaaaaggccgctaacgtgcagtgggatgagatggccgacatcacaggatctagccccattatcgaagttaagcaggatgaggacggctccttctctattcgggatgtcgaggaaaccaatatgatcaccctgcttgtgaaactggccctcattacagtgagcgggctgtacccgctcgctatccctgtcaccatgacactgtggtatatgtggcaggtgaagacgcaaagatccggagcgctttgggacgttccctctcctgccgctacccagaaagccgccctgagcgagggcgtgtaccgcatcatgcagcggggcctgtttgggaagacacaggtcggagtgggcattcacatggaaggggttttccacaccatgtggcatgtgacaagaggatccgtcatctgtcacgagaccggccgcctcgaaccctcttgggctgatgtgcggaacgacatgattagctatgggggaggctggagactgggcgataaatgggacaaggaggaggacgttcaagtgcttgccatcgaaccggggaagaatcctaaacatgtccagacgaagcccggactgttcaaaaccctcacaggcgagattggggcggtgaccctggattttaagcctggaacatccggcagccccatcatcaaccgcaaagggaaggtgattggcctctacggaaatggcgtcgttaccaaatctggggactatgtgtccgctatcacacaggccgaacggattggagagcccgattacgaggtggacgaagatatcttcagaaagaagcggctgacgattatggaccttcaccctggcgccgggaaaaccaagcgcatcctgccgagcattgtcagagaggctctgaaacggcgcctcagaacactgatccttgcccccacccgggtggttgcggctgaaatggaggaagccctgagaggactccctatccgctatcagacccccgccgtgaagtctgagcatacaggccgggagattgtcgatctgatgtgccacgctacgtttaccacaagactcctgtccagcacccgcgtgcctaactacaatcttatcgttatggacgaagcccacttcacagatccctcctctgtggctgcccgggggtacattagcaccagagtcgagatgggcgaagcggccgctatctttatgacggccacacctccgggagctaccgaccccttccctcaatccaacagccccattgaggatatcgaacgcgagatccctgagcggtcttggaataccggctttgactggattacagactatcaggggaaaaccgtgtggttcgtcccctccatcaaggccggaaacgatattgccaattgcctgagaaagagcggcaaaaaggtgatccagctgtctcgcaaaacatttgacaccgaatacccgaagacgaaactcacagattgggacttcgttgtgaccacagatattagcgagatgggggctaactttagagcgggacgggtgatcgaccctcgcagatgtctgaagcccgtcatccttaccgatggccccgaacgggttattctggccgggcctatccccgtgacgcctgcttccgccgcccaacgcagaggccggattggaagaaacccggctcaggaggacgatcagtatgtgttctctggcgaccccctcaagaatgatgaagaccatgcccactggaccgaggcgaaaatgctgctggataacatctacacacctgaggggattatccccaccctcttcggacctgaacgcgagaagacacaggctattgacggcgaatttcggcttagaggggagcaacgcaaaaccttcgtcgagctgatgcggagaggagacctgcccgtgtggctcagctataaggttgcctccgccggcatctcttacaaagatcgggaatggtgctttacaggcgagcgcaataaccagatcctggaagagaatatggaagtggagatttggaccagagagggggaaaagaagaaacttcggccgcgctggctggacgctagagtctatgccgatcctatggcgctcaaggacttcaaagagtttgccagcggacggaagtccatcacgctggatattctgacagaaatcgctagcctccccacctacctttcttcccgcgccaaactggctctggacaacattgtgatgctccataccacagagagaggcgggcgggcctaccagcacgctctgaatgaacttcctgagagcctggagaccctcatgctggtcgccctgctcggagcgatgacagccggcatcttcctttttttcatgcaggggaagggaatcggcaagctgtccatgggcctgattgctatcgccgtggcttctgggctcctgtgggttgccgaaattcaaccccagtggatcgccgctagcattatccttgagtttttcctgatggtgctcctgatccctgaacccgagaaacagcgcacgccgcaggataaccaactgatttatgtcatcctcaccattcttacaatcattggactgatcgcggccaatgaaatgggcctgattgagaagaccaaaacagactttgggttctaccaggtgaagaccgagacgaccatcctcgatgttgacctgagacctgcttccgcctggacactttatgccgtggctaccacaatcctgacccccatgctccggcacacgattgaaaacacatctgccaatctgagcctggcggccatcgctaaccaggccgctgtcctcatgggacttggcaaagggtggcccctgcatagaatggatctgggagtgcctctcctggccatgggctgttactcccaggtgaatccgaccacacttaccgcgagcctggttatgctcctggtccactatgccattatcggccccgggctgcaagctaaggccacccgcgaggctcagaaacggacagccgctggaattatgaagaaccctacggtggacggcatcaccgtgatcgatctcgaacccatttcttacgaccctaagtttgagaaacagcttgggcaagtcatgctgctggttctctgcgccggacagctgcttctgatgagaacaacctgggcgttctgtgaggtgctcacactggccaccggccccatcctgacgctctgggaagggaatcctggacgcttctggaacacaaccattgctgtgtccaccgccaacatctttcggggcagctatcttgctggcgccgggctggccttctctctgattaagaatgcgcagacaccgagacgcggaaccggcacaacgggggagaccctcggagaaaaatggaagcggcagctgaactcccttgacagaaaagagtttgaagagtacaagcgcagcggcatcctggaggtcgatcggacagaagctaagtctgccctcaaagacgggagcaagatcaaacatgctgtgtccagaggatctagcaagattcgctggatcgttgagcggggcatggtgaaacccaagggcaaggtcgtggatctggggtgcggaagaggcgggtggtcctactatatggccaccctgaaaaatgttacagaagtgaagggatacaccaaaggcgggcctggacacgaggaacccattcctatggccacgtatggctggaacctcgtcaagcttcatagcggcgtggacgtgttctacaaacccaccgagcaagtcgatacactgctgtgtgacatcggggagtcctctagcaatccgaccattgaagagggacgcacactcagagttctgaagatggtggaaccttggctttcctctaagcccgagttttgcatcaaagtgctgaacccctatatgcctaccgtcattgaagagctcgagaagctgcagcggaaacacggcgggaatctggtgcgctgtcccctcagcagaaactccacacacgaaatgtactgggtttctggagctagcggcaatatcgtgtccagcgtcaacaccacgtctaagatgcttctgaatcggttcacaaccagacatcggaaacctacctatgagaaggatgtggacctgggggccggaacacgctccgttagcacggaaaccgagaaaccggatatgacaatcattggcagacggctccagcgcctgcaggaggaacacaaggagacctggcattacgaccaagaaaacccctacagaacatgggcgtatcacggctcttacgaggccccttccaccgggagcgcttcttccatggtgaatggagtcgtgaagcttctgacaaaaccctgggatgttatccctatggtgacccagctcgccatgacggacaccacaccctttggccagcagcgggtcttcaaggaaaaagtggacacccgcacaccgcaacctaagcccgggaccagaatggtcatgacgacaaccgctaactggctgtgggccctgctcggaaaaaagaagaatcctcggctgtgcacacgcgaggagtttattagcaaagtgagatccaacgcggccatcggcgctgttttccaggaagagcaggggtggaccagcgcctctgaagctgtgaatgatagccggttttgggagcttgtcgacaaggaacgcgccctgcaccaagagggcaaatgtgagtcctgcgtgtataacatgatgggaaagagagaaaaaaagctcggcgagttcgggcgggctaagggatctcgcgccatttggtacatgtggctgggcgcgagatttcttgaattcgaggccctggggttcctcaacgaagatcattggtttggacgggagaatagctggtccggcgtggagggggaaggcctgcacagactgggatatatcctcgaggaaatcgacaaaaaggatggcgacctgatgtacgctgatgacacggccgggtgggatacccgcattacagaggacgatcttcagaacgaggaactgatcaccgagcagatggctccccatcacaaaattctcgccaaggccatcttcaaactgacatatcagaataaggttgtgaaggtccttcggcctacccccagaggagcggtgatggacattatctctcgcaaagatcaacggggcagcgggcaggttggaacatacggcctgaacacctttacgaatatggaagtgcagctcatcagacagatggaggctgaaggggtcattacacaagacgacatgcagaacccgaagggcctgaaagagcgcgtggagaagtggctgcgggaatgcggagtcgatagactcaaacgcatggccatctccggcgacgattgtgtggttaagcctctggacgagcggttcgggacctctcttctgtttctcaatgatatgggaaaagtgagaaaggacattccccagtgggaacccagcaagggctggaaaaactggcaggaggtccctttctgctcccatcactttcacaagatcttcatgaaagatgggcgcagcctggtggttccgtgtcggaatcaagacgaacttattggaagagcccggatctctcagggcgctgggtggtccctgagagagaccgcctgcctcggcaaggcttacgcccagatgtggagcctgatgtattttcatcgccgggatctgagactcgcgtctatggccatctgttccgctgtgcccacagagtggttccctaccagccgcacaacgtggtccattcacgcccatcaccagtggatgaccacagaagacatgctgaaagtctggaacagagtgtggatcgaggataatcccaacatgaccgacaagacacctgtgcactcttgggaagacattccctaccttggaaagcgggaggatctgtggtgcggcagcctcatcgggctgtccagccgcgctacctgggccaaaaatattcatacggcgatcacccaagttagaaaccttattggaaaggaagagtatgtcgactacatgcctgtgatgaaacggtattctgccctgtccgagagcgaaggcgtgctctga

SEQ ID NO: 20990 - RNA, 9867 nt, synthetic construct
  misc_feature 1..9867: note = derived and/or modified CDS sequence (opt5) from DENV-4__EU854299__SS-prME
  source 1..9867: mol_type = other RNA
agcaccatcacactgctctgcctgattcccacggtgatggccttccacctttccaccagagacggcgagcctctgatgatcgtcgctaagcatgaacgggggcgcccgctcctgtttaaaacaaccgagggaattaacaagtgtacacttatcgccatggatctgggcgaaatgtgcgaggacaccgttacatacaaatgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggatccttagaaatcctggcttcgctctgctcgccggctttatggcttacatgatcgggcagacaggaattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctcttattagcaatatcaccacagccacccgctgcccgacgcaaggagagccctatctgaaggaggaacaggaccagcagtacatttgtagacgggatgtggtggaccgcggctgggggaacggatgcggcctcttcgggaaaggaggcgtcgtgacatgcgcgaagttttcttgttccggcaaaatcaccgggaatctggttcaaattgagaaccttgaatataccgtggtcgtgacagttcataatggagatacccacgccgtgggcaacgacacaagcaatcacggggtcacggctaccatcacacctagatctccctccgtggaggtcaagctgcctgattacggagaactcaccctggactgcgagccccggagcggcatcgacttcaacgagatgattctgatgaagatgaaaaagaaaacatggctcgtgcataagcagtggtttctggatcttccgctgccttggaccacgggggccgacacctctgaagttcactggaattacaaagagagaatggtgacattcaaggtcccccatgctaaacgccaggatgtgaccgttctcggctcccaggaaggagccatgcacagcgccctggctggcgcgacagaggtggactccggggatggaaaccacatgtttgccggccatcttaagtgtaaggtccggatggaaaaactgagaatcaaggggatgtcttataccatgtgcagcggaaaattctccattgacaaggagatggctgagacgcaacacggcacaaccgtggtgaaagttaagtacgaaggggccggcgccccttgtaaggtccccatcgagattcgcgatgtgaataaagaaaaggtggtcggacgggtgatcagcgctacacccctcgccgagaacaccaactctgttaccaatatcgagctggaacctccgttcggcgactcctatattgtgatcggggtcggaaacagcgcgctgacactccattggtttagaaaaggctctagcattgggaagatgttcgagtccacgtaccgcggagctaaacggatggccatcctgggcgaaaccgcctgggattttgggtctgtgggcggacttttcacaagcctgggcaaggctgttcaccaggtgtttgggtccgtctataccacaatgttcggaggcgtgagctggatgattagaatcctcatcgggtttctggttctgtggattggaaccaattctcgcaacacgtccatggccatgacatgcatcgctgtgggcgggattacccttttcctcggctttaccgtccaggccgacatgggatgtgtggtgagctggtctggccgggagctgaagtgcgggtccggaatcttcgtcgttgataatgtgcatacatggaccgaacaatacaaatttcagcccgagagccctgcgagactggcctccgctattctcaacgcccacaaggacggcgtgtgtgggatccgctctacaacgcggctggagaatgtcatgtggaaacagattaccaacgaacttaattatgtgctgtgggagggaggccacgacctcacagttgtggctggcgatgtcaagggggtgctgaccaaaggaaagagagccctgacaccccctgcgagcgaccttaagtactcctggaaaacctggggcaaggccaaaatcttcacgcccgaagctcggaactctacctttctcatcgatgggccggacacaagcgagtgccctaatgaacgcagagcctggaactccttcgaggttgaggattacggattcggcatgtttaccacaaatatttggatgaagttccgggaagggagctctgaggtgtgtgaccatagactgatgtccgctgccatcaaagatcagaaggccgtccacgctgacatgggatattggattgaaagctctaaaaaccaaacctggcagatcgagcgcgcgtccctgattgaagtgaagacatgcctctggcccaagacccatacgctgtggagcaatggcgttcttgagtctcagatgctgatccctaaaagctacgccggccccttttcccagcacaactatcggcaagggtacgctacacagaccgtgggaccttggcacctcggcaagctggagatcgatttcggggaatgccccggaaccacagtcaccattcaggagaactgtgaccatagaggcccgagcctgcgcacgacaaccgcctctgggaaacttgtgacacagtggtgctgtagatcctgcaccatgcctcccctccggtttctgggagaagatggctgttggtatggcatggagatccgccccctgagcgagaaggaagagaatatggtgaaatcccaagtcacagccgggcagggaacctctgaaacgttcagcatgggcctcctgtgccttaccctgtttgttgaggaatgtctcagacggcgcgtgacaagaaagcacatgattctggctgtggtcatcaccctgtgcgccattatccttgggggactcacatggatggacctgctgcgggcgctcatcatgctgggcgataccatgtccgggcgcattggaggccagacgcatcttgctatcatggccgtgttcaagatgtctcctggctacgttctgggggtgtttctcagaaaactgacaagccgggagaccgccctgatggtcattggaatggctatgacaaccaccctttccatcccgcacgacctgatggagctcattgacggcatctctctggggctcatcctgcttaagattgtgacacagttcgataacacgcaagttggaaccctggccctcagcctgacatttatccgctccaccatgagcctggtgatggcgtggagaacaattatggctgtccttttcgtggtcaccctgatccccctctgtcggacgtcttgcctgcagaaacagtcccattgggtggaaattacagccctcatcctgggcgcccaagctcttcctgtttatctgatgaccctcatgaagggggccagcagacgctcttggcccctgaatgagggaattatggctgtgggcctggtctcccttctgggcagcgccctcctgaaaaacgacgtgcctctcgcggggcccatggttgccggaggcctgcttctggctgcctacgtgatgtctgggtccagcgctgatctgtccctcgaaaaggccgccaatgtccagtgggacgagatggctgatatcaccggaagctctcctatcattgaagtgaagcaggacgaggatggcagcttttccatccgggacgtggaggaaacaaacatgattaccctgcttgttaaactggcgctcatcacagtctctgggctgtaccccctcgccattccgatcacgatgaccctgtggtatatgtggcaggtgaagacacaaagaagcggagctctttgggatgtgccttcccccgccgccacccagaaagctgccctgtctgagggcgtctaccgcatcatgcagcggggcctgttcgggaagacacaggtgggagttggcattcacatggaaggggtgttccacaccatgtggcatgtcacgagaggaagcgtgatctgtcacgagaccggccgcctcgaaccttcctgggcggacgttcggaatgatatgatttcttatgggggaggctggagactgggcgacaaatgggataaggaggaggacgtgcaagtccttgctatcgaacccgggaagaacccgaaacatgtgcagacaaagcctggactgtttaaaaccctcacaggcgagattggggccgttaccctggacttcaagcccggaacaagcggctcccctatcatcaatcgcaaagggaaggtgattggcctctacggaaacggcgtcgtgacgaaaagcggggattatgtgtctgccatcacccaggctgaacggattggagagcccgactacgaggtcgatgaagacatctttagaaagaagcggctgacaattatggatcttcaccccggcgccgggaaaaccaagcgcatcctgccttccattgttagagaggcgctgaaacggcgcctcagaaccctgatccttgctccgacacgggtggtggccgccgaaatggaggaagctctgagaggactccccatccgctatcagacgcctgccgtcaagagcgagcataccggccgggagattgtggacctgatgtgccacgctacattcaccacaagactcctgtcttccacccgcgttcccaattacaaccttatcgtgatggatgaagcccactttacggaccctagctccgtcgcggcccgggggtacatttctacaagagtggagatgggcgaagctgccgctatcttcatgaccgccaccccccctggagccacagatccgtttccccaaagcaattcccctattgaggacatcgaacgcgagatccccgagcggagctggaacaccggcttcgattggattacagactatcaggggaaaaccgtttggtttgtgccttctatcaaggctggaaatgacattgcgaactgcctgagaaagtccggcaaaaaggtcatccagctgagccgcaaaacgttcgatacagaataccccaagaccaaactcacagactgggattttgtggtcaccacggacatttctgagatgggggccaacttcagagctggacgggtgatcgatccgcgcagatgtctgaagcctgttatccttaccgacggccccgaacgggtgattctggccgggcccatccctgtgacacccgccagcgctgcccaacgcagaggccggattggaagaaatcctgcgcaggaggatgaccagtatgtcttctccggcgatccgctcaagaacgacgaagatcatgctcactggaccgaggccaaaatgctgctggacaatatctacacacccgaggggattatccctaccctctttggacccgaacgcgagaagacacaggccattgatggcgaattccggcttagaggggagcaacgcaaaacctttgttgagctgatgcggagaggagacctgcctgtgtggctctcttataaggtggctagcgccggcatctcctacaaagaccgggaatggtgcttcacgggcgagcgcaacaatcagatcctggaagagaacatggaagtcgagatttggacaagagagggggaaaagaagaaacttcggcccaagtggctggatgcgcgcgtgtatgccgacccgatggctctcaaagattttaaggagttcgcctctggaagaaaaagcatcaccctggacattctgaccgaaatcgcttccctccctacataccttagctctcgggccaagctggctctggataatattgttatgctccataccacagagcgcggcgggagagcctaccagcacgcgctgaacgaacttcccgagtccctggagacgctcatgctggtggccctgctcggagctatgaccgccggcatctttcttttctttatgcaggggaagggaatcggcaaactgagcatgggcctgattacaatcgctgtcgcctccgggctcctgtgggtggccgaaattcaacctcagtggatcgctgcgtctattatccttgagttctttctgatggtcctcctgatccccgaacctgagaagcagcggaccccccaggacaatcaactgatttatgtgatcctcacaattcttaccatcattggactgatcgccgctaacgaaatgggcctgattgagaaaacgaagaccgatttcgggttttaccaggttaaaacagagaccacaatcctcgacgtggatctgcgcccggccagcgcctggaccctttatgctgtcgccacgacaatcctgacccctatgctcagacacacaattgaaaatacctccgcgaacctgtctctggccgctatcgccaatcaggctgccgtgctcatgggacttggcaaggggtggcccctgcatcggatggacctgggagttcccctcctggcgatgggctgttacagccaggtgaaccctaccacacttacggcctccctggtcatgctcctggtgcactatgctattatcggcccggggctgcaagccaaagctaccagagaggcccagaagcgcacagctgccggaattatgaagaatcccaccgtggatggcatcacagttatcgacctcgaacctattagctacgatcccaaattcgagaagcagcttgggcaagtcatgctgctggtgctctgcgcgggacagctgcttctgatgcggaccacgtgggccttctgtgaggtgctcacactggctaccggccctatcctgaccctctgggaagggaaccccggaagattttggaacacaaccattgccgtctctacagctaatatcttccgcggctcctatcttgccggcgccgggctggcgtttagcctgattaaaaacgctcagacgcctcggagaggaaccggcacaaccggggagacactcggagaaaagtggaaacgccagctgaattctcttgaccggaaggagttcgaagagtacaagagatccggcatcctggaggttgaccgcaccgaagccaaaagcgctctcaaggatgggtctaaaatcaagcatgccgtgagccggggatcctctaaaattagatggatcgtggagcgcggcatggtcaagccgaagggcaaagtggttgacctggggtgcggacggggcgggtggagctactatatggccacgctgaagaacgtgaccgaagtcaaaggatacacaaagggcgggcccggacacgaggaacctattcccatggctacctatggctggaatctcgtgaaacttcattccggcgttgatgtgttttacaagcctacagagcaagtcgacaccctgctgtgtgatatcggggagagctcctctaaccccacaattgaagagggaagaaccctccgcgtgctgaagatggtggaaccgtggcttagctccaaacctgagttctgcatcaaggtcctgaatccctatatgcccacggttattgaagagctcgagaaactgcagagaaagcacggcgggaacctggtgcggtgtcctctctctcgcaatagcacacacgaaatgtactgggtgtccggagcctctggcaacatcgtcagctccgtgaataccaccagcaaaatgcttctgaacagatttacaacgcggcatagaaagcccacctatgagaaagacgttgatctgggggcgggaacacggtctgtgtccaccgaaacagagaagcctgacatgaccatcattggccgcagactccagcggctgcaggaggaacacaaggagacatggcattacgatcaagaaaatccgtaccgcacctgggcctatcacggcagctacgaggctccctctacggggtccgccagctctatggtcaacggagtggttaaacttctgaccaagccttgggacgtgatccccatggtcacacagctcgctatgaccgatacaacccctttcggccagcagagagtgtttaaagaaaaggttgacacgcggacaccccaaccgaaacctgggacccgcatggtgatgacaaccacggccaattggctgtgggcgctgctcggaaagaagaaaaaccccagactgtgcacccgggaggagttcatttccaaggtccgcagcaatgccgctatcggcgccgtgtttcaggaagagcaggggtggacatccgctagcgaagccgtcaacgactctagattctgggagcttgtggataaagaacgggctctgcaccaagagggcaagtgtgagagctgcgtttataacatgatgggaaaacgcgaaaagaagctcggcgagtttgggagagccaaaggatcccgggcgatttggtacatgtggctgggcgcccgcttccttgaattcgaggctctggggtttctcaatgaagaccattggttcggaagagagaactcttggagcggcgtggagggggaaggcctgcaccggctgggatatatcctcgaggaaatcgataagaaagacggcgatctgatgtacgccgacgataccgctgggtgggacacaagaattaccgaggatgaccttcagaatgaggaactgatcacagagcagatggcccctcatcacaagattctcgccaaagcgatctttaagctgacctatcagaacaaggtcgtgaaagtgcttcgccccacgcctcggggagctgttatggatattatctccagaaaggaccaacgcggctctgggcaggtgggaacatacggcctgaataccttcaccaacatggaagtccagctcatccggcagatggaggccgaaggggtgattacacaagatgacatgcagaatcccaaaggcctgaaggagagagttgagaaatggctgcgcgaatgcggagtggaccggctcaagagaatggccatcagcggcgatgactgtgtcgtgaaaccgctggatgagcgctttgggacctcccttctgttcctcaacgacatgggaaaggtccggaaggatattcctcagtgggaaccctctaaaggctggaagaattggcaggaggtgcccttttgcagccatcacttccacaaaatctttatgaaggacgggagatccctggttgtgccttgtcgcaaccaagatgaacttattggacgggctagaatcagccagggcgccgggtggtctctgcgggagacagcttgcctcggcaaagcctacgcgcagatgtggtccctgatgtatttccatagacgcgacctgcggctcgccagcatggctatctgttctgccgtcccgacggagtggtttcccacctccagaacaacctggagcattcacgctcatcaccagtggatgacaaccgaagatatgctgaaggtgtggaatcgcgtttggatcgaggacaaccctaatatgattgataagacgcccgtgcactcctgggaagacatcccttaccttggaaaaagagaggacctgtggtgcggctctctcattgggctgagctcccgggccacctgggcgaagaacatccatacagccattacccaagtccgcaatcttatcggaaaagaagagtatgtggattacatgcccgtgatgaagagatatagcgctccttctgagtccgaaggcgttctgtga

SEQ ID NO: 20991 - RNA, 9867 nt, synthetic construct
  misc_feature 1..9867: note = derived and/or modified CDS sequence (opt5) from DENV-4__FJ182016__SS-prME
  source 1..9867: mol_type = other RNA
agcaccatcacactgctctgcctgattcccacggtgatggccttccacctttccaccagagacggcgagcctctgatgatcgtcgctaagcatgaacgggggcgcccgctcctgtttaaaacaaccgagggaattaacaagtgtacacttatcgccatggatctgggcgaaatgtgcgaggacaccgttacatacaaatgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggatccttagaaatcctggcttcgctctgctcgccggctttatggcttacatgatcgggcagacaggaattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctcttattagcaatatcaccacagccacccgctgcccgacgcaaggagagccctatctgaaggaggaacaggaccagcagtacatttgtagacgggatgtggtggaccgcggctgggggaacggatgcggcctcttcgggaaaggaggcgtcgtgacatgcgcgaagttttcttgttccggcaaaatcaccgggaatctggttcaaattgagaaccttgaatataccgtggtcgtgacagttcataatggagatacccacgccgtgggcaacgacacaagcaatcacggggtcacggctaccatcacacctagatctccctccgtggaggtcaagctgcctgattacggagaactcaccctggactgcgagccccggagcggcatcgacttcaacgagatgattctgatgaagatgaaaaagaaaacatggctcgtgcataagcagtggtttctggatcttccgctgccttggaccacgggggccgacacctctgaagttcactggaattacaaagagagaatggtgacattcaaggtcccccatgctaaacgccaggatgtgaccgttctcggctcccaggaaggagccatgcacagcgccctggctggcgcgacagaggtggactccggggatggaaaccacatgtttgccggccatcttaagtgtaaggtccggatggaaaaactgagaatcaaggggatgtcttataccatgtgcagcggaaaattctccattgacaaggagatggctgagacgcaacacggcacaaccgtggtgaaagttaagtacgaaggggccggcgccccttgtaaggtccccatcgagattcgcgatgtgaataaagaaaaggtggtcggacgggtgatcagcgctacacccctcgccgagaacaccaactctgttaccaatatcgagctggaacctccgttcggcgactcctatattgtgatcggggtcggaaacagcgcgctgacactccattggtttagaaaaggctctagcattgggaagatgttcgagtccacgtaccgcggagctaaacggatggccatcctgggcgaaaccgcctgggattttgggtctgtgggcggacttttcacaagcctgggcaaggctgttcaccaggtgtttgggtccgtctataccacaatgttcggaggcgtgagctggatgattagaatcctcatcgggtttctggttctgtggattggaaccaattctcgcaacacgtccatggccatgacatgcatcgctgtgggcgggattacccttttcctcggctttaccgtccaggccgacatgggatgtgtggtgagctggtctggccgggagctgaagtgcgggtccggaatcttcgtcgttgataatgtgcatacatggaccgaacaatacaaatttcagcccgagagccctgcgagactggcctccgctattctcaacgcccacaaggacggcgtgtgtgggatccgctctacaacgcggctggagaatgtcatgtggaaacagattaccaacgaacttaattatgtgctgtgggagggaggccacgacctcacagttgtggctggcgatgtcaagggggtgctgaccaaaggaaagagagccctgacaccccctgcgagcgaccttaagtactcctggaaaacctggggcaaggccaaaatcttcacgcccgaagctcggaactctacctttctcatcgatgggccggacacaagcgagtgccctaatgaacgcagagcctggaactccttcgaggttgaggattacggattcggcatgtttaccacaaatatttggatgaagttccgggaagggagctctgaggtgtgtgaccatagactgatgtccgctgccatcaaagatcagaaggccgtccacgctgacatgggatattggattgaaagctctaaaaaccaaacctggcagatcgagcgcgcgtccctgattgaagtgaagacatgcctctggcccaagacccatacgctgtggagcaatggcgttcttgagtctcagatgctgatccctaaaagctacgccggccccttttcccagcacaactatcggcaagggtacgctacacagaccgtgggaccttggcacctcggcaagctggagatcgatttcggggaatgccccggaaccacagtcaccattcaggagaactgtgaccatagaggcccgagcctgcgcacgacaaccgcctctgggaaacttgtgacacagtggtgctgtagatcctgcaccatgcctcccctccggtttctgggagaagatggctgttggtatggcatggagatccgccccctgagcgagaaggaagagaatatggtgaaatcccaagtcacagccgggcagggaacctctgaaacgttcagcatgggcctcctgtgccttaccctgtttgttgaggaatgtctcagacggcgcgtgacaagaaagcacatgattctggctgtggtcatcaccctgtgcgccattatccttgggggactcacatggatggacctgctgcgggcgctcatcatgctgggcgataccatgtccgggcgcattggaggccagacgcatcttgctatcatggccgtgttcaagatgtctcctggctacgttctgggggtgtttctcagaaaactgacaagccgggagaccgccctgatggtcattggaatggctatgacaaccaccctttccatcccgcacgacctgatggagctcattgacggcatctctctggggctcatcctgcttaagattgtgacacagttcgataacacgcaagttggaaccctggccctcagcctgacatttatccgctccaccatgagcctggtgatggcgtggagaacaattatggctgtccttttcgtggtcaccctgatccccctctgtcggacgtcttgcctgcagaaacagtcccattgggtggaaattacagccctcatcctgggcgcccaagctcttcctgtttatctgatgaccctcatgaagggggccagcagacgctcttggcccctgaatgagggaattatggctgtgggcctggtctcccttctgggcagcgccctcctgaaaaacgacgtgcctctcgcggggcccatggttgccggaggcctgcttctggctgcctacgtgatgtctgggtccagcgctgatctgtccctcgaaaaggccgccaatgtccagtgggacgagatggctgatatcaccggaagctctcctatcattgaagtgaagcaggacgaggatggcagcttttccatccgggacgtggaggaaacaaacatgattaccctgcttgttaaactggcgctcatcacagtctctgggctgtaccccctcgccattccgatcacgatgaccctgtggtatatgtggcaggtgaagacacaaagaagcggagctctttgggatgtgccttcccccgccgccacccagaaagctgccctgtctgagggcgtctaccgcatcatgcagcggggcctgttcgggaagacacaggtgggagttggcattcacatggaaggggtgttccacaccatgtggcatgtcacgagaggaagcgtgatctgtcacgagaccggccgcctcgaaccttcctgggcggacgttcggaatgatatgatttcttatgggggaggctggagactgggcgacaaatgggataaggaggaggacgtgcaagtccttgctatcgaacccgggaagaacccgaaacatgtgcagacaaagcctggactgtttaaaaccctcacaggcgagattggggccgttaccctggacttcaagcccggaacaagcggctcccctatcatcaatcgcaaagggaaggtgattggcctctacggaaacggcgtcgtgacgaaaagcggggattatgtgtctgccatcacccaggctgaacggattggagagcccgactacgaggtcgatgaagacatctttagaaagaagcggctgacaattatggatcttcaccccggcgccgggaaaaccaagcgcatcctgccttccattgttagagaggcgctgaaacggcgcctcagaaccctgatccttgctccgacacgggtggtggccgccgaaatggaggaagctctgagaggactccccatccgctatcagacgcctgccgtcaagagcgagcataccggccgggagattgtggacctgatgtgccacgctacattcaccacaagactcctgtcttccacccgcgttcccaattacaaccttatcgtgatggatgaagcccactttacggaccctagctccgtcgcggcccgggggtacatttctacaagagtggagatgggcgaagctgccgctatcttcatgaccgccaccccccctggagccacagatccgtttccccaaagcaattcccctattgaggacatcgaacgcgagatccccgagcggagctggaacaccggcttcgattggattacagactatcaggggaaaaccgtttggtttgtgccttctatcaaggctggaaatgacattgcgaactgcctgagaaagtccggcaaaaaggtcatccagctgagccgcaaaacgttcgatacagaataccccaagaccaaactcacagactgggattttgtggtcaccacggacatttctgagatgggggccaacttcagagctggacgggtgatcgatccgcgcagatgtctgaagcctgttatccttaccgacggccccgaacgggtgattctggccgggcccatccctgtgacacccgccagcgctgcccaacgcagaggccggattggaagaaatcctgcgcaggaggatgaccagtatgtcttctccggcgatccgctcaagaacgacgaagatcatgctcactggaccgaggccaaaatgctgctggacaatatctacacacccgaggggattatccctaccctctttggacccgaacgcgagaagacacaggccattgatggcgaattccggcttagaggggagcaacgcaaaacctttgttgagctgatgcggagaggagacctgcctgtgtggctctcttataaggtggctagcgccggcatctcctacaaagaccgggaatggtgcttcacgggcgagcgcaacaatcagatcctggaagagaacatggaagtcgagatttggacaagagagggggaaaagaagaaacttcggcccaagtggctggatgcgcgcgtgtatgccgacccgatggctctcaaagattttaaggagttcgcctctggaagaaaaagcatcaccctggacattctgaccgaaatcgcttccctccctacataccttagctctcgggccaagctggctctggataatattgttatgctccataccacagagcgcggcgggagagcctaccagcacgcgctgaacgaacttcccgagtccctggagacgctcatgctggtggccctgctcggagctatgaccgccggcatctttcttttctttatgcaggggaagggaatcggcaaactgagcatgggcctgattacaatcgctgtcgcctccgggctcctgtgggtggccgaaattcaacctcagtggatcgctgcgtctattatccttgagttctttctgatggtcctcctgatccccgaacctgagaagcagcggaccccccaggacaatcaactgatttatgtgatcctcacaattcttaccatcattggactgatcgccgctaacgaaatgggcctgattgagaaaacgaagaccgatttcgggttttaccaggttaaaacagagaccacaatcctcgacgtggatctgcgcccggccagcgcctggaccctttatgctgtcgccacgacaatcctgacccctatgctcagacacacaattgaaaatacctccgcgaacctgtctctggccgctatcgccaatcaggctgccgtgctcatgggacttggcaaggggtggcccctgcatcggatggacctgggagttcccctcctggcgatgggctgttacagccaggtgaaccctaccacacttacggcctccctggtcatgctcctggtgcactatgctattatcggcccggggctgcaagccaaagctaccagagaggcccagaagcgcacagctgccggaattatgaagaatcccaccgtggatggcatcacagttatcgacctcgaacctattagctacgatcccaaattcgagaagcagcttgggcaagtcatgctgctggtgctctgcgcgggacagctgcttctgatgcggaccacgtgggccttctgtgaggtgctcacactggctaccggccctatcctgaccctctgggaagggaaccccggaagattttggaacacaaccattgccgtctctacagctaatatcttccgcggctcctatcttgccggcgccgggctggcgtttagcctgattaaaaacgctcagacgcctcggagaggaaccggcacaaccggggagacactcggagaaaagtggaaacgccagctgaattctcttgaccggaaggagttcgaagagtacaagagatccggcatcctggaggttgaccgcaccgaagccaaaagcgctctcaaggatgggtctaaaatcaagcatgccgtgagccggggatcctctaaaattagatggatcgtggagcgcggcatggtcaagccgaagggcaaagtggttgacctggggtgcggacggggcgggtggagctactatatggccacgctgaagaacgtgaccgaagtcagaggatacacaaaaggcgggcccggacacgaggaacctattcccatggctacctatggctggaatctcgtgaagcttcattccggcgttgatgtgttttacaaacctacagagcaagtcgacaccctgctgtgtgatatcggggagagctcctctaaccccacaattgaagagggacgcaccctcagagtgctgaagatggtggaaccgtggcttagctccaagcctgagttctgcatcaaagtcctgaatccctatatgcccacggttattgaagagctcgagaagctgcagcggaaacacggcgggaacctggtgcgctgtcctctctctagaaatagcacacacgaaatgtactgggtgtccggagcctctggcaacatcgtcagctccgtgaataccaccagcaagatgcttctgaaccggtttacaacgagacatcggaaacccacctatgagaaggacgttgatctgggggcgggaacacgctctgtgtccaccgaaacagagaaacctgacatgaccatcattggcagacggctccagcgcctgcaggaggaacacaaggagacatggcattacgatcaagaaaatccgtacagaacctgggcctatcacggcagctacgaggctccctctacggggtccgccagctctatggtcaacggagtggttaagcttctgaccaaaccttgggacgtgatccccatggtcacacagctcgctatgaccgatacaacccctttcggccagcagcgggtgtttaaggaaaaagttgacacgcgcacaccccaaccgaagcctgggaccagaatggtgatgacaaccacggccaattggctgtgggcgctgctcggaaaaaagaagaacccccggctgtgcacccgcgaggagttcatttccaaagtcagaagcaatgccgctatcggcgccgtgtttcaggaagagcaggggtggacatccgctagcgaagccgtcaacgactctcggttctgggagcttgtggataaggaacgcgctctgcaccaagagggcaaatgtgagagctgcgtttataacatgatgggaaagagagaaaaaaagctcggcgagtttgggcgggccaagggatcccgcgcgatttggtacatgtggctgggcgccagattccttgaattcgaggctctggggtttctcaatgaagaccattggttcggacgggagaactcttggagcggcgtggagggggaaggcctgcacagactgggatatatcctcgaggaaatcgataaaaaggacggcgatctgatgtacgccgacgataccgctgggtgggacacacgcattaccgaggatgaccttcagaatgaggaactgatcacagagcagatggcccctcatcacaaaattctcgccaaggcgatctttaaactgacctatcagaacaaggtcgtgaaggtgcttcggcccacgcctagaggagctgttatggatattatctcccgcaaagaccaacggggctctgggcaggtgggaacatacggcctgaataccttcaccaacatggaagtccagctcatcagacagatggaggccgaaggggtgattacacaagatgacatgcagaatcccaagggcctgaaagagcgcgttgagaagtggctgcgggaatgcggagtggacagactcaaacgcatggccatcagcggcgatgactgtgtcgtgaagccgctggatgagcggtttgggacctcccttctgttcctcaacgacatgggaaaagtcagaaaggatattcctcagtgggaaccctctaagggctggaaaaattggcaggaggtgcccttttgcagccatcacttccaccgcatctttatgaaggacgggcggtccctggttgtgccttgtagaaaccaagatgaacttattggacgggctagaatcagccagggcgccgggtggtctctgcgcgagacagcttgcctcggcaaagcctacgcgcagatgtggtccctgatgtatttccatcggagagacctgcgcctcgccagcatggctatctgttctgccgtcccgacggagtggtttcccacctccagaacaacctggagcattcacgctcatcaccagtggatgacaaccgaagatatgctgaaggtgtggaatcgggtttggatcgaggacaaccctaatatgattgataaaacgcccgtgcactcctgggaagacatcccttaccttggaaagcgcgaggacctgtggtgcggctctctcattgggctgagctccagagccacctgggcgaagaacatccatacagccattacccaagtccggaatcttatcggaaaagaagagtatgtggattacatgcccgtgatgaagcgctatagcgctccttctgagtccgaaggcgttctgtga

SEQ ID NO: 20992 - RNA, 9867 nt, synthetic construct
  misc_feature 1..9867: note = derived and/or modified CDS sequence (opt5) from DENV-4__EU854300__SS-prME
  source 1..9867: mol_type = other RNA
agcaccatcacactgctctgcctgattcccacggtgatggccttccacctttccaccagagacggcgagcctctgatgatcgtcgctaagcatgaacgggggcgcccgctcctgtttaaaacaaccgagggaattaacaagtgtacacttatcgccatggatctgggcgaaatgtgcgaggacaccgttacatacaaatgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggatccttagaaatcctggcttcgctctgctcgccggctttatggcttacatgatcgggcagacaggaattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctcttattagcaatatcaccacagccacccgctgcccgacgcaaggagagccctatctgaaggaggaacaggaccagcagtacatttgtagacgggatgtggtggaccgcggctgggggaacggatgcggcctcttcgggaaaggaggcgtcgtgacatgcgcgaagttttcttgttccggcaaaatcaccgggaatctggttcaaattgagaaccttgaatataccgtggtcgtgacagttcataatggagatacccacgccgtgggcaacgacacaagcaatcacggggtcacggctaccatcacacctagatctccctccgtggaggtcaagctgcctgattacggagaactcaccctggactgcgagccccggagcggcatcgacttcaacgagatgattctgatgaagatgaaaaagaaaacatggctcgtgcataagcagtggtttctggatcttccgctgccttggaccacgggggccgacacctctgaagttcactggaattacaaagagagaatggtgacattcaaggtcccccatgctaaacgccaggatgtgaccgttctcggctcccaggaaggagccatgcacagcgccctggctggcgcgacagaggtggactccggggatggaaaccacatgtttgccggccatcttaagtgtaaggtccggatggaaaaactgagaatcaaggggatgtcttataccatgtgcagcggaaaattctccattgacaaggagatggctgagacgcaacacggcacaaccgtggtgaaagttaagtacgaaggggccggcgccccttgtaaggtccccatcgagattcgcgatgtgaataaagaaaaggtggtcggacgggtgatcagcgctacacccctcgccgagaacaccaactctgttaccaatatcgagctggaacctccgttcggcgactcctatattgtgatcggggtcggaaacagcgcgctgacactccattggtttagaaaaggctctagcattgggaagatgttcgagtccacgtaccgcggagctaaacggatggccatcctgggcgaaaccgcctgggattttgggtctgtgggcggacttttcacaagcctgggcaaggctgttcaccaggtgtttgggtccgtctataccacaatgttcggaggcgtgagctggatgattagaatcctcatcgggtttctggttctgtggattggaaccaattctcgcaacacgtccatggccatgacatgcatcgctgtgggcgggattacccttttcctcggctttaccgtccaggccgacatgggatgtgtggtgagctggaatggccgggagctgaagtgcgggtctggaatcttcgtcgttgataacgtgcatacatggaccgaacaatacaaatttcagcccgagtcccctgcgagactggccagcgctattctcaatgcccacaaggacggcgtgtgtgggatccgctccacaacgcggctggagaacgtcatgtggaaacagattaccaatgaacttaactatgtgctgtgggagggaggccacgacctcacagttgtggctggcgatgtcaagggggtgctgaccaaaggaaagagagccctgacaccccctgcgtctgaccttaagtacagctggaaaacctggggcaaggccaaaatcttcacgcccgaaacccggaattccacatttctcatcgatgggccggacacctctgagtgccctaacgaacgcagagcttggaatagcttcgaggttgaggattacggattcggcatgtttacaaccaacatttggatgaagttccgggaagggtccagcgaggtgtgtgaccatagactgatgtctgccgctatcaaagatcagaaggccgtccacgccgacatgggatattggattgaatccagcaaaaatcaaacatggcagatcgagcgcgcttctctgattgaagtgaagacctgcctctggcccaagacgcatacactgtggtccaacggcgttcttgagagccagatgctgatccctaaatcttacgcgggcccctttagccagcacaactatcggcaagggtacgccacccagaccgtgggaccttggcacctcggcaagctggagatcgatttcggggaatgccccggaacaaccgtcacgattcaggagaattgtgaccatagaggcccgtccctgcgcacaaccacagctagcgggaaacttgtgacccagtggtgctgtagatcttgcacaatgcctcccctccggtttctgggagaagatggctgttggtatggcatggagatccgccccctgtccgagaaggaagagaacatggtgaaaagccaagtcaccgccgggcagggaacgtccgaaaccttctctatgggcctcctgtgccttacactgtttgttgaggaatgtctcagacggcgcgtgaccagaaagcacatgattctggccgtggtcatcacactgtgcgctattatccttgggggactcacctggatggacctgctgcgggccctcatcatgctgggcgatacgatgagcgggcgcattggaggccagacacatcttgcgatcatggctgtgttcaagatgtcccctggctacgttctgggggtgtttctcagaaaactgacctctcgggagacagccctgatggtcattggaatggccatgaccaccacacttagcatcccgcacgacctgatggagctcattgacggcatctccctggggctcatcctgcttaagattgtgacgcagttcgataatacccaagttggaacactggctctctctctgacctttatccgcagcacaatgtccctggtgatggcctggagaaccattatggcggtccttttcgtggtcacgctgatccccctctgtcggacaagctgcctgcagaaacagtctcattgggtggaaattaccgctctcatcctgggcgcccaagcccttcctgtttatctgatgaccctcatgaagggggcttccagacgcagctggcccctgaacgagggaattatggccgtgggcctggtctctcttctgggctccgctctcctgaaaaatgacgtgcctctcgccgggcccatggttgcgggaggcctgcttctggccgcttacgtgatgagcgggtcttccgccgatctgagcctcgaaaaggctgccaacgtccagtgggacgagatggccgatatcacaggatccagccctatcattgaagtgaagcaggacgaggatggctcttttagcatccgggacgtggaggaaaccaatatgattacactgcttgttaaactggctctcatcacggtctccgggctgtaccccctcgcgattccgatcaccatgacactgtggtatatgtggcaggtgaagacccaaagatctggagccctttgggatgtgcctagccccgctgccacacagaaagccgctctgtccgagggcgtctaccgcatcatgcagcggggcctgttcgggaagacccaggtgggagttggcattcacatcgaaggggtgttccacacgatgtggcatgtcaccagaggatctgtgatttgtcacgagacaggccgcctcgaacctagctgggccgacgttcggaacgatatgatctcctatgggggaggctggagactgggcgacaaatgggataaggaggaggacgtgcaagtccttgcgattgaacccgggaagaatccgaaacatgtgcagaccaagcctggactgtttaaaacactcaccggcgagatcggggctgttacactggacttcaagcccggaacgtctggcagccctatcattaaccgcaaagggaaggtgatcggcctctacggaaatggcgtcgtgaccaaatccggggattatgtgagcgccattacacaggccgaacggatcggagagcccgactacgaggtcgatgaagacatttttagaaagaagcggctgaccatcatggatcttcaccccggcgctgggaaaaccaagcgcattctgccttctatcgttagagaggccctgaaacggcgcctcagaacactgatccttgcgccgacgcgggtggtggctgccgaaatggaggaagccctgagaggactccccattcgctatcagacccctgctgtcaagtccgagcatacaggccgggagatcgtggacctgatgtgccacgccaccttcacaaccagactcctgagctctacgcgcgttcccaactacaatcttattgtgatggatgaagctcactttacagacccttccagcgtcgccgcgcgggggtacatctccaccagagtggagatgggcgaagccgctgccattttcatgaccgctacaccccctggagccaccgatccgtttccccaatctaacagccctatcgaggacatcgaacgcgagattcccgagcggtcctggaatacaggcttcgattggatcaccgactatcaggggaaaacggtttggtttgtgcctagcattaaggccggaaacgacatcgctaactgcctgagaaagtctggcaaaaaggtcattcagctgtcccgcaaaacattcgataccgaataccccaagacaaaactcaccgactgggattttgtggtcacgaccgacatcagcgagatgggggcgaatttcagagccggacgggtgatcgatccgcgcagatgtctgaagcctgttattcttacagacggccccgaacgggtgatcctggctgggcccattcctgtgacccccgcctctgccgctcaacgcagaggccggatcggaagaaacctcgcccaggaggatgaccagtatgtcttcagcggcgatcctctgaagaatgacgaagatcatgcgcactggacagaggctaaaatgctgctcgacaacatttacaccccggaggggatcattcccacactttttggacctgaacgcgagaagacccaggccatcgatggcgaattccggctgagaggggagcaacgcaaaacgtttgttgagctgatgcggagaggagacctccccgtgtggctgtcctataaggtggcctctgctggcatcagctacaaagaccgggaatggtgcttcacaggcgagcgcaataaccagattcttgaagagaatatggaagtcgagatctggaccagagagggggaaaagaagaaactgcggcctaagtggctcgatgcccgcgtgtatgcggaccccatggccctgaaagattttaaggagttcgcttccggaagaaaatctattaccctggacatcctcacagaaattgccagccttccgacctacctgtccagccgggctaagctggccctcgataacatcgttatgctgcatacaacggagcgcggcgggagagcttaccagcacgcccttaatgaactgcctgagtctctcgagaccctgatgctggtggcgctccttggagccatgacagctggcatctttctgttctttatgcaggggaagggaattggcaaactgtccatgggcctcatcaccattgccgtcgctagcgggctgctttgggtggccgaaatccaaccccagtggattgccgcttccatcatcctggagttctttctcatggtcctgctgattcctgaacccgagaagcagcggacacctcaggacaaccaactcatctatgtgattcttaccatcctgacgattatcggactgattgcggccaatgaaatgggcctcatcgagaaaaccaaggctgatttcgggttttaccaggttaaaacagagaccacaatcctggacgtggatcttcgccccgcctctgcctggaccctgtatgctgtcgccacgacaattctcaccccgatgctgagacacacaatcgaaaacaccagcgcgaatctgtccctcgccgctattgccaaccaggctgccgtgcttatgggactgggcaaggggtggcctctgcatcggatggacctcggagttcccctgcttgcgatgggctgttactctcaggtgaatcccaccacactgacggccagcctcgtcatgctgctggtgcactatgctatcattggccctgggctccaagccaaagctaccagagaggcccagaagcgcacagctgccggaatcatgaagaacccgaccgtggatggcatcacagttattgaccttgaacccatctcctacgatcctaaattcgagaagcagctggggcaagtcatgctgctcgtgctgtgcgcgggacagcttctgctcatgcggaccacgtgggccttctgtgaggtgctgacactggctaccggccccattctcaccctttgggaagggaaccctggaagattttggaatacaaccatcgccgtcagcacagctaacattttccgcggctcttatctggccggcgccgggctggcgttttccctcatcaaaaatgctcagacgccccggagaggaaccggcacaaccggggagacactgggagaaaagtggaaacgccagcttaacagcctggaccggaaggagttcgaagagtacaagagatctggcatcctcgaggttgaccgcaccgaagccaaatccgctctgaaggatgggagcaaaattaagcatgccgtgtctcggggaagctccaaaatcagatggattgtggagcgcggcatggtcaagcctaagggcaaagtggttgacctggggtgcggacggggcgggtggtcttactatatggccacgctcaagaatgtgaccgaagtcaaaggatacacaaagggcgggccgggacacgaggaacccatccctatggctacctatggctggaaccttgtgaaactgcatagcggcgttgatgtgttttacaagcccacagagcaagtcgacaccctgctctgtgatattggggagtccagctccaatcctacaatcgaagagggaagaaccctgcgcgtgcttaagatggtggaaccctggctgtctagcaaaccggagttctgcattaaggtcctcaacccttatatgcccacggttatcgaagagctggagaaactgcagagaaagcacggcgggaatctcgtgcggtgtcccctttcccgcaactctacacacgaaatgtactgggtgagcggagcctccggcaatatcgtctctagcgtgaacaccacctccaaaatgctgctgaatagatttacaacgcggcatagaaagcctacctatgagaaagacgttgatctcggggcgggaacacggagcgtgtctaccgaaacagagaagcccgacatgaccattatcggccgcagactgcagcggcttcaggaggaacacaaggagacatggcattacgatcaagaaaacccttaccgcacctgggcctatcacggctcctacgaggctccgagcacggggtctgcctccagcatggtcaatggagtggttaaactgctcaccaagccctgggacgtgattcctatggtcacacagctggctatgaccgatacaacccccttcggccagcagagagtgtttaaagaaaaggttgacacgcggacacctcaacccaaaccggggacccgcatggtgatgacaaccacggccaactggctgtgggcgctcctgggaaagaagaaaaatcctagactttgcacccgggaggagttcatctctaaggtccgctccaacgccgctattggcgccgtgtttcaggaagagcaggggtggacaagcgcttccgaagccgtcaacgacagcagattctgggagctggtggataaagaacgggctctccaccaagagggcaagtgtgagtcttgcgtttataatatgatgggaaaacgcgaaaagaagctgggcgagtttgggagagccaaaggaagccgggcgatctggtacatgtggcttggcgcccgcttcctggaattcgaggctctcgggtttctgaacgaagaccattggttcggaagagagaattcctggtctggcgtggagggggaaggcctgcaccggctcggatatatcctggaggaaattgataagaaagacggcgatcttatgtacgccgacgataccgctgggtgggacacaagaatcaccgaggatgacctgcagaacgaggaactcattacagagcagatggccccccatcacaagatcctggccaaagcgatttttaagcttacctatcagaataaggtcgtgaaagtgctgcgccctacgccccggggagctgttatggatatcatcagcagaaaggaccaacgcggctccgggcaggtgggaacatacggcctcaacaccttcaccaatatggaagtccagctgattcggcagatggaggccgaaggggtgatcacacaagatgacatgcagaaccctaaaggcctgaaggagagagttgagaaatggctccgcgaatgcggagtggaccggctgaagagaatggccatttctggcgatgactgtgtcgtgaaaccccttgatgagcgctttgggaccagcctgctcttcctgaatgacatgggaaaggtccggaaggatatcccgcagtgggaaccttccaaaggctggaagaactggcaggaggtgcccttttgctctcatcacttccacaaaatttttatgaaggacgggagaagccttgttgtgccctgtcgcaatcaagatgaactgatcggacgggctagaatctcccagggcgccgggtggagcctccgggagacagcttgcctgggcaaagcctacgcgcagatgtggtctctgatgtatttccatagacgcgacctccggctggcctccatggctatttgtagcgccgtccctacggagtggtttccgacctctagaacaacctggtccatccacgctcatcaccagtggatgacaaccgaagatatgcttaaggtgtggaaccgcgtttggattgaggacaatcccaacatgatcgataagacgcctgtgcacagctgggaagacattccctacctgggaaaaagagaggacctctggtgcggctccctgatcgggctttctagccgggccacctgggcgaagaatattcatacagccatcacccaagtccgcaacctgatcggaaaagaagagtatgtggattacatgcctgtgatgaagagatattccgctcccagcgagtctgaaggcgttctctga

SEQ ID NO: 20993 - RNA, 9867 nt, synthetic construct
  misc_feature 1..9867: note = derived and/or modified CDS sequence (opt5) from DENV-4__FJ182017__SS-prME
  source 1..9867: mol_type = other RNA
agcaccatcacactgctctgcctgattcccacggtgatggccttccacctttccaccagagacggcgagcctctgatgatcgtcgctaagcatgaacgggggcgcccgctcctgtttaaaacaaccgagggaattaacaagtgtacacttatcgccatggatctgggcgaaatgtgcgaggacaccgttacatacaaatgtcccctcctggtgaataccgaacctgaggatattgactgctggtgtaacctgacgtctgcgtgggtgatgtatgggacctgcacacagagcggagagagacggcgcgaaaagagatccgtcgctctcaccccccactctggcatggggctggagacacgggccgaaacctggatgagctccgagggagcctggaaacatgctcaacgcgtggagtcttggatccttagaaatcctggcttcgccctgctcgctggctttatggcctacatgatcgggcagacgggaattcagcggacagttttctttgtgctgatgatgcttgtcgcgcccagctatggcatgcgctgtgtgggggttggaaacagagatttcgtggaaggcgtctccgggggagcctgggtggacctggtgctcgagcacggcggctgcgtcaccacaatggctcaggggaagcctaccctggattttgaactgaccaagacaacggccaaagaggttgctctcctgcggacctactgtatcgaagcccttattagcaatatcacaaccgcgacacgctgcccgacccaaggagagccctatctgaaggaggaacaggaccagcagtacatttgtagacgggatgtggtggaccgcggctgggggaacggatgcggcctcttcgggaaaggaggcgtcgtgacgtgcgccaagttttcttgttccggcaaaatcacagggaatctggttcaaattgagaaccttgaatataccgtggtcgtgaccgttcataatggagatacacacgctgtgggcaacgacaccagcaatcacggggtcacagccacgatcacccctagatctccctccgtggaggtcaagctgcctgattacggagaactcacactggactgcgagccccggagcggcatcgacttcaacgagatgattctgatgaagatgaaaaagaaaacctggctcgtgcataagcagtggtttctggatcttccgctgccttggacaaccggggctgacacgtctgaagttcactggaattacaaagagagaatggtgaccttcaaggtcccccatgccaaacgccaggatgtgacagttctcggctcccaggaaggagccatgcacagcgctctggcgggcgccaccgaggtggactccggggatggaaaccacatgtttgctggccatcttaagtgtaaggtccggatggaaaaactgagaatcaaggggatgtcttatacaatgtgcagcggaaaattctccattgacaaggagatggccgagacccaacacggcacgacagtggtgaaagttaagtacgaaggggccggcgctccttgtaaggtccccatcgagattcgcgatgtgaataaagaaaaggtggtcggacgggtgatcagcgccacccccctcgcggagaacacaaactctgttaccaatatcgagctggaacctccgttcggcgactcctatattgtgatcggggtcggaaacagcgctctgaccctccattggtttagaaaaggctctagcattgggaagatgttcgagtccacataccgcggagccaaacggatggccatcctgggcgaaacggcttgggattttgggtctgtgggcggacttttcaccagcctgggcaaggccgttcaccaggtgtttgggtccgtctatacaaccatgttcggaggcgtgagctggatgattagaatcctcatcgggtttctggttctgtggattggaacaaattctcgcaacacctccatggctatgacgtgcatcgccgtgggcgggattacacttttcctcggctttaccgtccaggcggacatgggatgtgtggtgagctggtctggccgggagctgaagtgcgggtccggaatcttcgtcgttgataatgtgcatacctggacagaacaatacaaatttcagcccgagagccctgccagactggcttccgccattctcaacgctcacaaggacggcgtgtgtgggatccgctctaccacacggctggagaatgtcatgtggaaacagattacgaacgaacttaattatgtgctgtgggagggaggccacgacctcaccgttgtggccggcgatgtcaagggggtgctgacaaaaggaaagagagcgctgaccccccctgccagcgaccttaagtactcctggaaaacatggggcaaggctaaaatcttcacccccgaagcccggaactctacgtttctcatcgatgggccggacaccagcgagtgccctaatgaacgcagagcttggaactccttcgaggttgaggattacggattcggcatgtttacaaccaatatttggatgaagttccgggaagggagctctgaggtgtgtgaccatagactgatgtccgccgccatcaaagatcagaaggctgtccacgcggacatgggatattggattgaaagctctaaaaaccaaacatggcagatcgagcgcgcctccctgattgaagtgaagacctgcctctggcccaagacacataccctgtggagcaatggcgttcttgagtctcagatgctgatccctaaaagctacgctggccccttttcccagcacaactatcggcaagggtacgccacgcagacagtgggaccttggcacctcggcaagctggagatcgatttcggggaatgccccggaaccaccgtcacaattcaggagaactgtgaccatagaggcccgagcctgcgcaccacgacagcctctgggaaacttgtgacccagtggtgctgtagatcctgcacaatgcctcccctccggtttctgggagaagatggctgttggtatggcatggagatccgccccctgagcgagaaggaagagaatatggtgaaatcccaagtcaccgctgggcagggaacatctgaaaccttcagcatgggcctcctgtgccttacgctgtttgttgaggaatgtctcagacggcgcgtgaccagaaagcacatgattctggccgtggtcatcacactgtgcgcgattatccttgggggactcacctggatggacctgctgcgggctctcatcatgctgggcgatacaatgtccgggcgcattggaggccagacccatcttgccatcatggccgtgttcaagatgtctcctggctacgttctgggggtgtttctcagaaaactgacgagccgggagacagctctgatggtcattggaatggccatgaccacaaccctttccatcccgcacgacctgatggagctcattgacggcatctctctggggctcatcctgcttaagattgtgacccagttcgataacacacaagttggaacgctggcgctcagcctgacctttatccgctccacaatgagcctggtgatggcttggagaaccattatggccgtccttttcgtggtcacactgatccccctctgtcggacctcttgcctgcagaaacagtcccattgggtggaaattacggccctcatcctgggcgctcaagcccttcctgtttatctgatgacactcatgaagggggctagcagacgctcttggcccctgaatgagggaattatggccgtgggcctggtctcccttctgggcagcgcgctcctgaaaaacgacgtgcctctcgccgggcccatggttgctggaggcctgcttctggccgcttacgtgatgtctgggtccagcgccgatctgtccctcgaaaaggccgctaatgtccagtgggacgagatggcggatatcaccggaagctctcctatcattgaagtgaagcaggacgaggatggcagcttttccatccgggacgtggaggaaaccaacatgattacactgcttgttaaactggccctcatcaccgtctctgggctgtaccccctcgctattccgatcacaatgacgctgtggtatatgtggcaggtgaagacccaaagaagcggagccctttgggatgtgccttcccccgccgctacacagaaagccgcgctgtctgagggcgtctaccgcatcatgcagcggggcctgttcgggaagacccaggtgggagttggcattcacatggaaggggtgttccacacaatgtggcatgtcaccagaggaagcgtgatctgtcacgagacgggccgcctcgaaccttcctgggctgacgttcggaatgatatgatttcttatgggggaggctggagactgggcgacaaatgggataaggaggaggacgtgcaagtccttgccatcgaacccgggaagaacccgaaacatgtgcagaccaagcctggactgtttaaaacactcaccggcgagattggggccgttacactggacttcaagcccggaaccagcggctcccctatcatcaatcgcaaagggaaggtgattggcctctacggaaacggcgtcgtgacaaaaagcggggattatgtgtctgctatcacgcaggccgaacggattggagagcccgactacgaggtcgatgaagacatctttagaaagaagcggctgaccattatggatcttcaccccggcgcggggaaaacaaagcgcatcctgccttccattgttagagaggctctgaaacggcgcctcagaaccctgatccttgccccgacccgggtggtggccgctgaaatggaggaagccctgagaggactccccatccgctatcagacacctgctgtcaagagcgagcatacgggccgggagattgtggacctgatgtgccacgccaccttcacaaccagactcctgtcttccacacgcgttcccaattacaaccttatcgtgatggatgaagcgcactttaccgaccctagctccgtcgccgctcgggggtacatttctacgagagtggagatgggcgaagccgctgccatcttcatgacagccaccccccctggagctaccgatccgtttccccaaagcaattcccctattgaggacatcgaacgcgagatccccgagcggagctggaacacaggcttcgattggattaccgactatcaggggaaaacagtttggtttgtgccttctatcaaggcgggaaatgacattgccaactgcctgagaaagtccggcaaaaaggtcatccagctgagccgcaaaaccttcgatacggaataccccaagacaaaactcaccgactgggattttgtggtcacaaccgacatttctgagatgggggctaacttcagagccggacgggtgatcgatccgcgcagatgtctgaagcctgttatccttacggacggccccgaacgggtgattctggccgggcccatccctgtgacccccgctagcgccgcgcaacgcagaggccggattggaagaaatcctgctcaggaggatgaccagtatgtcttctccggcgatccgctcaagaacgacgaagatcatgcccactggacagaggccaaaatgctgctggacaatatctacacccccgaggggattatccctacactctttggacccgaacgcgagaagacccaggctattgatggcgaattccggcttagaggggagcaacgcaaaacatttgttgagctgatgcggagaggagacctgcctgtgtggctctcttataaggtggccagcgcgggcatctcctacaaagaccgggaatggtgcttcaccggcgagcgcaacaatcagatcctggaagagaacatggaagtcgagatttggacgagagagggggaaaagaagaaacttcggcccaagtggctggatgcccgcgtgtatgctgacccgatggccctcaaagattttaaggagttcgcttctggaagaaaaagcatcacactggacattctgaccgaaatcgcctccctccctacctaccttagctctcgggctaagctggccctggataatattgttatgctccatacaaccgagcgcggcgggagagcgtaccagcacgccctgaacgaacttcccgagtccctggagacactcatgctggtggctctgctcggagccatgacggctggcatctttcttttctttatgcaggggaagggaatcggcaaactgagcatgggcctgattaccatcgccgtcgcctccgggctcctgtgggtggctgaaattcaacctcagtggatcgcggcctctattatccttgagttctttctgatggtcctcctgatccccgaacctgagaagcagcggacaccccaggacaatcaactgatttatgtgatcctcaccattcttacaatcattggactgatcgctgccaacgaaatgggcctgattgagaaaaccaagacggatttcgggttttaccaggttaaaaccgagacaaccatcctcgacgtggatctgcgcccggccagcgcttggacactttatgccgtcgcgaccacgatcctgacacctatgctcagacacaccattgaaaatacatccgccaacctgtctctggctgccatcgctaatcaggccgcggtgctcatgggacttggcaaggggtggcccctgcatcggatggacctgggagttcccctcctggccatgggctgttacagccaggtgaaccctaccacccttacagcttccctggtcatgctcctggtgcactatgccattatcggcccggggctgcaagctaaagccacgagagaggctcagaagcgcaccgccgcgggaattatgaagaatcccacagtggatggcatcaccgttatcgacctcgaacctattagctacgatcccaaattcgagaagcagcttgggcaagtcatgctgctggccctctgcgctggacagctgcttctgatgcggacaacctgggccttctgtgaggtgctcacgctggctacaggccctatcctgaccctctgggaagggaaccccggaagattttggaacaccacaattgccgtgtctaccgccaatatcttccgcggctcctatcttgcgggcgctgggctggcctttagcctgattaaaaacgctcagacacctcggagaggaacgggcaccacaggggagaccctcggagaaaagtggaaacgccagctgaattctcttgaccggaaggagttcgaagagtacaagagatccggcatcctggaggtcgaccgcacagaagccaaaagcgccctcaaggatgggtctaaaatcaagcatgctgttagccggggatcctctaaaattagatggatcgtggagcgcggcatggtgaagccgaagggcaaagtcgtggacctggggtgcggacggggcgggtggagctactatatggccaccctgaagaacgttacggaagtgaaaggatacaccaagggcgggcccggacacgaggaacctattcccatggcgacatatggctggaatctcgtcaaacttcattccggcgtggatgttttttacaagcctaccgagcaagtggacacactgctgtgtgatatcggggagagctcctctaaccccaccattgaagagggaagaacactccgcgtcctgaagatggtggaaccgtggcttagctccaaacctgagttctgcatcaaggtgctgaatccctatatgcccaccgtcattgaagagctcgagaaactgcagagaaagcacggcgggaacctggttcggtgtcctctctctcgcaatagcacgcacgaaatgtactgggtgtccggagcctctggcaacatcgtgagctccgtcaatacaaccagcaaaatgcttctgaacagatttaccacacggcatagaaagcccacgtatgagaaagacgtggatctgggggctggaacccggtctgtttccacagaaaccgagaagcctgacatgacaatcattggccgcagactccagcggctgcaggaggaacacaaggagacctggcattacgatcaagaaaatccgtaccgcacatgggcctatcacggcagctacgaggctccctctaccgggtccgccagctctatggtgaacggagtcgtgaaacttctgacgaagccttgggacgttatccccatggtgacccagctcgcgatgacagataccacacctttcggccagcagagagtctttaaagaaaaggtggacacccggacgccccaaccgaaacctgggacacgcatggttatgaccacaaccgccaattggctgtgggctctgctcggaaagaagaaaaaccccagactgtgcacgcgggaggagttcatttccaaggtgcgcagcaatgccgctatcggcgccgtctttcaggaagagcaggggtggacctccgctagcgaagccgtgaacgactctagattctgggagcttgtcgataaagaacgggcgctgcaccaagagggcaagtgtgagagctgcgtgtataacatgatgggaaaacgcgaaaagaagctcggcgagtttgggagagccaaaggatcccgggctatttggtacatgtggctgggcgcccgcttccttgaattcgaggctctggggtttctcaatgaagaccattggttcggaagagagaactcttggagcggcgttgagggggaaggcctgcaccggctgggatatatcctcgaggaaatcgataagaaagacggcgatctgatgtacgccgacgatacagccgggtgggacaccagaattacagaggatgaccttcagaatgaggaactgatcaccgagcagatggcgcctcatcacaagattctcgctaaagccatctttaagctgacatatcagaacaaggtggtcaaagtgcttcgccccacccctcggggagccgtgatggatattatctccagaaaggaccaacgcggctctgggcaggttggaacgtacggcctgaatacattcaccaacatggaagtgcagctcatccggcagatggaggctgaaggggtcattacccaagatgacatgcagaatcccaaaggcctgaaggagagagtggagaaatggctgcgcgaatgcggagttgaccggctcaagagaatggccatcagcggcgatgactgtgtggtcaaaccgctggatgagcgctttgggacatcccttctgttcctcaacgacatgggaaaggtgcggaaggatattcctcagtgggaaccctctaaaggctggaagaattggcaggaggtccccttttgcagccatcacttccacaaaatctttatgaaggacgggagatccctggtggttccttgtcgcaaccaagatgaacttattggacgggctagaatcagccagggcgccgggtggtctctgcgggagaccgcgtgcctcggcaaagcctacgctcagatgtggtccctgatgtatttccatagacgcgacctgcggctcgccagcatggctatctgttctgccgtgccgacagagtggtttcccacgtccagaaccacatggagcattcacgcgcatcaccagtggatgaccacagaagatatgctgaaggtctggaatcgcgtgtggatcgaggacaaccctaatatgattgataagacccccgttcactcctgggaagacatcccttaccttggaaaaagagaggacctgtggtgcggctctctcattgggctgagctcccgggccacgtgggctaagaacatccataccgccattacacaagtgcgcaatcttatcggaaaagaagagtatgtcgattacatgcccgtgatgaagagatatagcgctccttctgagtccgaaggcgtgctgtga

SEQ ID NO: 20994 - RNA, 9867 nt, synthetic construct
  misc_feature 1..9867: note = derived and/or modified CDS sequence (opt5) from DENV-4__EU854301__SS-prME
  source 1..9867: mol_type = other RNA
agcaccatcacactgctctgcctgattcccacggtgatggccttccacctttccaccagagacggcgagcctctgatgatcgtcgctaagcatgaacgggggcgcccgctcctgtttaaaacaaccgagggaattaacaagtgtacacttatcgccatggatctgggcgaaatgtgcgaggacaccgttacatacaaatgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggatccttagaaatcctggcttcgctctgctcgccggctttatggcttacatgatcgggcagacaggaattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctagcatttctaatatcaccacagccacccgctgcccgacgcaaggagagccctatcttaaggaggaacaggaccagcagtacatttgtagacgggatgtggtggaccgcggctgggggaacggatgcggcctgttcgggaaaggaggcgtcgtgacatgcgcgaagttttcctgtagcggcaaaatcaccgggaatctcgttcaaattgagaacctggaatataccgtggtcgtgacagttcataatggagatacccacgccgtgggcaacgacacatctaatcacggggtcacggctaccatcacacctagatcccccagcgtggaggtcaagcttcctgattacggagaactgaccctcgactgcgagccccggtctggcatcgacttcaacgagatgattctgatgaagatgaaaaagaaaacatggctggtgcataagcagtggtttctcgatctgccgcttccttggaccacgggggccgacacctccgaagttcactggaattacaaagagagaatggtgacattcaaggtcccccatgctaaacgccaggatgtgaccgttctgggcagccaggaaggagccatgcactccgccctcgctggcgcgacagaggtggactctggggatggaaaccacatgtttgccggccatctgaagtgtaaggtccggatggaaaaacttagaatcaaggggatgagctataccatgtgctccggaaaattcagcattgacaaggagatggctgagacgcaacacggcacaaccgtggtgaaagttaagtacgaaggggccggcgccccttgtaaggtccccatcgagattcgcgatgtgaataaagaaaaggtggtcggacgggtgatctctgctacacccctggccgagaacaccaactccgttaccaatatcgagctcgaacctccgttcggcgacagctatattgtgatcggggtcggaaactctgcgctgacactgcattggtttagaaaaggcagctccattgggaagatgttcgagtctacgtaccgcggagctaaacggatggccatcctcggcgaaaccgcctgggattttgggagcgtgggcggactgttcacatcccttggcaaggctgttcaccagatttttgggagcgtgtataccacaatgttcggaggcgtctcttggatgatcagaatcctgattgggtttctcgtgctgtggatcggaaccaattcccgcaacacgagcatggccatgacatgcattgctgttggcgggatcaccctgttccttggctttaccgtgcaggccgacatgggatgtgtcgtgtcttggtccggccgggagctcaagtgcgggagcggaattttcgtggtcgataatgttcatacatggaccgaacaatacaaatttcagcccgagtcccctgcgagactggcctctgctatcctgaacgcccacaaggacggcgtgtgtgggattcgcagcacaacgcggctcgagaatgtgatgtggaaacagatcaccaacgaactgaattatgtcctttgggagggaggccacgacctgacagtggttgctggcgatgtgaagggggtcctcaccaaaggaaagagagccctgacaccccctgcgtccgacctgaagtactcttggaaaacctggggcaaggccaaaatcttcacgcccgaagctcggaacagcacctttcttattgatgggccggacacatccgagtgccctaatgaacgcagagcctggaacagcttcgaggtggaggattacggattcggcatgtttaccacaaatatctggatgaagttccgggaagggtcttccgaggtttgtgaccatagactcatgagcgctgccattaaagatcagaaggccgtgcacgctgacatgggatattggatcgaatcttccaaaaaccaaacctggcagattgagcgcgcgagcctgatcgaagtcaagacatgcctgtggcccaagacccatacgctctggtctaatggcgtgctggagagccagatgcttatccctaaatcctacgccggcccctttagccagcacaactatcggcaagggtacgctacacagaccgttggaccttggcacctgggcaagctcgagattgatttcggggaatgccccggaaccacagtgaccatccaggagaactgtgaccatagaggcccgtctctgcgcacgacaaccgcctccgggaaactggtcacacagtggtgctgtagaagctgcaccatgcctccccttcggtttctcggagaagatggctgttggtatggcatggagattcgccccctgtccgagaaggaagagaatatggtgaaatctcaagtgacagccgggcagggaaccagcgaaacgttctccatgggcctgctctgcctgaccctttttgtcgaggaatgtctgagacggcgcgttacaagaaagcacatgatcctcgctgtggtgattaccctgtgcgccatcatcctggggggacttacatggatggacctcctgcgggcgctgattatgctcggcgataccatgtctgggcgcatcggaggccagacgcatctggctattatggccgtcttcaagatgagccctggctacgtgcttggggtttttctgagaaaactcacatcccgggagaccgccctgatggtgatcggaatggctatgacaaccaccctgtctattccgcacgaccttatggagctgatcgacggcatcagcctcgggctgattctcctgaagatcgtcacacagttcgataacacgcaagtgggaacccttgccctgtccctcacatttattcgcagcaccatgtctctggttatggcgtggagaacaatcatggctgtgctgttcgtcgtgacccttattcccctgtgtcggacgtcctgcctccagaaacagagccattgggtcgaaatcacagccctgattctcggcgcccaagctctgcctgtgtatcttatgaccctgatgaagggggcctctagacgctcctggcccctcaatgagggaatcatggctgttggcctggtgagcctgcttggctctgccctgctcaaaaacgacgtccctctggcggggcccatggtggccggaggcctcctgcttgctgcctacgttatgtccgggagctccgctgatctgagcctggaaaaggccgccaatgtgcagtgggacgagatggctgatatcaccggatctagccctattatcgaagtcaagcaggacgaggatggctccttttctattcgggacgtggaggaaacaaacatgatcaccctcctggtgaaacttgcgctgattacagttagcgggctctaccccctggccatcccgatcacgatgaccctctggtatatgtggcaggtcaagacacaaagatccggagctctgtgggatgtgccttctcccgccgccacccagaaagctgcccttagcgagggcgtgtaccgcattatgcagcggggcctgttcgggaagacacaggtcggagtgggcatccacatggaaggggttttccacaccatgtggcatgtgacgagaggatccgtcatttgtcacgagaccggccgcctggaaccttcttgggcggacgtgcggaatgatatgatcagctatgggggaggctggagactcggcgacaaatgggataaggaggaggacgttcaagtgctggctattgaacccgggaagaacccgaaacatgtccagacaaagcctggactttttaaaaccctgacaggcgagatcggggccgtgaccctcgacttcaagcccggaacatccggcagccctatcattaatcgcaaagggaaggttatcggcctgtacggaaacggcgtggtcacgaaatctggggattatgtgtccgccattacccaggctgaacggatcggagagcccgactacgaggtggatgaagacatttttagaaagaagcggctcacaatcatggatctgcaccccggcgccgggaaaaccaagcgcattcttcctagcatcgtcagagaggcgctgaaacggcgcctgagaaccctcatcctggctccgacacgggttgtggccgccgaaatggaggaagctcttagaggactgcccattcgctatcagacgcctgccgtgaagtctgagcataccggccgggagatcgtcgacctcatgtgccacgctacattcaccacaagactgctctccagcacccgcgtgcccaattacaacctgattgttatggatgaagcccactttacggacccttcctctgtggcggcccgggggtacatcagcacaagagtcgagatgggcgaagctgccgctattttcatgaccgccaccccccctggagccacagatccgtttccccaatccaatagccctatcgaggacatcgaacgcgagattcccgagcggtcttggaacaccggcttcgattggatcacagactatcaggggaaaaccgtgtggtttgttccttccattaaggctggaaatgacatcgcgaactgccttagaaagagcggcaaaaaggtgattcagctgtctcgcaaaacgttcgatacagaataccccaagaccaaactgacagactgggattttgtcgtgaccacggacatcagcgagatgggggccaacttcagagctggacgggtcatcgatccgcgcagatgtctcaagcctgtgattctgaccgacggccccgaacgggttatccttgccgggcccattcctgtgacacccgcctccgctgcccaacgcagaggccggatcggaagaaatcctgcgcaggaggatgaccagtatgtgttctctggcgatccgctgaagaacgacgaagatcatgctcactggaccgaggccaaaatgctcctggacaatatttacacacccgaggggatcattcctaccctgtttggacccgaacgcgagaagacacaggccatcgatggcgaattccggctcagaggggagcaacgcaaaacctttgtcgagcttatgcggagaggagacctgcctgtttggctgagctataaggtggcttccgccggcatctcttacaaagaccgggaatggtgcttcacgggcgagcgcaacaatcagattctcgaagagaacatggaagtggagatctggacaagagagggggaaaagaagaaactgcggcccaagtggcttgatgcgcgcgtctatgccgacccgatggctctgaaagattttaaggagttcgccagcggaagaaaatccattaccctcgacatcctgaccgaaattgctagcctgcctacatacctctcttcccgggccaagcttgctctggataatatcgtgatgctgcataccacagagcgcggcgggagagcctaccagcacgcgctcaacgaactgcccgagagccttgagacgctgatgctcgttgccctgctgggagctatgaccgccggcatctttctcttctttatgcaggggaagggaatgggcaaactttccatgggcctgattacaatcgctgtggcctctgggctgctctgggtcgccgaaattcaacctcagtggatcgctgcgagcattatcctggagttctttcttatggtgctgctcatccccgaacctgagaagcagcggaccccccaggacaatcaactgatttatgtcatcctgacaattctcaccatcattggacttatcgccgctaacgaaatgggcctgattgagaaaacgaagaccgatttcgggttttaccaggtgaaaacagagaccacaatcctggacgttgatctccgcccggcctccgcctggaccctgtatgctgtggccacgacaatccttacccctatgctgagacacacaattgaaaatacctctgcgaacctcagcctggccgctatcgccaatcaggctgccgtcctgatgggactcggcaaggggtggccccttcatcggatggacctgggagtgcccctgctcgcgatgggctgttactcccaggttaaccctaccacactgacggccagccttgtgatgctgctcgtccactatgctattatcggcccggggctgcaagccaaagctaccagagaggcccagaagcgcacagctgccggaattatgaagaatcccaccgtggatggcatcacagtgatcgacctggaacctatttcttacgatcccaaattcgagaagcagctcgggcaagttatgcttctggtcctgtgcgcgggacagctcttcctgatgcggaccacgtgggccttttgtgaggtgcttacactggctaccggccctatcctcaccctgtgggaagggaaccccggaagattctggaacacaaccattgccgtgtccacagctaatatctttcgcggcagctatctggccggcgccgggctcgcgttctctcttattaaaaacgctcagacgcctcggagaggaaccggcacaaccggggagacactgggagaaaagtggaaacgccagctgaattccctcgaccggaaggagtttgaagagtacaagagaagcggcatcctggaggtcgaccgcaccgaagccaaatctgctcttaaggatgggagcaaaatcaagcatgccgtttcccggggatctagcaaaattagatggatcgtggagcgcggcatggtgaagccgaagggcaaagtcgtggacctggggtgcggacggggcgggtggtcctactatatggccacgctcaagaacgttaccgaagtgaaaggatacacaaagggcgggcccggacacgaggaacctattcccatggctacctatggctggaatctggtcaaactgcatagcggcgtggatgttttctacaagcctacagagcaagtggacaccctcctttgtgatatcggggagtcctctagcaaccccacaattgaagagggaagaaccctgcgcgtcctgaagatggtggaaccgtggctctcctctaaacctgagttttgcatcaaggtgctgaatccctatatgcccacggtcattgaagagcttgagaaactgcagagaaagcacggcgggaacctcgttcggtgtcctctgagccgcaattccacacacgaaatgtactgggtgtctggagccagcggcaacatcgtgtccagcgtcaataccacctctaaaatgctgctcaacagattcacaacgcggcatagaaagcccacctatgagaaagacgtggatcttggggcgggaacacggtccgttagcaccgaaacagagaagcctgacatgaccatcattggccgcagactgcagcggctgcaggaggaacacaaggagacatggcattacgatcaagaaaatccgtaccgcacctgggcctatcacggctcttacgaggctccctccacggggagcgcctcttccatggtgaacggagtcgtgaaactcctgaccaagccttgggacgttatccccatggtgacacagcttgctatgaccgatacaaccccttttggccagcagagagtcttcaaagaaaaggtggacacgcggacaccccaaccgaaacctgggacccgcatggttatgacaaccacggccaattggctgtgggcgctcctgggaaagaagaaaaaccccagactgtgcacccgggaggagtttattagcaaggtgcgctccaatgccgctatcggcgccgtcttccaggaagagcaggggtggacaagcgcttctgaagccgtgaacgacagcagattttgggagctcgtcgataaagaacgggctctgcaccaagagggcaagtgtgagtcctgcgtgtataacatgatgggaaaacgcgaaaagaagcttggcgagttcgggagagccaaaggatctcgggcgatttggtacatgtggctgggcgcccgcttcctcgaatttgaggctctggggttccttaatgaagaccattggtttggaagagagaacagctggtccggcgttgagggggaaggcctgcaccggctcggatatatcctggaggaaatcgataagaaagacggcgatctgatgtacgccgacgataccgctgggtgggacacaagaattaccgaggatgacctccagaatgaggaactgatcacagagcagatggcccctcatcacaagattcttgccaaagcgatcttcaagctgacctatcagaacaaggtggtcaaagtgctccgccccacgcctcggggagctgtgatggatattatctctagaaaggaccaacgcggcagcgggcaggttggaacatacggcctgaatacctttaccaacatggaagtgcagcttatccggcagatggaggccgaaggggtcattacacaagatgacatgcagaatcccaaaggcctgaaggagagagtggagaaatggctccgcgaatgcggagttgaccggctgaagagaatggccatctccggcgatgactgtgtggtcaaaccgctggatgagcgcttcgggacctctctcctgtttcttaacgacatgggaaaggtgcggaaggatattcctcagtgggaacccagcaaaggctggaagaattggcaggaggtccccttctgctcccatcactttcacaaaatcttcatgaaggacgggagaagcctggtggttccttgtcgcaaccaagatgaactcattggacgggctagaatctctcagggcgccgggtggtccctgcgggagacagcttgccttggcaaagcctacgcgcagatgtggagcctgatgtattttcatagacgcgacctccggctggcctctatggctatctgttccgccgtgccgacggagtggttccccaccagcagaacaacctggtccattcacgctcatcaccagtggatgacaaccgaagatatgctgaaggtctggaatcgcgtgtggatcgaggacaaccctaatatgattgataagacgcccgttcactcttgggaagacatcccttacctcggaaaaagagaggacctgtggtgcggcagccttattgggctgtccagccgggccacctgggcgaagaacatccatacagccattacccaagtgcgcaatctcatcggaaaagaagagtatgtcgattacatgcccgctatgaagagatattctgccccttccgagagcgaaggcgtgctgtga

SEQ ID NO: 20995 - RNA, 9867 nt, synthetic construct
  misc_feature 1..9867: note = derived and/or modified CDS sequence (opt5) from DENV-4__FJ639736__SS-prME
  source 1..9867: mol_type = other RNA
agcaccatgacgctgctctgcctgatccccacggccatggctttccacctttccaccagagacggagagcctctgatgattgtggccaagcatgaacgggggagaccgctcctgtttaaaaccaccgagggaatcaacaagtgtacccttattgcgatggatctgggcgaaatgtgcgaggacaccgtcacatacaaatgtcccctcctggttaataccgaacctgaggatatcgactgctggtgtaacctgacgtctacctgggtgatgtatgggacatgcacccagagcggagagagacggcgcgaaaagagatccgtggctctcacaccccactctggcatggggctggagacccgggccgaaacgtggatgagctccgagggagcctggaaacatgctcagcgcgtcgagtcttggattcttagaaatcctggcttcgccctgctcgctggctttatggcctacatgatcgggcagacaggaatccagcggaccgtgttctttgttctgatgatgcttgtggcgcccagctatggcatgcgctgtgtcggggtgggaaacagagatttcgttgaaggcgtgtccgggggagcctgggtcgacctggtgctcgagcacggcggctgcgtgacaaccatggctcaggggaagcctaccctggattttgaactgacaaagacgaccgccaaagaggtcgctctcctgcggacatactgtattgaagcccttatcagcaatattaccacagcgacccgctgcccgacgcaaggagagccctatctgaaggaggaacaggaccagcagtacatctgtagacgggatgttgtggaccgcggctgggggaacggatgcggcctcttcgggaaaggaggcgtggtcacatgcgccaagttttcttgttccggcaaaattaccgggaatctggtgcaaatcgagaaccttgaatataccgttgtggtcacagtgcataatggagatacccacgctgttggcaacgacacaagcaatcacggggtgacggccaccattacacctagatctccctccgtcgaggtgaagctgcctgattacggagaactcaccctggactgcgagccccggagcggcatcgacttcaacgagatgatcctgatgaagatgaaaaagaaaacatggctcgtccataagcagtggtttctggatcttccgctgccttggaccgctggggccgacacgtctgaagtgcactggaattacaaagagagaatggttaccttcaaggtgccccatgccaaacgccaggatgtcacagtgctcggctcccaggaaggagctatgcacagcgcgctggccggcgctaccgaggttgactccggggatggaaaccacatgtttgccggccatcttaagtgtaaggtgcggatggaaaaactgagaattaaggggatgtcttatacaatgtgcagcggaaaattctccatcgacaaggagatggccgagacccaacacggcacgacagtcgtgaaagtgaagtacgaaggggctggcgccccttgtaaggttcccattgagatccgcgatgtcaataaagaaaaggtggtgggacgggtcattagctctacacccctcgcggagaacacaaactccgtgaccaatatcgagctggaacctccgttcggcgacagctatatcgttattggggtgggaaactctgctctgaccctccattggtttagaaaaggcagctccatcgggaagatgttcgagtctacataccgcggagccaaacggatggccattctgggcgaaacggcttgggattttgggagcgtcggcggacttttcacctccctgggcaaggccgtgcaccaggtttttgggagcgtgtatacaaccatgttcggaggcgtctcttggatgatccgcattctcatcgggtttctggtgctgtggatcggaacaaattcccgcaacaccagcatggctatgacgtgcattgccgttggcgggatcacacttttcctcggctttaccgtgcaggcggacatgggatgtgtcgtgtcttggtccggccgggagctgaagtgcgggagcggaattttcgtggtcgataatgttcatacctggacagaacaatacaaatttcagcccgagtcccctgccagactggcttctgccatcctcaacgctcacaaggacggcgtgtgtgggattcgcagcaccacacggctggagaatgtgatgtggaaacagatcacgaacgaacttaattatgtcctgtgggagggaggccacgacctcaccgtggttgccggcgatgtgaagggggtcctgacaaaaggaaagagagcgctgacaccccctgtgtccgaccttaagtactcttggaaaacatggggcaaggccaaaattttcacccccgaagctcggaacagcacgtttctcatcgatgggccggacacctccgagtgccctaatgaacgcagagcctggaacagcctggaggttgaggattacggattcggcatgttcacaaccaatatctggatgaagtttcgggaagggtcttccgaggtgtgtgaccatagactgatgagcgctgccattaaagatcagaaggccgtccacgctgacatgggatattggatcgaatcttccaaaaaccaaacatggcagattgagcgcgcgagcctcatcgaagtgaagacctgcctgtggcccaagacacataccctttggtctaatggcgttctggagagccagatgctcattcctaaatcctacgccggccccttcagccagcacaactatcggcaagggtacgctacgcagacagtgggaccttggcacctgggcaagctggagatcgattttggggaatgccccggaaccaccgtcacaatccaggaggactgtgatcatagaggcccgtctcttcgcaccacgacagcctccgggaaactcgtgacccagtggtgctgtagaagctgcacaatgcctcccctgcggttcctgggagaagacggctgttggtatggcatggagattcgccccctctccgagaaggaagagaacatggtgaaatctcaagtcaccgccgggcagggaacaagcgaaaccttttccatgggcctgctttgcctgacactcttcgttgaggaatgtctgagacggcgcgtgaccagaaagcacatgatcctggctgtggtcattacactttgcgccatcattctcgggggactgacctggatggatctgctccgggcgctgatcatgcttggcgacacaatgtctgggcgcatcggaggccagacccatctggctattatggccgtgtttaagatgagccctggctacgttctcggggtgttcctgagaaaactgacgtcccgggagacagcccttatggtcatcggaatggctatgaccacaaccctgtctattccgcacgacctcatggagctgatcgatggcattagcctcgggctgatccttctgaagatcgtgacccagtttgacaatacacaagttggaacgctcgccctgtccctgaccttcattcgcagcacaatgtctcttgtgatggcgtggagaaccatcatggctgtcctgtttgtggtcacactcattcccctgtgtcggacctcctgcctccagaaacagagccattgggtggaaatcacggccctgattcttggcgcccaagctctgcctgtttatctcatgacactgatgaagggggcctctagacgctcctggcccctgaacgagggaatcatggctgtgggccttgtcagcctgctcggctctgccctgctcaaaaatgatgtgcctctggcggggcccatggttgccggaggccttctgctggctgcctacgtgatgtccgggagctccgctgacctcagcctggaaaaggccgccaacgtccagtgggatgagatggctgacattaccggatctagccctatcatcgaagtgaagcaggatgaggacggctccttctctattcgggatgtggaggaaaccaatatgatcacacttctggttaaactcgcgctgattaccgtcagcgggctctaccccctggccatcccggtgacaatgacgctttggtatatgtggcaagtgaagacccaaagatccggagctctgtgggacgtcccttctcccgccgccacacagaaagctgccctgagcgagggcgtgtaccgcattatgcagcggggcctctttgggaagacccaggttggagtgggcatccacatggaaggggtcttccacacaatgtggcatgtgaccagaggatccgttatctgtcacgagacgggccgcctggaaccttcttgggcggatgtgcggaacgacatgattagctatgggggaggctggagacttggcgataaatgggacaaggaggaggacgtccaagtgctggctatcgaacccgggaagaatccgaaacatgttcagaccaagcctggactcttcaaaacactgaccggcgagattggggccgtgacactcgattttaagcccggaacctccggcagccctatcattaaccgcaaagggaaggtcatcggcctgtacggaaatggcgtggtgacaaaatctggggactatgtctccgccatcacgcaggctgaacggattggagagcccgattacgaggttgacgaagatatcttcagaaagaagcggcttaccattatggacctgcaccccggcgccgggaaaacaaagcgcatcctgcctagcattgtgagagaggcgctcaaacggcgcctgagaacccttatcctggctccgacccgggtggtcgccgccgaaatggaggaagctctcagaggactgcccattcgctatcagacccctgccgtgaagtctgagcatacgggccgggagatcgttgatctcatgtgccacgctacctttacaaccagactgctttccagcacacgcgtgcccaactacaatctgatcgtcatggacgaagcccacttcaccgatccttcctctgtggcggcccgggggtacattagcacgagagttgagatgggcgaagctgccgctatctttatgacagccacaccccctggagccaccgacccgttcccccaatccaacagccctattgaggatatcgaacgcgagattcccgagcggtcttggaatacaggctttgactggatcaccgactatcaggggaaaacagtgtggttcgtcccttccatcaaggctggaaacgatattgcgaattgcctgagaaagagcggcaaaaaggtgatccagctctctcgcaaaacctttgacacggaataccccaagacaaaactgaccgattgggacttcgtcgtgacaaccgatattagcgagatgggggccaactttagagctggacgggttatcgacccgcgcagatgtcttaagcctgtgattctgacggatggccccgaacgggtgatcctcgccgggcccatccctgtcacccccgcctccgctgcccaacgcagaggccggattggaagaaaccctgcgcaggaggacgatcagtatgttttctctggcgacccgctgaagaatgatgaagaccatgctcactggacagaggccaaaatgctgctcgataacatctacacccccgaggggattatccctacacttttcggacccgaacgcgagaagacccaggccattgacggcgaatttcggctgagaggggagcaacgcaaaacattcgtggagctgatgcggagaggagacctccctgtgtggctgagctataaggtcgcttccgccggcatctcttacaaagatcgggaatggtgctttaccggcgagcgcaataaccagattcttgaagagaatatggaagtggagatctggacgagagagggggaaaagaagaaactgcggccccgctggctcgacgcgagagtttatgccgatccgatggctctgaaggacttcaaagagtttgccagcggacggaagtccatcacactggatattctcaccgaaatcgctagccttcctacctacctgtcttcccgcgccaaactggctctcgacaacattgtgatgctgcatacaaccgagagaggcgggcgggcctaccagcacgcgcttaatgaactgcccgagagcctcgagacactgatgctggtcgccctccttggagctatgacggccggcatcttcctgtttttcatgcaggggaagggaattggcaagctgtccatgggcctcatcaccatcgctgtggcctctgggctgctttgggtcgccgaaattcaacctcagtggatcgctgcgagcattatcctggagtttttcctcatggtgctgctgattcccgaacctgagaaacagcgcacaccccaggataaccaactcatctatgttatccttaccattctgacaatcattggactgatcgccgctaatgaaatgggcctcattgagaagaccaaaacggactttgggttctaccaggtgaagaccgagacaaccatcctggatgtcgaccttagaccggcctccgcctggacactgtatgctgtggccaccacgattctcacacctatgctgcggcacaccatcgaaaacacatctgcgaatctgagcctcgccgctatcgccaaccaggctgccgttcttatgggactgggcaaagggtggcccctgcatagaatggatctcggagtgcccctgcttgcgatgggctgttactcccaggtcaatcctaccaccctgacagccagcctcgtgatgctgctggtgcactatgctattatcggcccggggctccaagccaaggctacgcgcgaggcccagaaacggaccgctgccggaattatgaagaaccccacagttgacggcatcaccgtcattgatcttgaacctatctcttacgaccccaagtttgagaaacagctggggcaagtgatgctgctcgtgctgtgcgcgggacagcttctgctcatgagaacaacctgggccttctgtgaggtcctgacgctggctacaggccctatcctcaccctttgggaagggaatcccggacgcttctggaacaccacaattgccgtttccaccgctaacatctttcggggcagctatctggccggcgccgggctggcgttctctctcattaagaatgctcagacacctagacgcggaacgggcaccacaggggagaccctgggagaaaaatggaagcggcagcttaactccctggacagaaaagagtttgaagagtacaagcgcagcggcatcctcgaggtggatcggacagaagccaagtctgctctgaaagacgggagcaagattaaacatgccgtgtccagaggatctagcaagatccgctggatcgtcgagcggggcatggtgaaaccgaagggcaaggttgtggatctggggtgcggaagaggcgggtggtcctactatatggccaccctcaaaaatgtcacggaagtgaagggatacaccaaaggcgggcccggacacgaggaacctattcccatggctacatatggctggaaccttgttaagctgcatagcggcgtggacgtcttctacaaacctaccgagcaagtggatacactgctctgtgacatcggggagtcctctagcaatcccaccattgaagagggacgcacactgagagtgcttaagatggtcgaaccgtggctgtcctctaagcctgagttttgcatcaaagttctcaacccctatatgcccaccgtgattgaagaactggagaagctgcagcggaaacacggcgggaatctcgtgcgctgtcctcttagcagaaactccacgcacgaaatgtactgggtctctggagccagcggcaatatcgtgtccagcgttaacacaacctctaagatgctgctgaatcggttcaccacaagacatcggaaacccacgtatgagaaggatgtggacctcggggcgggaacccgctccgtcagcacagaaaccgagaaacctgatatgacaattatcggcagacggctgcagcgccttcaggaggaacacaaggagacctggcattacgaccaagaaaacccgtacagaacatgggcctatcacggctcttacgaggctccctccaccgggagcgcctcttccatggtgaatggagttgtgaagctgctcacgaaaccttgggatgtcatccccatggtgacccagctggctatgacagacaccacaccttttggccagcagcgggttttcaaggaaaaagtggacacccgcacgccccaaccgaagcctgggacaagaatggtcatgaccacaaccgccaactggctgtgggcgctcctgggcaaaaagaagaatccccggctttgcacgcgcgaggagtttattagcaaagtgagatccaacgccgctatcggcgccgtcttccaggaagaacaggggtggaccagcgcttctgaagccgtgaatgatagccggttttgggagctggttgacaaggaacgcgctctccaccaagagggcaaatgtgagtcctgcgtgtataacatgatgggaaagagagagaaaaagctgggcgagttcgggcgggccaagggatctcgcgcgatttggtacatgtggcttggcgccagatttctggagttcgaggctctcgggttcctgaacgaagatcattggtttggacgggagaatagctggtccggcgtcgagggggaaggcctgcacagactcggatatatcctggaggaaattgacaaaaaggatggcgaccttatgtacgccgatgacacagctgggtgggatacccgcatcacagaggacgatctgcagaacgaggaactcatcaccgagcagatggcccctcatcacaaaattctggccaaggcgatcttcaaacttacatatcagaataaggtggtgaaggttctgcggcccacccctagaggagctgtgatggacattatctctcgcaaagatcaacggggcagcgggcaggtcggaacgtacggcctcaacacatttaccaatatggaagtgcagctgattagacagatggaggccgaaggggttatcacccaagacgacatgcagaaccccaagggcctgaaagagcgcgtggagaagtggctccgggaatgcggagtcgatagactgaaacgcatggccatctccggcgacgattgtgtggtcaagccgcttgacgagcggttcgggacatctctgctctttctgaatgatatgggaaaagtgagaaaggacattcctcagtgggaacccagcaagggctggaaaaactggcaggaggttcccttctgctcccatcactttcacaagatcttcatgaaagatgggcgcagccttgtggtcccttgtcggaatcaagacgaactgattggcagagctcggatctctcagggagccgggtggtccctcagagagaccgcttgcctgggcaaggcctacgcgcagatgtggagcctgatgtattttcatcgccgggatctcagactggcctctatggctatttgttccgccgtgccgacagagtggttccccacgagccgcaccacatggtccatccacgctcatcaccagtggatgaccacagaagacatgcttaaagtttggaacagagtgtggatcgaggataatcctaacatgattgacaagacccccgtccactcttgggaagacatcccttacctgggaaagcgggaggatctctggtgcggcagcctgattgggctttccagccgcgccacgtgggcgaaaaatatccataccgccattacacaagtgagaaacctgatcggaaaggaagagtatgtggactacatgcccgttatgaaacggtattctgctccttccgagagcgaaggcgtcctctga

SEQ ID NO: 20996 - RNA, 9867 nt, synthetic construct
  misc_feature 1..9867: note = derived and/or modified CDS sequence (opt5) from DENV-4__FJ639737__SS-prME
  source 1..9867: mol_type = other RNA
agcaccatcaccctgctctgcctgattcccacggtgatggccttccacctttccacccgggacggagagcctctgatgatcgtcgctaagcatgaacgggggcgcccgctcctgtttaaaaccaccgagggaattaacaagtgtacccttatcgccatggatctgggcgaaatgtgcgaggacaccgttacgtacaaatgtcccctcctgattaataccgaacctgaggatatcgactgctggtgtaacctgacgtctacctgggtgatgtatgggacatgcacccagagcggagagagacggcgcgaaaagagatccgtggcgctcacaccccactctggcatggggctggagacccgggctgaaacgtggatgagctccgagggagcctggaaacatgcccaacgcgtcgagtcttggatccttagaaatcctggcttcgctctgctcgccggctttatggcttacatgattgggcagacaggaatccagcggaccgtgttctttgttctgatgatgcttgtggcccccagctatggcatgcgctgtgtcggggtgggaaacagagatttcgttgaaggcgtgtccgggggagcgtgggtcgacctggtgctcgagcacggcggctgcgtgacaaccatggcccaggggaagcctaccctggattttgaactgacaaagacgaccgctaaagaggtcgccctcctgcggacatactgtattgaagctcttatcagcaatattaccacagccacccgctgcccgacgcaaggagagccctatctgaaggaggaacaggaccagcagtacatctgtagacgggatgttgtggaccgcggctgggggaacggatgcggcctcttcgggaaaggaggcgtggtcacatgcgcgaagttttcttgttccggcaaaattaccgggaatctggtgcaaatcgagaaccttgaatataccgttgtggtcacagtgcataatggagatacccacgccgttggcaacgacacaagcaatcacggggtgacggctaccatcacacctagatctccctccgtcgaggtgaagctgcctgattacggagaactcaccctggactgcgagccccggagcggcattgacttcaacgagatgatcctgatgaagatgaaaaagaaaacatggctcgtccataagcagtggtttctggatcttccgctgccttggaccgccggggctgacacgtctgaagtgcactggaattacaaagagagaatggttaccttcaaggtgccccatgccaaacgccaggatgtcacagtgctcggctcccaggaaggagccatgcacagcgctctggcgggcgccaccgaggttgactccggggatggaaaccacatgtttgctggccatcttaagtgtaaggtgcggatggaaaaactgagaattaaggggatgtcttatacaatgtgcagcggaaaattctccatcgacaaggagatggccgagacccaacacggcacgacagtcgtgaaagtgaagtacgaaggggccggcgctccttgtaaggttcccattgagatccgcgatgtcaataaagaaaaggtggtgggacgggtcatcagctctacacccctcgccgagaacacaaactccgtgaccaatattgagctggaacctccgttcggcgacagctatatcgttattggggtgggaaactctgcgctgaccctccattggtttagaaaaggcagctccatcgggaagatgttcgagtctacataccgcggagctaaacggatggccattctgggcgaaacggcctgggattttgggagcgtcggcggacttttcacctccctgggcaaggctgtgcaccaggtttttgggagcgtgtatacaaccatgttcggaggcgtctcttggatgatcagaatcctcattgggtttctggtgctgtggatcggaacaaattcccgcaacaccagcatggccatgacgtgcattgctgttggcgggatcacacttttcctcggctttaccgtgcaggccgacatgggatgtgtcgtgtcttggtccggccgggagctgaagtgcgggagcggaattttcgtggtcgataatgttcatacctggacagaacaatacaaatttcagcccgagtcccctgcgagactggcctctgctatcctcaacgcccacaaggacggcgtgtgtgggattcgcagcaccacacggctggagaatgtgatgtggaaacagatcacgaacgaacttaattatgtcctgtgggagggaggccacgacctcaccgtggttgctggcgatgtgaagggggtcctgacaaaaggaaagagagccctgacaccccctgtgtccgaccttaagtactcttggaaaacatggggcaaggcgaaaatcttcacccccgaagcccggaacagcacgtttctcattgatgggccggacacctccgagtgccctaatgaacgcagagcttggaacagcctggaggttgaggattacggattcggcatgttcacaaccaatatctggatgaagtttcgggaagggtcttccgaggtgtgtgaccatagactgatgagcgccgctattaaagatcagaaggccgtccacgccgacatgggatattggatcgaatcttccaaaaaccaaacatggcagattgagcgcgctagcctcatcgaagtgaagacctgcctgtggcccaagacacataccctttggtctaatggcgttctggagagccagatgctcatccctaaatcctacgcgggccccttcagccagcacaactatcggcaagggtacgccacgcagacagtgggaccttggcacctgggcaagctggagattgattttggggaatgccccggaaccaccgtcacaatccaggaggactgtgatcatagaggcccgtctcttcgcaccacgacagcttccgggaaactcgtgacccagtggtgctgtagaagctgcacaatgcctcccctgcggttcctgggagaagacggctgttggtatggcatggagattcgccccctctccgagaaggaagagaacatggtgaaatctcaagtcaccgccgggcagggaacaagcgaaaccttttccatgggcctgctttgcctgacactcttcgttgaggaatgtctgagacggcgcgtgaccagaaagcacatgatcctggccgtggtcattacactttgcgctatcatcctcgggggactgacctggatggatctgctccgggccctgattatgcttggcgacacaatgtctgggcgcatcggaggccagacccatctggcgattatggctgtgtttaagatgagccctggctacgttctcggggtgttcctgagaaaactgacgtcccgggagacagcccttatggtcatcggaatggccatgaccacaaccctgtctattccgcacgacctcatggagctgatcgatggcatcagcctcgggctgattcttctgaagatcgtgacccagtttgacgatacacaagttggaacgctcgctctgtccctgaccttcattcgcagcacaatgtctcttgtgatggcctggagaaccatcatggcggtcctgtttgtggtcacactcattcccctgtgtcggacctcctgcctccagaaacagagccattgggtggaaatcacggctctgattcttggcgcccaagccctgcctgtttatctcatgacactgatgaagggggcttctagacgctcctggcccctgaatgagggaatcatggccgtgggccttgtcagcctgctcggctctgctctgctcaaaaacgacgtgcctctggccgggcccatggttgcgggaggccttctgctggccgcttacgtgatgtccgggagctccgccgatctcagcctggaaaaggctgcctctgtccagtgggacgagatggccgatatcaccggaagctcccctattatcgaagtgaagcaggacgaggatggctctttcagcattcgggacgtggaggaaaccaatatgatcacacttctggttaaactcgctctgattaccgtctccgggctctaccccctggcgatcccggtgacaatgacgctttggtatatgtggcaagtgaagacccaaagatctggagccctgtgggatgtccctagccccgctgccacacagaaagccgctctgtccgagggcgtgtaccgcatcatgcagcggggcctctttgggaagacccaggttggagtgggcattcacatcgaaggggtcttccacacaatgtggcatgtgaccagaggatctgttatttgtcacgagacgggccgcctggaacctagctgggccgacgtgcggaacgatatgatctcctatgggggaggctggagacttggcgacaaatgggacaaggaggaggatgtccaagtgctggcgattgaacccgggaagaatccgaaacatgttcagaccaagcctggactcttcaaaacactgaccggcgagatcggggctgtgacactcgactttaagcccggaaccagcggctctcctatcattaaccgcaaagggaaggtcatcggcctgtacggaaatggcgtggtgacaaaatccggggattatgtcagcgccattacgcaggccgaacggatcggagagcccgactacgaggttgatgaagacattttcagaaagaagcggcttaccatcatggatctgcaccccggcgctgggaaaacaaagcgcattctgccttctatcgtgagagaggccctcaaacggcgcctgagaacccttatcctggcgccgacccgggtggtcgctgccgaaatggaggaagccctcagaggactgcccattcgctatcagacccctgctgtgaagtccgagcatacgggccgggagatcgttgacctcatgtgccacgccacctttacaaccagactgcttagctccacacgcgtgcccaactacaatctgattgtcatggatgaagctcacttcaccgacccttctagcgtggccgcgcgggggtacatctccacgagagttgagatgggcgaagccgctgccatttttatgacagctacaccccctggagccaccgatccgttcccccaaagcaactctcctatcgaggacatcgaacgcgagattcccgagcggtcctggaatacaggctttgactggatcaccgattatcaggggaaaacagtgtggttcgtccctagcattaaggccggaaacgacatcgctaattgcctgagaaagtctggcaaaaaggtgattcagctcagccgcaaaacctttgatacggaataccccaagacaaaactgaccgactgggatttcgtcgtgacaaccgacatctccgagatgggggcgaactttagagccggacgggttatcgatccgcgcagatgtcttaagcctgtgattctgacggacggccccgaacgggtgatcctcgctgggcccattcctgtcacccccgcctctgccgctcaacgcagaggccggatcggaagaaatcctgcccaggaggatgaccagtatgttttcagcggcgatccgctgaagaacgacgaagatcatgcgcactggacagaggctaaaatgctgctcgacaacatttacacccccgaggggatcattcctacacttttcggacccgaacgcgagaagacccaggccatcgacggcgaatttcggctgagaggggagcaacgcaaaacattcgtggagctgatgcggagaggagatctccctgtgtggctgtcctataaggtcgcctctgctggcatcagctacaaagaccgggaatggtgctttaccggcgagcgcaataaccagattcttgaagagaatatggaagtggagatctggacgagagagggggaaaagaagaaactgcggccccgctggctcgatgccagagtttatgcggacccgatggccctgaaggatttcaaagagtttgcttccggaagaaagagcattacactggacatcctcaccgaaattgcctctcttcctacctacctgtccagccgcgctaaactggccctcgataacatcgtgatgctgcatacaaccgagagaggcgggcgggcttaccagcacgcccttaatgaactgcccgagtccctcgagacactgatgctggtcgcgctccttggagccatgacggctggcatcttcctgtttttcatgcaggggaagggaattggcaagctgtctatgggcctcatcaccattgccgtggctagcgggctgctttgggtcgccgaaatccaacctcagtggattgccgcttccatcatcctggagtttttcctcatggtgctgctgattcccgaacctgagaaacagcgcacaccccaggacaaccaactcatctatgttattcttaccatcctgacaattatcggactgattgcggccaatgaaatgggcctcatcgagaagaccaaaacggattttgggttctaccaggtgaagaccgagacaaccatcctggacgtcgatcttagaccggcttctgcctggacactgtatgccgtggctaccacgattctcacacctatgctgcggcacaccatcgaaaacacaagcgccaatctgtccctcgcggccattgctaaccaggccgctgttcttatgggactgggcaaagggtggcccctgcatagaatggacctcggagtgcccctgcttgccatgggctgttacagccaggtcaatcctaccaccctgacagcgtctctcgtgatgctgctggtgcactatgccatcattggcccggggctccaagctaaggccacgcgcgaggctcagaaacggaccgccgctggaatcatgaagaaccccacagttgatggcatcaccgtcattgaccttgaacctatctcctacgaccccaagtttgagaaacagctggggcaagtgatgctgctcgtgctgtgcgccggacagcttctgctcatgagaacaacctgggcgttctgtgaggtcctgacgctggccacaggccctattctcaccctttgggaagggaatcccggacgcttctggaacaccacaatcgctgttagcaccgccaatatttttcggggctcttatctggctggcgccgggctggccttctccctcatcaagaacgcgcagacacctagacgcggaacgggcaccacaggggagaccctgggagaaaaatggaagcggcagcttaacagcctggatagaaaagagtttgaagagtacaagcgctctggcatcctcgaggtggaccggacagaagctaagagcgccctgaaagatgggtccaagattaaacatgctgtgtctagaggaagctccaagatccgctggattgtcgagcggggcatggtgaaaccgaagggcaaggttgtggacctggggtgcggaagaggcgggtggagctactatatggccaccctcaaaaatgtcacggaagtgaagggatacaccaaaggcgggcccggacacgaggaacctatccccatggccacatatggctggaaccttgttaagctgcattccggcgtggatgtcttctacaaacctattgagcaagtggacaccctgctctgtgatatcggggagtctagctccaatcccacaattgaagagggacgcaccctgagagtgcttaagatggtcgaaccgtggctgtctagcaagcctgagttttgcatcaaagttctcaacccctatatgcccacagtgatcgaagaactggagaagctgcagcggaaacacggcgggaatctcgtgcgctgtcctctttccagaaactctacccacgaaatgtactgggtcagcggagcttccggcaatattgtgagctctgttaacacgacatccaagatgctgctgaatcggttcaccaccagacatcggaaacccacatatgagaaggacgtggatctcggggccggaacgcgcagcgtctctaccgaaacagagaaacctgacatgaccatcattggcagacggctgcagcgccttcaggaggaacacaaggagacatggcattacgatcaagaaaacccgtacagaacctgggcgtatcacggctcctacgaggcccccagcacagggtctgcttccagcatggtgaatggagttgtgaagctgctcaccaaaccttgggacgtcatccccatggtgacgcagctggccatgaccgacacaaccccttttggccagcagcgggttttcaaggaaaaagtggatacacgcacaccccagccgaagcctgggacgagaatggtcatgacaaccacagctaactggctgtgggccctcctgggcaaaaagaagaatccccggctttgcacccgcgaggagtttatttccaaagtgagaagcaacgcggccatcggcgctgtcttccaggaagaacaggggtggacgtctgccagcgaagctgtgaatgactcccggttttgggagctggttgataaggaacgcgccctccaccaagagggcaaatgtgagtcttgcgtgtataacatgatgggaaagagagagaaaaagctgggcgagttcgggcgggctaagggaagccgcgccatctggtacatgtggcttggcgcgagatttctggagttcgaggccctcgggttcctgaatgaagaccattggtttggacgggagaactcctggtctggcgtcgagggggaaggcctgcacagactcggatatattctggaggaaatcgataaaaaggacggcgatcttatgtacgctgacgataccgccgggtgggacacacgcattaccgaggatgacctgcagaacgaggaactcatcacagagcagatggctcctcatcacaaaattctggccaaggccatcttcaaacttacctatcagaataaggtggtgaaggttctgcggcccacacctagaggagcggtgatggatatcattagccgcaaagaccaacggggctccgggcaggtcggaacctacggcctcaacacgtttacaaatatggaagtgcagctgatcagacagatggaggctgaaggggttattacccaagacgatatgcagaaccccaagggcctgaaagagcgcgtggagaagtggctccgggaatgcggagtcgacagactgaaacgcatggccatctctggcgatgactgtgtggtcaagccgcttgatgagcggttcgggaccagcctgctctttctgaatgacatgggaaaagtgagaaaggatattcctcagtgggaaccctccaagggctggaaaaactggcaggaggttcccttctgcagccatcactttcacaagatcttcatgaaagacgggcgctctcttgtggtcccttgtcggaatcaagatgaactgatcggcagagcccggatttcccagggagctgggtggagcctcagagagacagcctgcctgggcaaggcttacgcccagatgtggtctctgatgtattttcatcgccgggacctcagactggcgtccatggccatctgtagcgctgtgccgaccgagtggttccccacatcccgcacgacctggtctattcacgcccatcaccagtggatgacaaccgaagatatgcttaaagtttggaacagagtgtggatcgaggacaatcctaacatgattgacaagacacccgtccacagctgggaagatatcccttacctgggaaagcgggaggacctctggtgcggctccctgattgggcttagctctcgcgctacctgggccaaaaatatccatacggcgatcacccaagtgagaaacctgattggaaaggaagagtatgtggattacatgcccgttatgaaacggtattccgcccctagcgagtctgaaggcgtcctctga

SEQ ID NO: 20997 - RNA, 9867 nt, synthetic construct
  misc_feature 1..9867: note = derived and/or modified CDS sequence (opt5) from DENV-4__FJ639738__SS-prME
  source 1..9867: mol_type = other RNA
agcaccatcacactgctctgcctgattcccacggtgatggccttccacctttccaccagagacggcgagcctctgatgatcgtcgctaagcatgaacgggggcgcccgctcctgtttaaaacaaccgagggaattaacaagtgtacacttatcgccatggatctgggcgaaatgtgcgaggacaccgttacatacaaatgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggatccttagaaatcctggcttcgctctgctcgccggctttatggcttacatgatcgggcagacaggaattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctcttattagcaatatcaccacagccacccgctgcccgacgcaaggagagccctatctgaaggaggaacaggaccagcagtacatttgtagacgggatgtggtggaccgcggctgggggaacggatgcggcctcttcgggaaaggaggcgtcgtgacatgcgcgaagttttcttgttccggcaaaatcaccgggaatctggttcaaattgagaaccttgaatataccgtggtcgtgacagttcataatggagatacccacgccgtgggcaacgacacaagcaatcacggggtcacggctaccatcacacctagatctccctccgtggaggtcaagctgcctgattacggagaactcaccctggactgcgagccccggagcggcatcgacttcaacgagatgattctgatgaagatgaaaaagaaaacatggctcgtgcataagcagtggtttctggatcttccgctgccttggaccgccggggctgacacgtctgaagttcactggaattacaaagagagaatggtgaccttcaaggtcccccatgccaaacgccaggatgtgacagttctcggctcccaggaaggagccatgcacagcgctctggcgggcgccaccgaggtggactccggggatggaaaccacatgtttgctggccatcttaagtgtaaggtccggatggaaaaactgagaatcaaggggatgtcttatacaatgtgcagcggaaaattctccattgacaaggagatggccgagacccaacacggcacgacagtggtgaaagttaagtacgaaggggccggcgctccttgtaaggtccccatcgagattcgcgatgtgaataaagaaaaggtggtcggacgggtgatcagctctacccccctcgccgagaacacaaactccgttaccaatatcgagctggaacctccgttcggcgacagctatattgtgatcggggtcggaaactctgcgctgaccctccattggtttagaaaaggcagctccattgggaagatgttcgagtctacataccgcggagctaaacggatggccatcctgggcgaaacggcctgggattttgggagcgtgggcggacttttcacctccctgggcaaggctgttcaccaggtgtttgggagcgtctatacaaccatgttcggaggcgtgtcttggatgattagaatcctcatcgggtttctggttctgtggattggaacaaattcccgcaacaccagcatggccatgacgtgcatcgctgtgggcgggattacacttttcctcggctttaccgtccaggccgacatgggatgtgtggtgtcttggtccggccgggagctgaagtgcgggagcggaatcttcgtcgttgataatgtgcatacctggacagaacaatacaaatttcagcccgagtcccctgcgagactggcctctgctattctcaacgcccacaaggacggcgtgtgtgggatccgcagcaccacacggctggagaatgtcatgtggaaacagattacgaacgaacttaattatgtgctgtgggagggaggccacgacctcaccgttgtggctggcgatgtcaagggggtgctgacaaaaggaaagagagccctgaccccccctgtttccgaccttaagtactcttggaaaacatggggcaaggcgaaaatcttcacccccgaagcccggaacagcacgtttctcatcgatgggccggacacctccgagtgccctaatgaacgcagagcttggaacagcctggaggtggaggattacggattcggcatgttcacaaccaatatttggatgaagtttcgggaagggtcttccgaggtctgtgaccatagactgatgagcgccgctatcaaagatcagaaggccgtgcacgccgacatgggatattggattgaatcttccaaaaaccaaacatggcagatcgagcgcgctagcctcattgaagttaagacctgcctgtggcccaagacacataccctttggtctaatggcgtgctggagagccagatgctcatccctaaatcctacgcgggccccttcagccagcacaactatcggcaagggtacgccacgcagacagtcggaccttggcacctgggcaagctggagatcgattttggggaatgccccggaaccaccgtgacaattcaggaggactgtgatcatagaggcccgtctcttcgcaccacgacagcttccgggaaactcgtgacccagtggtgctgtagaagctgcacaatgcctcccctgcggttcctgggagaagacggctgttggtatggcatggagatccgccccctctccgagaaggaagagaacatggtcaaatctcaagttaccgccgggcagggaacaagcgaaaccttttccatgggcctgctttgcctgacgctcttcgtggaggaatgtctgagacggcgcgtgaccagaaagcacatgattctggccgtcgtgatcacactttgcgctattatcctcgggggactgacctggatggatctgctccgggccctgatcatgcttggcgacacaatgtctgggcgcattggaggccagacccatctggcgatcatggctgtttttaagatgagccctggctacgtgctcggggtcttcctgagacggctgacgtcccgcgagacagcccttatggtgattggaatggccatgaccacaaccctgtctatcccgcacgacctcatggagctgattgatggcatcagcctcgggctgatccttctgaaaattgttacccagtttgacaatacacaagtgggaacgctcgctctgtccctgaccttcatcagaagcacaatgtctcttgtcatggcctggcggaccattatggcggtgctgtttgtcgtgacactcatccccctgtgtagaacctcctgcctccagaagcagagccattgggttgaaattacggctctgatccttggcgcccaagccctgcctgtgtatctcatgacactgatgaaaggggcttctcgccggtcctggcccctgaacgagggaattatggccgtcggccttgtgagcctgctcggctctgctctgctcaagaatgatgttcctctggccgggcccatggtggcgggaggccttctgctggccgcttacgtcatgtccgggagctccgccgacctcagcctggaaaaagctgccaacgtgcagtgggatgagatggccgacatcaccggatctagccctatcattgaagtgaagcaggatgaggacggctccttctctatcagagatgttgaggaaaccaatatgattacacttctggtcaagctcgctctgatcaccgtgagcgggctctaccccctggcgattccggtgacaatgacgctttggtatatgtggcaggtcaaaacccaacgctccggagccctgtgggacgtgccttctcccgctgccacacagaaggccgctctgagcgagggcgtttaccggatcatgcagagaggcctctttgggaaaacccaggtgggagtcggcatccacatggaaggggtgttccacacaatgtggcatgttacccgcggatccgtgatttgtcacgagacgggccggctggaaccttcttgggccgatgtcagaaacgacatgatcagctatgggggaggctggcgccttggcgataagtgggacaaagaggaggacgtgcaagttctggcggtggaacccgggaagaatccgaagcatgtccagaccaaacctggactcttcaagacaattaccggcgagatcggggctgtgacactggattttaaacccggaacctccggcagccctattatcaaccggaaggggaaagtgatcggcctctacggaaatggcgtcgttacaaagtctggggactatgtgtccgccattacgcaggccgaaagaatcggagagcccgattacgaggtggacgaagatattttccggaaaaagcgcctgaccatcatggaccttcaccccggcgctgggaagacaaaaagaattctgcctagcatcgtccgggaggccctgaagcgcagactccggaccctgattcttgcgccgaccagagtggttgctgccgaaatggaggaagccctgcgcggactccccatccggtatcagacacctgctgtgaaatctgagcatacgggcagagagatcgtcgatctgatgtgccacgccacctttacaacccgcctcctgtccagcacacgggtgcccaactacaatcttattgttatggacgaagctcacttcaccgatccttcctctgtggccgcgagagggtacatcagcacgcgcgtcgagatgggcgaagccgctgccatttttatgacagctaccccccctggagccaccgacccgttcccccaatccaacagccctatcgaggatattgaacgggagatccccgagagatcttggaatacaggctttgactggatcaccgactatcaggggaagacagtgtggttcgtcccttccattaaagccggaaacgatatcgctaattgcctgcgcaagagcggcaagaaagtgattcagctgtctagaaagacctttgacacggaataccccaaaacaaagctcaccgattgggacttcgttgtgacaaccgatatcagcgagatgggggcgaactttcgggccggacgcgtgattgacccgagacggtgtctgaaacctgtcatccttacggatggccccgaacgcgttatcctggctgggcccattcctgtgacccccgcctccgccgctcaaagacggggcagaatcggacgcaaccctgcccaggaggacgatcagtatgtgttctctggcgacccgctcaagaatgatgaagaccatgcgcactggacagaggctaagatgctgctggataacatttacacccccgaggggatcattcctacactcttcggacccgaacgggagaaaacccaggccatcgacggcgaatttagacttcgcggggagcaacggaagacattcgtcgagctgatgagacggggagacctgcctgtgtggctcagctataaagttgcctccgctggcatttcttacaaggatcgcgaatggtgctttaccggcgagagaaataaccagatcctggaagagaatatggaagtggagatctggacgcgggagggggaaaaaaagaagcttcgccccagatggctggacgcccgggtctatgcggatccgatggccctcaaagacttcaaggagtttgctagcggacgcaaatccattacactggatatcctgaccgaaattgccagcctccctacctacctttcttccagagctaagctggccctggacaacatcgtgatgctccatacaaccgagcggggcgggcgcgcttaccagcacgccctgaatgaacttcccgagagcctggagacactcatgctggtcgcgctgctcggagccatgacggctggcattttcctttttttcatgcaggggaaaggaatcggcaagctgtccatgggcctgatcaccattgccgtggcttctgggctcctgtgggttgccgaaatccaacctcagtggattgccgctagcatcattcttgagtttttcctgatggtgctcctgatccccgaacctgagaagcagagaacaccccaggataaccaactgatctatgtcattctcaccatccttacaattatcggactgattgcggccaatgaaatgggcctgatcgagaaaaccaagacggactttgggttctaccaggtgaaaaccgagacaaccattctcgatgttgacctgcggccggcttccgcctggacactttatgccgtggctaccacgatcctgacacctatgctcagacacaccatcgaaaacacatctgccaatctgagcctggcggccattgctaaccaggccgctgtcctcatgggacttggcaaggggtggcccctgcatcgcatggatctgggagtgcccctcctggccatgggctgttactcccaggtgaatcctaccacccttacagcgagcctggttatgctcctggtccactatgccatcattggcccggggctgcaagctaaagccacgcgggaggctcagaagagaaccgccgctggaatcatgaaaaaccccacagtggacggcattaccgtgatcgatctcgaacctatctcttacgaccccaagtttgagaagcagcttgggcaagtcatgctgctggttctctgcgccggacagctgcttctgatgcgcacaacctgggcgttctgtgaggtgctcacgctggccacaggccctattctgaccctctgggaagggaatcccggacggttctggaacaccacaatcgctgtgtccaccgccaacatttttagaggcagctatcttgctggcgccgggctggccttctctctgatcaaaaatgcgcagacacctcgccggggaacgggcaccacaggggagaccctcggagaaaagtggaaaagacagctgaactcccttgaccgcaaggagtttgaagagtacaaacggagcggcattctggaggtcgatagaacagaagctaagtctgccctcaaggacgggagcaaaatcaagcatgctgtgtcccgcggatctagcaaaatccggtggattgttgagagaggcatggtgaagccgaaaggcaaggtcgtggatctggggtgcggacgcggcgggtggtcctactatatggccaccctgaagaatgttacggaagtgaaaggatacaccaagggcgggcccggacacgaggaacctatccccatggccacatatggctggaacctcgtcaaacttcatagcggcgtggacgtgttctacaagcctaccgagcaagtcgatacactgctgtgtgacattggggagtcctctagcaatcccaccatcgaagagggaagaacactccgggttctgaaaatggtggaaccgtggctttcctctaagcctgagttttgcattaaggtgctgaacccctatatgcccaccgtcatcgaagagctcgagaaactgcagcgcaagcacggcgggaatctggtgagatgtcctctcagccggaactccacgcacgaaatgtactgggtttctggagctagcggcaatattgtgtccagcgtcaacacaacctctaaaatgcttctgaatagattcaccacacggcatcgcaagcccacgtatgagaaagatgtggacctgggggccggaaccagatccgttagcacagaaaccgagaagcctgatatgacaatcatcggccggcgcctccagagactgcaggaggaacacaaagagacctggcattacgaccaagaaaacccgtaccggacatgggcgtatcacggctcttacgaggccccctccaccgggagcgcttcttccatggtgaatggagtcgtgaagcttctgacgaagccttgggatgttattcccatggtgacccagctcgccatgacagacaccacaccttttggccagcagcgcgtcttcaaagaaaaggtggacaccagaacgccccaaccgaaacctgggacacggatggtcatgaccacaaccgctaactggctgtgggccctgctcggaaagaaaaagaatccccgcctgtgcacgagagaggagtttatcagcaaggtgcggtccaacgcggccattggcgctgttttccaggaagagcaggggtggaccagcgcctctgaagctgtgaatgatagccgcttttgggagcttgtcgacaaagaaagagccctgcaccaagagggcaagtgtgagtcctgcgtgtataacatgatgggaaaacgggaaaagaaactcggcgagttcgggcgcgctaagggatctagagccatctggtacatgtggctgggcgcgcggtttcttgaattcgaggccctggggttcctcaacgaagatcattggtttggaagagagaatagctggtccggcgtggagggggaaggcctgcaccgcctgggatatattctcgaggaaatcgacaagaaagatggcgacctgatgtacgctgatgacacagccgggtgggatacccggatcacagaggacgatcttcagaacgaggaactgattaccgagcagatggctcctcatcacaagatcctcgccaaagccattttcaagctgacatatcagaataaagttgtgaaggtccttagacccacccctcgcggagcggtgatggacatcatttctcggaaggatcaaagaggcagcgggcaggttggaacgtacggcctgaacacatttaccaatatggaagtgcagctcatccgccagatggaggctgaaggggtcatcacccaagacgacatgcagaaccccaaaggcctgaaggagcgggtggagaaatggctgagagaatgcggagtcgatcgcctcaagcggatggccatttccggcgacgattgtgtggttaaaccgctggacgagagattcgggacatctcttctgtttctcaatgatatgggaaaggtgcgcaaagacatccctcagtgggaacccagcaagggctggaagaactggcaggaggtccccttctgctcccatcactttcacaaaattttcatgaaggatgggcggagcctggtggttccttgtagaaatcaagacgaacttatcggacgggccagaatttctcagggcgctgggtggtccctgcgcgagaccgcctgcctcggcaaagcttacgcccagatgtggagcctgatgtattttcatcggagagatctgcgcctcgcgtctatggccatctgttccgctgtgccgacagagtggttccccacgagcagaaccacatggtccatccacgcccatcaccagtggatgaccacagaagacatgctgaaggtctggaaccgggtgtggattgaggataatcctaacatgatcgacaaaacccccgtgcactcttgggaagacattccttaccttggaaagcgcgaggatctgtggtgcggcagcctcatcgggctgtccagcagagctacgtgggccaagaatattcataccgcgatcacacaagttcggaaccttattggaaaagaagagtatgtcgactacatgcccgtgatgaagcgctattctgccccttccgagagcgaaggcgtgctgtga

SEQ ID NO: 20998 - RNA, 9867 nt, synthetic construct
  misc_feature 1..9867: note = derived and/or modified CDS sequence (opt5) from DENV-4__FJ639739__SS-prME
  source 1..9867: mol_type = other RNA
agcaccatgaccctgctctgcctgatccccacggccatggctttccacctttccaccagagacggagagcctctgatgattgtggccaagcatgaacgggggagaccgctcctgtttaaaaccaccgaggggatcaacaagtgtacccttattgcgatggatctgggcgaaatgtgcgaggacaccgtcacctacaaatgtcccctcctggttaataccgaacctgaggatatcgactgctggtgtaacctgacgtctacctgggtgatgtatgggacgtgcacccagagcggagagagacggcgcgaaaagagatccgtggctctcacaccccactctggcatggggctggagacccgggccgaaacgtggatgagctccgagggagcctggaaacatgctcaacgcgtcgagtcttggattcttagaaatcctggcttcgccctgctcgctggctttatggcctacatgatcgggcagacaggaatccagcggaccgtgttctttgttctgatgatgcttgtggcgcccagctatggcatgcgctgtgtcggggtgggaaacagagatttcgttgaaggcgtgtccgggggagcctgggtcgacctggtgctcgagcacggcggctgcgtgacaaccatggctcaggggaagcctaccctggattttgaactgacaaagacgaccgccaaagaggtcgctctcctgcggacatactgtattgaagcccttatcagcaatattaccacagcgacccgctgcccgacgcaaggagagccctatctgaaggaggaacaggaccagcagtacatctgtagacgggatgttgtggaccgcggctgggggaacggatgcggcctcttcgggaaaggaggcgtggtcacatgcgccaagttttcttgttccggcaaaattaccgggaatctggtgcaaatcgagaaccttgaatataccgttgtggtcacagtgcataatggagatacccacgctgttggcaacgacacaagcaatcacggggtgacggccaccattacacctagatctccctccgtcgaggtgaagctgcctgattacggagaactcaccctggactgcgagccccggagcggcatcgacttcaacgagatgatcctgatgaagatgaaaaagaaaacatggctcgtccataagcagtggtttctggatcttccgctgccttggaccgctggggccgacacgtctgaagtgcactggaattacaaagagagaatggttaccttcaaggtgccccatgccaaacgccaggatgtcacagtgctcggctcccaggaaggagctatgcacagcgcgctggccggcgctaccgaggttgactccggggatggaaaccacatgtttgccggccatcttaagtgtaaggtgcggatggaaaaactgagaattaaggggatgtcttatacaatgtgcagcggaaaattctccatcgacaaggagatggccgagacccaacacggcacgacagtcgtgaaagtgaagtacgaaggggctggcgccccttgtaaggttcccattgagatccgcgatgtcaataaagaaaaggtggtgggacgggtcattagctctacacccctcgcggagaacacaaactccgtgaccaatatcgagctggaacctccgttcggcgacagctatatcgttattggggtgggaaactctgctctgaccctccattggtttagaaaaggcagctccatcgggaagatgttcgagtctacataccgcggagccaaacggatggccattctgggcgaaacggcttgggattttgggagcgtcggcggacttttcacctccctgggcaaggccgtgcaccaggtttttgggagcgtgtatacaaccatgttcggaggcgtctcttggatgatccgcattctcatcgggtttctggtgctgtggatcggaacaaattcccgcaacaccagcatggctatgacgtgcattgccgttggcgggatcacacttttcctcggctttaccgtgcaggcggacatgggatgtgtcgtgtcttggtccggccgggagctgaagtgcgggagcggaattttcgtggtcgataatgttcatacctggacagaacaatacaaatttcagcccgagtcccctgccagactggcttctgccatcctcaacgctcacaaggacggcgtgtgtgggattcgcagcaccacacggctggagaatgtgatgtggaaacagatcacgaacgaacttaattatgtcctgtgggagggaggccacgacctcaccgtggttgccggcgatgtgaagggggtcctgacaaaaggaaagagagcgctgacaccccctgtgtccgaccttaagtactcttggaaaacatggggcaaggccaaaattttcacccccgaagctcggaacagcacgtttctcatcgatgggccggacacctccgagtgccctaatgaacgcagagcctggaacagcctggaggttgaggattacggattcggcatgttcacaaccaatatctggatgaagtttcgggaagggtcttccgaggtgtgtgaccatagactgatgagcgctgccattaaagatcagaaggccgtccacgctgacatgggatattggatcgaatcttccaaaaaccaaacatggcagattgagcgcgcgagcctcatcgaagtgaagacctgcctgtggcccaagacacataccctttggtctaatggcgttctggagagccagatgctcattcctaaatcctacgccggccccttcagccagcacaactatcggcaagggtacgctacgcagacagtgggaccttggcacctgggcaagctggagatcgattttggggaatgccccggaaccaccgtcacaatccaggaggactgtgatcatagaggcccgtctcttcgcaccacgacagcctccgggaaactcgtgacccagtggtgctgtagaagctgcacaatgcctcccctgcggttcctgggagaagacggctgttggtatggcatggagattcgccccctctccgagaaggaagagaacatggtgaaatctcaagtcaccgccgggcagggaacaagcgaaaccttttccatgggcctgctttgcctgacactcttcgttgaggaatgtctgagacggcgcgtgaccagaaagcacatgatcctggctgtggtcattacactttgcgccatcattctcgggggactgacctggatggatctgctccgggcgctgatcatgcttggcgacacaatgtctgggcgcatcggaggccagacccatctggctattatggccgtgtttaagatgagccctggctacgttctcggggtgttcctgagaaaactgacgtcccgggagacagcccttatggtcatcggaatggctatgaccacaaccctgtctattccgcacgacctcatggagctgatcgatggcattagcctcgggctgatccttctgaagatcgtgacccagtttgacaatacacaagttggaacgctcgccctgtccctgaccttcattcgcagcacaatgtctcttgtgatggcgtggagaaccatcatggctgtcctgtttgtggtcacactcattcccctgtgtcggacctcctgcctccagaaacagagccattgggtggaaatcacggccctgattcttggcgcccaagctctgcctgtttatctcatgacactgatgaagggggcctctagacgctcctggcccctgaacgagggaatcatggctgtgggccttgtcagcctgctcggctctgccctgctcaaaaatgatgtgcctctggcggggcccatggttgccggaggccttctgctggctgcctacgtgatgtccgggagctccgctgacctcagcctggaaaaggccgccaacgtccagtgggatgagatggctgacattaccggatctagccctatcatcgaagtgaagcaggatgaggacggctccttctctattcgggatgtggaggaaaccaatatgatcacacttctggttaaactcgcgctgattaccgtcagcgggctctaccccctggccatcccggtgacaatgacgctttggtatatgtggcaagtgaagacccaaagatccggagctctgtgggacgtcccttctcccgccgccacacagaaagctgccctgagcgagggcgtgtaccgcattatgcagcggggcctctttgggaagacccaggttggagtgggcatccacatggaaggggtcttccacacaatgtggcatgtgaccagaggatccgttatctgtcacgagacgggccgcctggaaccttcttgggcggatgtgcggaacgacatgattagctatgggggaggctggagacttggcgataaatgggacaaggaggaggacgtccaagtgctggctatcgaacccgggaagaatccgaaacatgttcagaccaagcctggactcttcaaaacactggccggcgagattggggccgtgaccctcgattttaagcccggaacatccggcagccctatcattaaccgcaaagggaaggtcatcggcctgtacggaaatggcgtggtgaccaaatctggggactatgtctccgctatcacacaggccgaacggattggagagcccgattacgaggttgacgaagatatcttcagaaagaagcggcttacgattatggacctgcaccccggcgcggggaaaaccaagcgcatcctgcctagcattgtgagagaggctctcaaacggcgcctgagaacacttatcctggccccgacccgggtggtcgccgctgaaatggaggaagccctcagaggactgcccattcgctatcagacccctgctgtgaagtctgagcatacaggccgggagatcgttgatctcatgtgccacgccacgtttaccacaagactgctttccagcacccgcgtgcccaactacaatctgatcgtcatggacgaagcgcacttcacagatccttcctctgtggccgctcgggggtacattagcaccagagttgagatgggcgaagccgctgccatctttatgacggccacaccccctggagctaccgacccgttcccccaatccaacagccctattgaggatatcgaacgcgagattcccgagcggtcttggaataccggctttgactggatcacagactatcaggggaaaaccgtgtggttcgtcccttccatcaaggcgggaaacgatattgccaattgcctgagaaagagcggcaaaaaggtgatccagctctctcgcaaaacatttgacaccgaataccccaagacgaaactgacagattgggacttcgtcgtgaccacagatattagcgagatgggggctaactttagagccggacgggttatcgacccgcgcagatgtcttaagcctgtgattctgaccgatggccccgaacgggtgatcctcgccgggcccatccctgtcacgcccgcttccgccgcgcaacgcagaggccggattggaagaaaccctgctcaggaggacgatcagtatgttttctctggcgacccgctgaagaatgatgaagaccatgcccactggaccgaggccaaaatgctgctcgataacatctacacacccgaggggattatccctacccttttcggacccgaacgcgagaagacacaggctattgacggcgaatttcggctgagaggggagcaacgcaaaaccttcgtggagctgatgcggagaggagacctccctgtgtggctgagctataaggtcgcctccgcgggcatctcttacaaagatcgggaatggtgctttacaggcgagcgcaataaccagattcttgaagagaatatggaagtggagatctggaccagagagggggaaaagaagaaactgcggccccgctggctcgacgccagagtttatgctgatccgatggccctgaaggacttcaaagagtttgctagcggacggaagtccatcacgctggatattctcacagaaatcgccagccttcctacctacctgtcttcccgcgctaaactggccctcgacaacattgtgatgctgcataccacagagagaggcgggcgggcgtaccagcacgcccttaatgaactgcccgagagcctcgagaccctgatgctggtcgctctccttggagccatgacagctggcatcttcctgtttttcatgcaggggaagggaattggcaagctgtccatgggcctcatcacgatcgccgtggcctctgggctgctttgggtcgctgaaattcaacctcagtggatcgcggccagcattatcctggagtttttcctcatggtgctgctgattcccgaacctgagaaacagcgcacaccccaggataaccaactcatctatgttatccttacaattctgaccatcattggactgatcgctgccaatgaaatgggcctcattgagaagacaaaaaccgactttgggttctaccaggtgaagacggagaccacaatcctggatgtcgaccttagaccggcctccgcttggaccctgtatgccgtggcgacaaccattctcacgcctatgctgcggcacacaatcgaaaacacctctgccaatctgagcctcgctgccatcgctaaccaggccgcggttcttatgggactgggcaaagggtggcccctgcatagaatggatctcggagtgcccctgcttgccatgggctgttactcccaggtcaatcctacaaccctgaccgctagcctcgtgatgctgctggtgcactatgccattatcggcccggggctccaagctaaggccacacgcgaggctcagaaacggacggccgcgggaattatgaagaaccccaccgttgacggcatcacagtcattgatcttgaacctatctcttacgaccccaagtttgagaaacagctggggcaagtgatgctgctcgtgctgtgcgccggacagcttctgctcatgagaaccacatgggctttctgtgaggtcctgaccctggccacgggccctatcctcacactttgggaagggaatcccggacgcttctggaacaccaccattgctgtttccacagccaacatctttcggggcagctatctggccggcgcggggctggctttctctctcattaagaatgcccagacccctagacgcggaacaggcacgaccggggagacactgggagaaaaatggaagcggcagcttaactccctggacagaaaagagtttgaagagtacaagcgcagcggcatcctcgaggtggatcggaccgaagctaagtctgccctgaaagacgggagcaagattaaacatgccgtgtccagaggatctagcaagatccgctggatcgtcgagcggggcatggtgaaaccgaagggcaagattgttgatctggggtgcggaagaggcgggtggtcctactatatggctacactcaaaaatgtgaccgaagtcaagggatacacgaaaggcgggcccggacacgaggaacctatccccatggccacctatggctggaaccttgtgaagctgcatagcggcgttgacgtgttctacaaacctacagagcaagtcgataccctgctctgtgacattggggagtcctctagcaatcccacaatcgaagagggacgcaccctgagagtgcttaagatggtggaaccgtggctgtcctctaagcctgagttttgcattaaagtcctcaacccctatatgcccacagttatcgaagaactggagaagctgcagcggaaacacggcgggaatctcgtgcgctgtcctcttagcagaaactccacccacgaaatgtactgggtgtctggagcgagcggcaatattgtctccagcgtgaacacgacatctaagatgctgctgaatcggttcaccaccagacatcggaaacccacatatgagaaggatgttgacctcggggccggaacgcgctccgtgagcaccgaaacagagaaacctgatatgaccatcatcggcagacggctgcagcgccttcaggaggaacacaaggagacatggcattacgaccaagaaaacccgtacagaacctgggcttatcacggctcttacgaggccccctccacagggagcgcttcttccatggtcaatggagtggttaagctgctcaccaaaccttgggatgtgattcccatggtcacgcagctggccatgaccgacacaaccccttttggccagcagcgggtgttcaaggaaaaagttgacacacgcacaccccagccgaagcctgggacgagaatggtgatgacaaccacagcgaactggctgtgggccctcctgggcaaaaagaagaatccccggctttgcacccgcgaggagtttatcagcaaagtcagatccaacgctgccattggcgctgtgttccaggaagaacaggggtggacgagcgcctctgaagctgtcaatgatagccggttttgggagctggtggacaaggaacgcgccctccaccaagagggcaaatgtgagtcctgcgtttataacatgatgggaaagagagagaaaaagctgggcgagttcgggcgggcgaagggatctcgcgccatctggtacatgtggcttggcgctagatttctggagttcgaggccctcgggttcctgaacgaagatcattggtttggacgggagaatagctggtccggcgtggagggggaaggcctgcacagactcggatatattctggaggaaatcgacaaaaaggatggcgaccttatgtacgctgatgacaccgccgggtgggatacacgcatcaccgaggacgatctgcagaacgaggaactcattacagagcagatggcccctcatcacaaaatcctggcgaaggctattttcaaacttacctatcagaataaggtcgtgaaggtgctgcggcccacacctagaggagccgttatggacatcatttctcgcaaagatcaacggggcagcggacaggtgggaacctacggcctcaacacgtttacaaatatggaagtccagctgatcagacagatggaggccgaaggggtgatcacccaagacgacatgcagaaccccaagggcctgaaagagcgcgttgagaagtggctccgggaatgcggagtggatagactgaaacgcatggctatttccggcgacgattgtgtcgtgaagccgcttgacgagcggttcgggacctctctgctctttctgaatgatatgggaaaagtcagaaaggacatccctcagtgggaacccagcaagggctggaaaaactggcaggaggtgcccttctgctcccatcactttcacaagattttcatgaaagatgggcgcagccttgttgtgccttgtcggaatcaagacgaactgatcggcagagcccggatttctcagggagctgggtggtccctcagagagacagcctgcctgggcaaggcgtacgcccagatgtggagcctgatgtattttcatcgccgggatctcagactggcttctatggccatctgttccgctgtcccgaccgagtggcttcccacaagccgcacgacctggtccatccacgcccatcaccagtggatgacaaccgaagacatgctgaaagtgtggaacagagtttggattgaggataatcctaacatgatcgacaagacacccgtgcactcttgggaagacattccttacctcggaaagcgggaggatctgtggtgcggcagccttatcgggctgtccagccgcgcgacctgggccaaaaatattcatacggctatcacccaagtcagaaacctcattggaaaggaagagtatgtggactacatgcccgtgatgaaacggtattctgccccttccgagagcgaaggcgttctgtga

SEQ ID NO: 20999 - RNA, 9867 nt, synthetic construct
  misc_feature 1..9867: note = derived and/or modified CDS sequence (opt5) from DENV-4__JN819409__SS-prME
  source 1..9867: mol_type = other RNA
agcaccatcacactgctctgcctgattcccacggtgatggccttccacctttccaccagagacggcgagcctctgatgatcgtcgctaagcatgaacgggggcgcccgctcctgtttaaaacaaccgagggaattaacaagtgtacacttatcgccatggatctgggcgaaatgtgcgaggacaccgttacatacaaatgtcccctcctggtgaataccgaacctgaggatattgactgctggtgtaacctgacggcgacctgggtgatgtatgggacatgcacccagtctggagagagacggcgcgaaaagagaagcgtcgctctcacaccccactccggcatggggctggagacccgggccgaaacgtggatgtctagcgagggagcctggaaacatgctcaacgcgtggagtcctggatccttagaaatcctggcttcgccctgctcgctggctttatggcctacatgatcgggcagacaggaattcagcggaccgttttctttgtgctgatgatgcttgtcgcgccctcttatggcatgcgctgtgtgggggttggaaacagagatttcgtggaaggcgtcagcgggggagcctgggtggacctggtgctcgagcacggcggctgcgtcacaaccatggctcaggggaagcctaccctggattttgaactgacaaagacgaccgccaaagaggttgctctcctgcggacatactgtatcgaagcccttatttccaatatcaccacagcgacccgctgcccgacgcaaggagagccctatctgaaggaggaacaggaccagcagtacatttgtagacgggatgtggtggaccgcggctgggggaacggatgcggcctcttcgggaaaggaggcgtcgtgacatgcgccaagtttagctgttctggcaaaatcaccgggaatctggttcaaattgagaaccttgaatataccgtggtcgtgacagttcataatggagatacccacgctgtgggcaacgacacatccaatcacggggtcacggccaccatcacacctagaagcccctctgtggaggtcaagctgcctgattacggagaactcaccctggactgcgagccccggtccggcatcgacttcaacgagatgattctgatgaagatgaaaaagaaaacatggctcgtgcataagcagtggtttctggatcttccgctgccttggaccgctggggccgacacgagcgaagttcactggaattacaaagagagaatggtgaccttcaaggtcccccatgccaaacgccaggatgtgacagttctcggctctcaggaaggagctatgcactccgcgctggccggcgctaccgaggtggacagcggggatggaaaccacatgtttgccggccatcttaagtgtaaggtccggatggaaaaactgagaatcaaggggatgtcctatacaatgtgctctggaaaattcagcattgacaaggagatggccgagacccaacacggcacgacagtggtgaaagttaagtacgaaggggctggcgccccttgtaaggtccccatcgagattcgcgatgtgaataaagaaaaggtggtcggacgggtgatctccagcacccccctcgcggagaacacaaacggcgttaccaatatcgagctggaacctccgttcggggactcttatattgtgatcggagtcggcaactccgctctgaccctccattggtttagaaaagggagctctattggaaagatgttcgagagcacataccgcggcgccaaacggatggccatcctgggggaaacggcttgggattttggctccgtgggaggccttttcacctctctggggaaggccgttcaccaggtgtttggaagcgtctatacaaccatgttcggcggggtgtcctggatgattagaatcctcatcggatttctggttctgtggattggcacaaatagccgcaacacctctatggctatgacgtgcatcgccgtggggggcattacacttttcctcggatttaccgtccaggcggacatgggctgtgtggtgtcctggagcgggcgggagctgaagtgcggatctggcatcttcgtcgttgataatgtgcatacctggacagaacaatacaaatttcagcccgagtcccctgccagactggctagcgccattctcaacgctcacaaggacggggtgtgtggaatccgctccaccacacggctggagaatgtcatgtggaaacagattacgaacgaacttaattatgtgctgtgggagggcggccacgacctcaccgttgtggccggggatgtcaagggagtgctgacaaaaggcaagagagcgctgaccccccctgtttctgaccttaagtacagctggaaaacatgggggaaggccaaaatcttcacccccgaagctcggaactccacgtttctcatcgatggaccggacacctctgagtgccctaatgaacgcagagcctggaacagcctggaggtggaggattacggcttcgggatgttcacaaccaatatttggatgaagtttcgggaaggatccagcgaggtctgtgaccatagactgatgtctgctgccatcaaagatcagaaggccgtgcacgctgacatgggctattggattgaatccagcaaaaaccaaacatggcagatcgagcgcgcgtctctcattgaagttaagacctgcctgtggcccaagacacataccctttggtccaatggcgtgctggagagccagatgctcatccctaaatcttacgccgggcccttcagccagcacaactatcggcaaggatacgctacgcagacagtcggcccttggcacctggggaagctggagatcgattttggagaatgccccggcaccaccgtgacaattcaggaggactgtgatcatagagggccgtcccttcgcaccacgacagccagcggaaaactcgtgacccagtggtgctgtagatcttgcacaatgcctcccctgcggttcctgggcgaagacggctgttggtatgggatggagatccgccccctctccgagaaggaagagaacatggtcaaaagccaagttaccgccggacagggcacatccgaaaccttttctatggggctgctttgcctgacgctcttcgtggaggaatgtctgagacggcgcgtgaccagaaagcacatgattctggctgtcatcattacactttgcgccatcatcctcggaggcctgacctggatggatctgctccgggcgctgattatgcttggggacacaatgagcggacgcatcggcggccagacccatctggctattatggccgtgtttaagatgtcccctgggtacgttctcggagtgttcctgagaaaactgacgtctcgggagacagcccttatggtcatcggcatggctatgaccacaaccctgagcattccgcacgacctcatggagctgatcgatgggatctccctcggactgattcttctgaagatcgtgacccagtttgacaatacacaagttggcacgctcgccctgtctctgaccttcattcgcagcacaatgtcccttgtgatggcgtggagaaccatcatggctgtcctgtttgtggtcacactcattcccctgtgtcggaccagctgcctccagaaacagtctcattgggtggaaatcacggccctgattcttggggcccaagctctgcctgtttatctcatgacactgatgaagggagcctccagacgcagctggcccctgaacgagggcatcatggctgtgggccttgtctctctgctcgggtccgccctgctcaaaaatgatgtgcctctggcgggacccatggttgccggcgggcttctgctggctgcctacgtgatgagcggatcttccgctgacctcagcctggaaaaggccgccaacgtccagtgggatgagatggctgacatcaccggctccagccctattatcgaagtgaagcaggatgaggacgggtctttcagcattcgggatgtggaggaaaccaatatgatcacacttctggttaaactcgcgctgattaccgtctccggactctaccccctggccatcccggtgacaatgacgctttggtatatgtggcaggtgaagacccaaagatctggcgctctgtgggacgtccctagccccgccgccacacagaaagctgccctgtccgagggcgtgtaccgcatcatgcagcgggggctctttggaaagacccaggttggcgtggggattcacatggaaggagtcttccacacaatgtggcatgtgaccagaggctctgttatctgtcacgagacggggcgcctggaacctagctgggcggatgtgcggaacgacatgatttcctatggaggcggctggagacttggggataaatgggacaaggaggaggacgtccaagtgctggctatcgaacccggaaagaatccgaaacatgttcagaccaagcctggcctcttcaaaacactgaccggggagattggagccgtgacactcgattttaagcccggcacctctgggagccctatcatcaaccgcaaaggcaaggtcattggactgtacggcaatggggtggtgacaaaatccggagactatgtcagcgccatcacgcaggctgaacggattggcgagcccgattacgaggttgacgaagatatcttcagaaagaagcggcttaccattatggacctgcaccccggggccggaaaaacaaagcgcatcctgccttctattgtgagagaggcgctcaaacggcgcctgagaacccttatcctggctccgacccgggtggtcgccgccgaaatggaggaagctctcagaggcctgcccatccgctatcagacacctgccgtgaagtccgagcatacggggcgggagattgttgatctcatgtgccacgctacctttacaaccagactgcttagctctacacgcgtgcccaactacaatctgatcgtcatggacgaagcccacttcaccgatccttccagcgtggcggcccggggctacatttccacgagagttgagatgggagaagctgccgctatctttatgacagccaccccccctggcgccaccgacccgttcccccaatctaacagccctattgaggatatcgaacgcgagatccccgagcggtcctggaatacagggtttgactggattaccgactatcagggaaaaacagtgtggttcgtccctagcatcaaggctggcaacgatattgcgaattgcctgagaaagtctgggaaaaaggtgatccagctctcccgcaaaacctttgacacggaataccccaagacaaaactgaccgattgggacttcgtcgtgacaaccgatattagcgagatgggagccaactttagagctggccgggttatcgacccgcgcagatgtcttaagcctgtgatcctgacggatgggcccgaacgggtgattctcgccggccccatccctgtcacccccgcctctgctgcccaacgcagaggacggattggcagaaaccctgcgcaggaggacgatcagtatgttttcagcggggacccgctgaagaatgatgaagaccatgctcactggacagaggccaaaatgctgctcgataacatctacacccccgagggaattatccctacacttttcggccccgaacgcgagaagacccaggccattgacggggaatttcggctgagaggagagcaacgcaaaacattcgtggagctgatgcggagaggcgacctccctgtgtggctgtcctataaggtcgcttctgccggcatcagctacaaagatcgggaatggtgctttaccggggagcgcaataaccagatccttgaagagaatatggaagtggagatttggacgagagagggagaaaagaagaaactgcggccccgctggctcgacgcgagagtttatgccgatccgatggctctgaaggacttcaaagagtttgcctccggccggaagtctatcacactggatattctcaccgaaatcgctagccttcctacctacctgtccagccgcgccaaactggctctcgacaacattgtgatgctgcatacaaccgagagagggggacgggcctaccagcacgcgcttaatgaactgcccgagtctctcgagacactgatgctggtcgccctccttggcgctatgacggccgggatcttcctgtttttcatgcagggaaagggcatcggcaagctgtccatggggctcattaccatcgctgtggccagcggactgctttgggtcgccgaaattcaacctcagtggatcgctgcgtccattatcctggagtttttcctcatggtgctgctgatccccgaacctgagaaacagcgcacaccccaggataaccaactcatttatgttatccttaccattctgacaatcattggcctgatcgccgctaatgaaatggggctcattgagaagaccaaaacggactttggattctaccaggtgaagaccgagacaaccatcctggatgtcgaccttagaccggcctctgcctggacactgtatgctgtggccaccacgatcctcacacctatgctgcggcacaccattgaaaacacaagcgcgaatctgtccctcgccgctatcgccaaccaggctgccgttcttatgggcctggggaaaggatggcccctgcatagaatggatctcggcgtgcccctgcttgcgatgggctgttactctcaggtcaatcctaccaccctgacagccagcctcgtgatgctgctggtgcactatgctattatcgggccgggactccaagccaaggctacgcgcgaggcccagaaacggaccgctgccggcattatgaagaaccccacagttgacgggatcaccgtcatcgatcttgaacctatttcctacgaccccaagtttgagaaacagctgggacaagtgatgctgctcgtgctgtgcgcgggccagcttctgctcatgagaacaacctgggccttctgtgaggtcctgacgctggctacagggcctatcctcaccctttgggaaggaaatcccggccgcttctggaacaccacaattgccgttagcaccgctaacatctttcggggctcttatctggccggggccggactggcgttctccctcattaagaatgctcagacacctagacgcggcacggggaccacaggagagaccctgggcgaaaaatggaagcggcagcttaacagcctggacagaaaagagtttgaagagtacaagcgctctgggatcctcgaggtggatcggacagaagccaagtccgctctgaaagacggaagcaagatcaaacatgccgtgtctagaggcagctccaagattcgctggatcgtcgagcggggcatggtgaaaccgaaggggaaggttgtggatctgggatgcggcagagggggatggtcttactatatggccaccctcaaaaatgtcacggaagtgaagggctacaccaaagggggacccggccacgaggaacctattcccatggctacatatggctggaaccttgttaagctgcatagcggggtggacgtcttctacaaacctaccgagcaagtggatacactgctctgtgacatcggagagtccagctccaatcccaccattgaagagggccgcacactgagagtgcttaagatggtcgaaccgtggctgtctagcaagcctgagttttgcatcaaagttctcaacccctatatgcccaccgtgattgaagagctggagaagctgcagcggaaacacgggggaaatctcgtgcgctgtcctctttccagaaactctacgcacgaaatgtactgggtcagcggcgcctccgggaatatcgtgtctagcgttaacacaacctccaagatgctgctgaatcggttcaccacaagacatcggaaacccacgtatgagaaggatgtggacctcggagcgggcacccgcagcgtctctacagaaaccgagaaacctgatatgacaatcattggcagacggctgcagcgccttcaggaggaacacaaggagacctggcattacgaccaagaaaacccgtacagaacatgggcctatcacgggtcctacgaggctcccagcaccggatctgcctccagcatggtgaatggcgttgtgaagctgctcacgaaaccttgggatgtcatccccatggtgacccagctggctatgacagacaccacaccttttgggcagcagcgggttttcaaggaaaaagtggacacccgcacgccccaaccgaagcctggaacaagaatggtcatgaccacaaccgccaactggctgtgggcgctcctgggcaaaaagaagaatccccggctttgcacgaaagaggagtttatttctaaggtgcgctccaacgccgctatcggggccgtcttccaggaagagcagggctggaccagcgcttccgaagccgtgaatgatagcagattttgggagctggttgacaaagaacgggctctccaccaagagggaaagtgtgagtcttgcgtgtataacatgatgggcaaacgcgaaaagaagctgggggagttcggaagagccaaaggcagccgggcgatttggtacatgtggcttggggcccgctttctggaattcgaggctctcggattcctgaacgaagatcattggtttggcagagagaattcctggtctggggtcgagggcgaaggactgcaccggctcggctatatcctggaggaaatcgacaagaaagatggggaccttatgtacgccgatgacacagctggatgggataccagaattacagaggacgatctgcagaacgaggaactcatcaccgagcagatggcccctcatcacaagattctggccaaagcgatcttcaagcttacatatcagaataaggtggtgaaagttctgcgccccacccctcggggcgctgtgatggacattatcagcagaaaggatcaacgcgggtccggacaggtcggcacgtacgggctcaacacatttaccaatatggaagtgcagctgatccggcagatggaggccgaaggcgttattacccaagacgacatgcagaaccccaaaggactgaaggagagagtggagaaatggctccgcgaatgcggcgtcgatcggctgaagagaatggccatctctggggacgattgtgtggtcaaaccgcttgacgagcgcttcggaacaagcctgctctttctgaatgatatgggcaaggtgcggaaggacattcctcagtgggaaccctccaaagggtggaagaactggcaggaggttcccttctgctctcatcactttcacaaaatcttcatgaaggatggaagaagccttgtggtcccttgtcgcaatcaagacgaactgattggccgggctagaatctcccagggggccggctggagcctccgggagaccgcttgcctgggaaaagcctacgcgcagatgtggtctctgatgtattttcatagacgcgatctccggctggcctccatggctatctgtagcgccgtgccgacagagtggttccccacgtctagaaccacatggtccattcacgctcatcaccagtggatgaccacagaagacatgcttaaggtttggaaccgcgtgtggatcgaggataatcctaacatgaccgacaagacgcccattcacagctgggaagacatcccttacctgggcaaaagagaggatctctggtgcgggtccctgattggactttctagccgggccacctgggcgaagaatatccatacagccattacccaagtccgcaacctgatcggcaaagaagagtatgtggactacatgcccgtgatgaagagatattccgctcctagcgagtctgaaggggttctctga

SEQ ID NO: 21000 - RNA, 9867 nt, synthetic construct
  misc_feature 1..9867: note = derived and/or modified CDS sequence (opt5) from DENV-4__FJ639742__SS-prME
  source 1..9867: mol_type = other RNA
agcaccatgacgctgctctgcctgatccccacggccatggctttccacctttccacccgggacggagagcctctgatgattgtggccaagcatgaacgggggcgcccgctcctgtttaaaaccaccgaggggatcaacaagtgtacccttattgcgatggatctgggcgaaatgtgcgaggacaccgtcacatacaaatgtcccctcctggttaataccgaacctgaggatatcgactgctggtgtaacctgacgtctacctgggtgatgtatgggacatgcacccagagcggagagagacggcgcgaaaagagatccgtggctctcacaccccactctggcatggggctggagacccgggccgaaacgtggatgagctccgagggagcctggaaacatgctcaacgcgtcgagtcttggattcttagaaatcctggcttcgccctgctcgctggctttatggcctacatggtggggcagacaggaatccagcggaccgttttctttgtgctgatgatgcttgtcgcgcccagctatggcatgcgctgtgtgggggttggaaacagagatttcgtggaaggcgtctccgggggagcctgggtggacctggtgctcgagcacggcggctgcgtcacaaccatggctcaggggaagcctaccctggattttgaactgacaaagacgaccgccaaagaggttgctctcctgcggacatactgtatcgaagcccttattagcaatatcaccacagcgacccgctgcccgacgcaaggagagccctatctgaaggaggaacaggaccagcagtacatttgtagacgggatgtggtggaccgcggctgggggaacggatgcggcctcttcgggaaaggaggcgtcgtgacatgcgccaagttttcttgttccggcaaaatcaccgggaatctggttcaaattgagaaccttgaatataccgtggtcgtgacagttcataatggagatacccacgctgtgggcaacgacacaagcaatcacggggtcacggccaccatcacacctagatctccctccgtggaggtcaagctgcctgattacggagaactcaccctggactgcgagccccggagcggcattgacttcaacgagatgatcctgatgaagatgaaaaagaaaacatggctcgtgcataagcagtggtttctggatcttccgctgccttggaccgctggggccgacacgtctgaagttcactggaattacaaagagagaatggtgaccttcaaggtcccccatgccaaacgccaggatgtgacagttctcggctcccaggaaggagctatgcacagcgcgctggccggcgctaccgaggtggactccggggatggaaaccacatgtttgccggccatcttaagtgtaaggtccggatggaaaaactgagaatcaaggggatgtcttatacaatgtgcagcggaaaattctccattgacaaggagatggccgagacccaacacggcacgacagtggtgaaagttaagtacgaaggggctggcgccccttgtaaggtccccatcgagattcgcgatgtgaataaagaaaaggtggtcggacgggtgatcagctctacacccctcgcggagaacacaaactccgttaccaatattgagctggaacctccgttcggcgacagctatatcgtgatcggggtcggaaactctgctctgaccctccattggtttagaaaaggcagctccattgggaagatgttcgagtctacataccgcggagccaaacggatggccatcctgggcgaaacggcttgggattttgggagcgtgggcggacttttcacctccctgggcaaggccgttcaccaggtgtttgggagcgtctatacaaccatgttcggaggcgtgtcttggatgattagaatcctcattgggtttctggttctgtggatcggaacaaattcccgcaacaccagcatggctatgacgtgcatcgccgtgggcgggattacacttttcctcggctttaccgtccaggcggacatgggatgtgtggtgtcttggtccggccgggagctgaagtgcgggagcggaatcttcgtcgttgataatgtgcatacctggacagaacaatacaaatttcagcccgagtcccctgccagactggcttctgccattctcaacgctcacaaggacggcgtgtgtgggatccgcagcaccacacggctggagaatgtcatgtggaaacagattacgaacgaacttaattatgtgctgtgggagggaggccacgacctcaccgttgtggccggcgatgtcaagggggtgctgacaaaaggaaagagagcgctgacaccccctgtttccgaccttaagtactcttggaaaacatggggcaaggccaaaatcttcacccccgaagctcggaacagcacgtttctcattgatgggccggacacctccgagtgccctaatgaacgcagagcctggaacagcctggaggtggaggattacggattcggcatgttcacaaccaatatctggatgaagtttcgggaagggtcttccgaggtctgtgaccatagactgatgagcgctgccatcaaagatcagaaggccgtgcacgctgacatgggatattggattgaatcttccaaaaaccaaacatggcagatcgagcgcgcgagcctcattgaagttaagacctgcctgtggcccaagacacataccctttggtctaatggcgtgctggagagccagatgctcatccctaaatcctacgccggccccttcagccagcacaactatcggcaagggtacgctacgcagacagtcggaccttggcacctgggcaagctggagattgattttggggaatgccccggaaccaccgtgacaatccaggaggactgtgatcatagaggcccgtctcttcgcaccacgacagcctccgggaaactcgtgacccagtggtgctgtagaagctgcacaatgcctcccctgcggttcctgggagaagacggctgttggtatggcatggagatccgccccctctccgagaaggaagagaacatggtcaaatctcaagttaccgccgggcagggaacaagcgaaaccttttccatgggcctgctttgcctgacactcttcgtggaggaatgtctgagacggcgcgtgaccagaaagcacatgattctggctgtcgtgatcacactttgcgccattatcctcgggggactgacctggatggatctgctccgggcgctgattatgcttggcgacacaatgtctgggcgcatcggaggccagacccatctggctatcatggccgtttttaagatgagccctggctacgtgctcggggtcttcctgagaaaactgacgtcccgggagacagcccttatggtgattggaatggctatgaccacaaccctgtctatcccgcacgacctcatggagctgattgatggcatcagcctcgggctgattcttctgaagatcgttacccagtttgacaatacacaagtgggaacgctcgccctgtccctgaccttcatccgcagcacaatgtctcttgtcatggcgtggagaaccattatggctgtgctgtttgtcgtgacactcatccccctgtgtcggacctcctgcctccagaaacagagccattgggttgaaattacggccctgatccttggcgcccaagctctgcctgtgtatctcatgacactgatgaagggggcctctagacgctcctggcccctgaacgagggaattatggctgtcggccttgtgagcctgctcggctctgccctgctcaaaaatgatgttcctctggcggggcccatggtggccggaggccttctgctggctgcctacgtcatgtccgggagctccgctgacctcagcctggaaaaggccgcctctgtgcagtgggatgagatggctgacatcaccggaagctcccctattatcgaagtgaagcaggatgaggacggctctttcagcatccgggatgttgaggaaaccaacatgattacacttctggtcaaactcgcgctgatcaccgtgtccgggctctaccccctggccattccggtgacaatgacgctttggtatatgtggcaggtcaagacccaaagatctggagctctgtgggacgtgcctagccccgccgccacacagaaagctgccctgtccgagggcgtttaccgcatcatgcagcggggcctctttgggaagacccaggtgggagtcggcattcacatggaaggggtgttccacacaatgtggcatgttaccagaggatctgtgatctgtcacgagacgggccgcctggaacctagctgggcggatgtccggaatgacatgatctcctatgggggaggctggagacttggcgataaatgggacaaggaggaggacgtgcaagttctggctattgaacccgggaagaacccgaaacatgtgcagaccaagcctggactcttcaaaacactgaccggcgagatcggggccgtcacactcgattttaagcccggaaccagcggctctcctattatcaatcgcaaagggaaggtgattggcctgtacggaaacggcgtggtcacaaaatccggggactatgttagcgccatcacgcaggctgaacggatcggagagcccgattacgaggtggacgaagatattttcagaaagaagcggcttaccatcatggacctgcaccccggcgccgggaaaacaaagcgcattctgccttctatcgtgagagaggcgctcaaacggcgcctgagaacccttattctggctccgacccgggtcgtggccgccgaaatggaggaagctctcagaggactgcccatccgctatcagacccctgccgttaagtccgagcatacgggccgggagattgtggatctcatgtgccacgctacctttacaaccagactgcttagctccacacgcgtccccaattacaacctgatcgtgatggacgaagcccacttcaccgatccttctagcgttgcggcccgggggtacatctccacgagagtggagatgggcgaagctgccgctatttttatgacagccacaccccctggagccaccgacccgttcccccaaagcaattctcctatcgaggatattgaacgcgagatccccgagcggtcctggaacacaggctttgactggattaccgactatcaggggaaaacagtctggttcgtgcctagcatcaaggctggaaatgatatcgcgaactgcctgagaaagtctggcaaaaaggtcattcagctcagccgcaaaacctttgacacggaataccccaagacaaaactgaccgattgggacttcgtggttacaaccgatatctccgagatgggggccaattttagagctggacgggtgattgacccgcgcagatgtcttaagcctgtgatcctgacggatggccccgaacgggtcattctcgccgggcccatccctgttacccccgcctctgctgcccaacgcagaggccggatcggaagaaaccctgcgcaggaggacgatcagtatgtgttcagcggcgacccgctgaagaacgatgaagaccatgctcactggacagaggccaaaatgctgctcgataatatttacacccccgaggggatcattcctacacttttcggacccgaacgcgagaagacccaggccatcgacggcgaatttcggctgagaggggagcaacgcaaaacattcgtggagctgatgcggagaggagacctccctgtctggctgtcctataaggtggcttctgccggcattagctacaaagatcgggaatggtgctttaccggcgagcgcaacaatcagatccttgaagagaacatggaagttgagatttggacgagagagggggaaaagaagaaactgcggccccgctggctcgacgcgagagtgtatgccgatccgatggctctgaaggacttcaaagagtttgcctccggaagaaagagcatcacactggatatcctcaccgaaattgcttctcttcctacctacctgtccagccgcgccaaactggctctcgacaatatcgtcatgctgcatacaaccgagagaggcgggcgggcctaccagcacgcgcttaacgaactgcccgagtccctcgagacactgatgctggtggccctccttggagctatgacggccggcattttcctgtttttcatgcaggggaagggaatcggcaagctgtctatgggcctcattaccatcgctgtcgccagcgggctgctttgggtggccgaaatccaacctcagtggattgctgcgtccatcattctggagtttttcctcatggttctgctgatccccgaacctgagaaacagcgcacaccccaggataatcaactcatttatgtgatccttaccatcctgacaattatcggactgattgccgctaacgaaatgggcctcatcgagaagaccaaaacggactttgggttctaccaggtcaagaccgagacaaccattctggatgtggaccttagaccggcctctgcctggacactgtatgctgttgccaccacgatcctcacacctatgctgcggcacaccattgaaaatacaagcgcgaacctgtccctcgccgctatcgccaatcaggctgccgtgcttatgggactgggcaaagggtggcccctgcatagaatggatctcggagtccccctgcttgcgatgggctgttacagccaggtgaaccctaccaccctgacagcctctctcgtgatgctgctggttcactatgctatcattggcccggggctccaagccaaggctacgcgcgaggcccagaaacggaccgctgccggaatcatgaagaatcccacagtcgacggcattaccgtgatcgatcttgaacctatttcctacgaccccaagtttgagaaacagctggggcaagtgatgctgctcgtcctgtgcgcgggacagcttctgctcatgagaacaacctgggccttctgtgaggttctgacgctggctacaggccctatcctcaccctttgggaagggaaccccggacgcttctggaataccacaatcgccgtgagcaccgctaacatttttcggggctcttatctggccggcgccgggctggcgttctccctcatcaagaacgctcagacacctagacgcggaacgggcaccacaggggagaccctgggagaaaaatggaagcggcagcttaatagcctggacagaaaagagtttgaagagtacaagcgctctggcattctcgaggtggatcggacagaagccaagagcgctctgaaagacgggtccaagatcaaacatgccgtctctagaggaagctccaagattcgctggatcgtggagcggggcatggttaaaccgaagggcaaggtggtcgatctggggtgcggaagaggcgggtggagctactatatggccaccctcaaaaacgtgacggaagttaagggatacaccaaaggcgggcccggacacgaggaacctatccccatggctacatatggctggaatcttgtgaagctgcattccggcgtcgacgtgttctacaaacctaccgagcaagtggatacactgctctgtgacattggggagtctagctccaaccccaccatcgaagagggacgcacactgagagtccttaagatggttgaaccgtggctgtctagcaagcctgagttttgcattaaagtgctcaatccctatatgcccaccgtgatcgaagaactggagaagctgcagcggaaacacggcgggaacctcgtccgctgtcctctttccagaaattctacgcacgaaatgtactgggtgagcggagcctccggcaacattgttagctctgtgaatacaacctccaagatgctgctgaaccggttcaccacaagacatcggaaacccacgtatgagaaggatgtcgacctcggggcgggaacccgcagcgtgtctacagaaaccgagaaacctgatatgacaatcattggcagacggctgcagcgccttcaggaggaacacaaggagacctggcattacgaccaagaaaatccgtacagaacatgggcctatcacggctcctacgaggctcccagcaccgggtctgcctccagcatggttaacggagtggtcaagctgctcacgaaaccttgggatgtgatccccatggttacccagctggctatgacagacaccacaccttttggccagcagcgggtgttcaaggaaaaagtcgacacccgcacgccccaaccgaagcctgggacaagaatggtgatgaccacaaccgccaattggctgtgggcgctcctgggcaaaaagaagaacccccggctttgcacgcgcgaggagtttatctccaaagtcagaagcaatgccgctattggcgccgtgttccaggaagaacaggggtggacctctgctagcgaagccgttaacgattcccggttttgggagctggtggacaaggaacgcgctctccaccaagagggcaaatgtgagtcttgcgtctataatatgatgggaaagagagagaaaaagctgggcgagttcgggcgggccaagggaagccgcgcgatctggtacatgtggcttggcgccagatttctggagttcgaggctctcgggttcctgaacgaagatcattggtttggacgggagaactcctggtctggcgtggagggggaaggcctgcacagactcggatatattctggaggaaatcgacaaaaaggatggcgaccttatgtacgccgatgacacagctgggtgggatacccgcattacagaggacgatctgcagaatgaggaactcatcaccgagcagatggcccctcatcacaaaatcctggccaaggcgattttcaaacttacatatcagaacaaggtggttaaggtgctgcggcccacccctagaggagctgtcatggacatcattagccgcaaagatcaacggggctccggacaggtgggaacgtacggcctcaatacatttaccaacatggaagttcagctgatcagacagatggaggccgaaggggtgattacccaagacgacatgcagaatcccaagggcctgaaagagcgcgtcgagaagtggctccgggaatgcggagtggatagactgaaacgcatggccatctctggcgacgattgtgtcgtgaagccgcttgacgagcggttcgggacaagcctgctctttctgaacgatatgggaaaagttagaaaggacatccctcagtgggaaccctccaagggctggaaaaattggcaggaggtgcccttctgcagccatcactttcacaagattttcatgaaagatgggcgctctcttgtcgtgccttgtcggaaccaagacgaactgatcggcagagctcggatttcccagggagccgggtggagcctcagagagaccgcttgcctgggcaaggcctacgcgcagatgtggtctctgatgtattttcatcgccgggatctcagactggcctccatggctatctgtagcgccgttccgacagagtggttccccacgtcccgcaccacatggtctattcacgctcatcaccagtggatgaccacagaagacatgcttaaagtgtggaatagagtctggatcgaggataaccctaatatgatcgacaagacccccgtgcacagctgggaagacattccttacctgggaaagcgggaggatctctggtgcggctccctgatcgggcttagctctcgcgccacgtgggcgaaaaacattcataccgccatcacacaagtgagaaatctgattggaaaggaagagtatgttgactacatgcccgtcatgaaacggtattccgctcctagcgagtctgaaggcgtgctctga

SEQ ID NO: 21001 - RNA, 9867 nt, synthetic construct
  misc_feature 1..9867: note = derived and/or modified CDS sequence (opt5) from DENV-4__FJ639745__SS-prME
  source 1..9867: mol_type = other RNA
agcaccatgacactgctctgcctgatccccacggccatggctttccacctttccaccagagacggcgagcctctgatgattgtggccaagcatgaacgggggcgcccgctcctgtttaaaacaaccgagggaatcaacaagtgtacacttattgcgatggatctgggcgaaatgtgcgaggacaccgtcacatacaaatgtcccctcctggttaataccgaacctgaggatatcgactgctggtgtaacctgacgtctacctgggtgatgtatgggacatgcacccagagcggagagagacggcgcgaaaagagatccgtggctctcacaccccactctggcatggggctggagacccgggccgaaacgtggatgagctccgagggagcctggaaacatgctcaacgcgtcgagtcttggattcttagaaatcctggcttcgccctgctcgctggctttatggcctacatgatcgggcagacaggaatccagcggaccgtgttctttgttctgatgatgcttgtggcgcccagctatggcatgcgctgtgtcggggtgggaaacagagatttcgttgaaggcgtgtccgggggagcctgggtcgacctggtgctcgagcacggcggctgcgtgacaaccatggctcaggggaagcctaccctggattttgaactgacaaagacgaccgccaaagaggtcgctctcctgcggacatactgtattgaagcccttatcagcaatattaccacagcgacccgctgcccgacgcaaggagagccctatctgaaggaggaacaggaccagcagtacatctgtagacgggatgttgtggaccgcggctgggggaacggatgcggcctcttcgggaaaggaggcgtggtcacatgcgccaagttttcttgttccggcaaaattaccgggaatctggtgcaaatcgagaaccttgaatataccgttgtggtcacagtgcataatggagatacccacgctgttggcaacgacacaagcaatcacggggtgacggccaccattacacctagatctccctccgtcgaggtgaagctgcctgattacggagaactcaccctggactgcgagccccggagcggcatcgacttcaacgagatgatcctgatgaagatgaaaaagaaaacatggctcgtccataagcagtggtttctggatcttccgctgccttggaccgctggggccgacacgtctgaagtgcactggaattacaaagagagaatggttaccttcaaggtgccccatgccaaacgccaggatgtcacagtgctcggctcccaggaaggagctatgcacagcgcgctggccggcgctaccgaggttgactccggggatggaaaccacatgtttgccggccatcttaagtgtaaggtgcggatggaaaaactgagaattaaggggatgtcttatacaatgtgcagcggaaaattctccatcgacaaggagatggccgagacccaacacggcacgacagtcgtgaaagtgaagtacgaaggggctggcgccccttgtaaggttcccattgagatccgcgatgtcaataaagaaaaggtggtgggacgggtcattagctctacccccctcgcggagaacacaaactccgtgaccaatatcgagctggaacctccgttcggcgacagctatatcgttattggggtgggaaactctgctctgaccctccattggtttagaaaaggcagctccatcgggaagatgttcgagtctacataccgcggagccaaacggatggccattctgggcgaaacggcttgggattttgggagcgtcggcggacttttcacctccctgggcaaggccgtgcaccaggtttttgggagcgtgtatacaaccatgttcggaggcgtctcttggatgatcagaattctcatcgggctgctggtgctttggatcggaacaaattcccgcaacaccagcatggctatgacgtgcattgccgttggcgggatcacactctttctgggcttcaccgtgcaggcggacatgggatgtgtcgtgtcttggtccggccgggagctgaagtgcgggagcggaatttttgtggtcgataatgttcatacctggacagaacaatacaaattccagcccgagtcccctgccagactcgcttctgccatcctgaacgctcacaaggacggcgtgtgtgggattcgcagcaccacacggcttgagaatgtgatgtggaaacagatcacgaacgaactgaattatgtcctctgggagggaggccacgacctgaccgtggttgccggcgatgtgaagggggtcctgacaaaaggaaagagagcgcttaccccccctgtgtccgacctcaagtactcttggaaaacatggggcaaggccaaaatttttacccccgaagctcggaacagcacgttcctgatcgatgggccggacacctccgagtgccctaatgaacgcagagcctggaacagcctggaggttgaggattacggatttggcatgttcacaaccaatatctggatgaagttccgggaagggtcttccgaggtgtgtgaccatagactcatgagcgctgccattaaagatcagaaggccgtccacgctgacatgggatattggatcgaatcttccaaaaaccaaacatggcagattgagcgcgcgagcctgatcgaagtgaagacctgcctttggcccaagacacataccctgtggtctaatggcgttctcgagagccagatgctgattcctaaatcctacgccggcccctttagccagcacaactatcggcaagggtacgctacgcagacagtgggaccttggcacctgggcaagcttgagatcgatttcggggaatgccccggaaccaccgtcacaatccaggaggactgtgatcatagaggcccgtctctccgcaccacgacagcctccgggaaactggtgacccagtggtgctgtagaagctgcacaatgcctcccctgcggtttctcggagaagacggctgttggtatggcatggagattcgccccctgtccgagaaggaagagaacatggtgaaatctcaagtcaccgccgggcagggaacaagcgaaaccttctccatgggccttctgtgcctcacgctgtttgttgaggaatgtctgagacggcgcgtgaccagaaagcacatgatccttgctgtggtcattacactctgcgccatcattctggggggactgacctggatggatctcctgcgggcgcttatcatgctgggcgacacaatgtctgggcgcatcggaggccagacccatctcgctattatggccgtgttcaagatgagccctggctacgttctgggggtgtttctgagaaaacttacgtcccgggagacagccctgatggtcatcggaatggctatgaccacaaccctctctattccgcacgacctgatggagctcatcgatggcattagcctggggcttatcctgctcaagatcgtgacccagttcgacaatacacaagttggaacgctggccctgtcccttacctttattcgcagcacaatgtctctggtgatggcgtggagaaccatcatggctgtcctcttcgtggtcacactgattcccctctgtcggacctcctgcctgcagaaacagagccattgggtggaaatcacggcccttattctgggcgcccaagctctccctgtttatctgatgacactgatgaagggggcctctagacgctcctggccccttaacgagggaatcatggctgtgggcctggtcagcctcctgggctctgccctcctgaaaaatgatgtgcctcttgcggggcccatggttgccggaggcctgctgctcgctgcctacgtgatgtccgggagctccgctgacctgagccttgaaaaggccgccaacgtccagtgggatgagatggctgacattaccggatctagccctatcatcgaagtgaagcaggatgaggacggctccttttctattcgggatgtggaggaaaccaatatgatcacactgctcgttaaactggcgctcattaccgtcagcgggctgtacccccttgccatcccggtgacaatgacgctgtggtatatgtggcaggtgaagacccaaagatccggagctctgtgggacgtcccttctcccgccgccacacagaaagctgccctcagcgagggcgtgtaccgcattatgcagcggggcctgttcgggaagacccaggttggagtgggcatccacatggaaggggtctttcacacaatgtggcatgtgaccagaggatccgttatctgtcacgagacgggccgccttgaaccttcttgggcggatgtgcggaacgacatgattagctatgggggaggctggagactgggcgataaatgggacaaggaggaggacgtccaagtgctcgctatcgaacccgggaagaatccgaaacatgttcagaccaagcctggactgttcaaaacactcaccggcgagattggggccgtgacactggatttcaagcccggaacctccggcagccctatcattaaccgcaaagggaaggtcatcggcctttacggaaatggcgtggtgacaaaatctggggactatgtctccgccatcacgcaggctgaacggattggagagcccgattacgaggttgacgaagatatctttagaaagaagcggctgaccattatggacctgcaccccggcgccgggaaaacaaagcgcatcctccctagcattgtgagagaggcgctgaaacggcgccttagaaccctgatcctcgctccgacccgggtggtcgccgccgaaatggaggaagctctgagaggactccccattcgctatcagacacctgccgtgaagtctgagcatacgggccgggagatcgttgatctgatgtgccacgctaccttcacaaccagacttctgtccagcacacgcgtgcccaactacaatctgatcgtcatggacgaagcccactttaccgatccttcctctgtggcggcccgggggtacattagcacgagagttgagatgggcgaagctgccgctatcttcatgacagccaccccccctggagccaccgacccgtttccccaatccaacagccctattgaggatatcgaacgcgagattcccgagcggtcttggaatacaggcttcgactggatcaccgactatcaggggaaaacagtgtggtttgtcccttccatcaaggctggaaacgatattgcgaattgcctcagaaagagcggcaaaaaggtgatccagctgtctcgcaaaaccttcgacacggaataccccaagacaaaacttaccgattgggactttgtcgtgacaaccgatattagcgagatgggggccaacttcagagctggacgggttatcgacccgcgcagatgtctgaagcctgtgattctcacggatggccccgaacgggtgatcctggccgggcccatccctgtcacccccgcctccgctgcccaacgcagaggccggattggaagaaaccctgcgcaggaggacgatcagtatgttttttctggcgacccgctgaagaatgatgaagaccatgctcactggacagaggccaaaatgctccttgataacatctacacccccgaggggattatccctacactgttcggacccgaacgcgagaagacccaggccattgacggcgaattccggctgagaggggagcaacgcaaaacatttgtggagctcatgcggagaggagacctgcctgtgtggcttagctataaggtcgcttccgccggcatctcttacaaagatcgggaatggtgcttcaccggcgagcgcaataaccagattctggaagagaatatggaagtggagatctggacgagagagggggaaaagaagaaactccggccccgctggctggacgcgagagtttatgccgatccgatggctctgaaggactttaaagagttcgccagcggacggaagtccatcacactcgatattcttaccgaaatcgctagcctgcctacctacctgtcttcccgcgccaaactcgctctggacaacattgtgatgcttcatacaaccgagagaggcgggcgggcctaccagcacgcgctgaatgaactccccgagagcctggagacactgatgctcgtcgcccttctgggagctatgacggccggcatctttctgttctttatgcaggggaagggaattggcaagctctccatgggcctgatcaccatcgctgtggcctctgggcttctgtgggtcgccgaaattcaacctcagtggatcgctgcgagcattatcctcgagttctttctgatggtgctgctcattcccgaacctgagaaacagcgcacaccccaggataaccaacttatctatgttatcctgaccattctgacaatcattggactcatcgccgctaatgaaatgggcctgattgagaagaccaaaacggacttcgggttttaccaggtgaagaccgagacaaccatccttgatgtcgacctgagaccggcctccgcctggacactctatgctgtggccaccacgattctgacacctatgctgcggcacaccatcgaaaacacatctgcgaatctcagccttgccgctatcgccaaccaggctgccgttctgatgggactgggcaaagggtggcccctccatagaatggatctgggagtgccccttctggcgatgggctgttactcccaggtcaatcctaccaccctcacagccagcctggtgatgctgctcgtgcactatgctattatcggcccggggcttcaagccaaggctacgcgcgaggcccagaaacggaccgctgccggaattatgaagaaccccacagttgacggcatcaccgtcattgatctggaacctatctcttacgaccccaagttcgagaaacagctggggcaagtgatgctcctggtgctttgcgcgggacagctgctcctgatgagaacaacctgggccttttgtgaggtcctgacgctcgctacaggccctatccttaccctgtgggaagggaatcccggacgcttctggaacaccacaattgccgtttccaccgctaacatcttccggggcagctatctggccggcgccgggctcgcgttttctctgattaagaatgctcagacacctagacgcggaacgggcaccacaggggagacccttggagaaaaatggaagcggcagctgaactccctcgacagaaaagagttcgaagagtacaagcgcagcggcatcctggaggtggatcggacagaagccaagtctgctctgaaagacgggagcaagattaaacatgccgtgtccagaggatctagcaagatccgctggatcgtcgagcggggcatggtgaaaccgaagggcaaggttgtggatctcgggtgcggaagaggcgggtggtcctactatatggccacccttaaaaatgtcacggaagtgaagggatacaccaaaggcgggcccggacacgaggaacctattcccatggctacatatggctggaacctggttaagctgcatagcggcgtggacgtcttttacaaacctaccgagcaagtggatacactcctgtgtgacatcggggagtcctctagcaatcccaccattgaagagggacgcacacttagagtgctgaagatggtcgaaccgtggctctcctctaagcctgagttctgcatcaaagttctgaacccctatatgcccaccgtgattgaagagctggagaagctccagcggaaacacggcgggaatcttgtgcgctgtcctctgagcagaaactccacgcacgaaatgtactgggtctctggagccagcggcaatatcgtgtccagcgttaacacaacctctaagatgctgctcaatcggtttaccacaagacatcggaaacccacgtatgagaaggatgtggacctgggggcgggaacccgctccgtcagcacagaaaccgagaaacctgatatgacaattatcggcagacggcttcagcgcctgcaggaggaacacaaggagacctggcattacgaccaagaaaacccgtacagaacatgggcctatcacggctcttacgaggctccctccaccgggagcgcctcttccatggtgaatggagttgtgaagctcctgacgaaaccttgggatgtcatccccatggtgacccagctggctatgacagacaccacacctttcggccagcagcgggtttttaaggaaaaagtggacacccgcacgccccaaccgaagcctgggacaagaatggtcatgaccacaaccgccaactggctctgggcgctgcttggaaaaaagaagaatccccggctgtgcacgcgcgaggagttcattagcaaagtgagatccaacgccgctatcggcgccgtctttcaggaagagcaggggtggaccagcgcttctgaagccgtgaatgatagccggttctgggagctcgttgacaaggaacgcgctctgcaccaagagggcaaatgtgagtcctgcgtgtataacatgatgggaaagagagaaaaaaagcttggcgagtttgggcgggccaagggatctcgcgcgatttggtacatgtggctgggcgccagattcctcgaatttgaggctctggggttcctgaacgaagatcattggttcggacgggagaatagctggtccggcgtcgagggggaaggcctccacagactgggatatatccttgaggaaattgacaaaaaggatggcgacctgatgtacgccgatgacacagctgggtgggatacccgcatcacagaggacgatctccagaacgaggaactgatcaccgagcagatggcccctcatcacaaaattcttgccaaggcgatctttaaactgacatatcagaataaggtggtgaaggttctccggcccacccctagaggagctgtgatggacattatctctcgcaaagatcaacggggcagcgggcaggtcggaacgtacggcctgaacacattcaccaatatggaagtgcagctgattagacagatggaggccgaaggggttatcacccaagacgacatgcagaaccccaagggcctcaaagagcgcgtggagaagtggctgcgggaatgcggagtcgatagacttaaacgcatggccatctccggcgacgattgtgtggtcaagccgctggacgagcggtttgctacatctctcctgttccttaatgatatggggaaagtgagaaaggacattcctcagtgggaacccagcaagggatggaaaaactggcaggaggttcccttttgctcccatcacttccacaagatctttatgaaagatggccgcagcctggtggtcccttgtcggaatcaagacgaactcattgggagagcccggatctctcagggagctggctggtccctgagagagaccgcctgcctggggaaggcgtacgcccagatgtggagcctcatgtatttccatcgccgggatctgagacttgcttctatggccatttgttccgctgtgccgacagagtggtttcccacgagccgcaccacatggtccatccacgcccatcaccagtggatgaccacagaagacatgctgaaagtttggaacagagtgtggatcgaggataatcctaacatgattgacaagacccccgtccactcttgggaagacatcccttacctcggcaagcgggaggatctgtggtgcggaagccttattggcctgtccagccgcgcgacgtgggccaaaaatatccataccgctattacacaagtgagaaacctcatcgggaaggaagagtatgtggactacatgcccgttatgaaacggtattctgccccttccgagagcgaaggagtcctgtga

SEQ ID NO: 21002 - RNA, 9867 nt, synthetic construct
  misc_feature 1..9867: note = derived and/or modified CDS sequence (opt5) from DENV-4__FJ850095__SS-prME
  source 1..9867: mol_type = other RNA
agcaccatcacactgctctgcctgattcccacggtgatggccttccacctttccaccagagacggcgagcctctgatgatcgtcgctaagcatgaacgggggcgcccgctcctgtttaaaacaaccgagggaattaacaagtgtacacttatcgccatggatctgggcgaaatgtgcgaggacaccgttacatacaaatgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggatccttagaaatcctggcttcgctctgctcgccggctttatggcttacatgatcgggcagacaggaattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctcttattagcaatatcaccacagccacccgctgcccgacgcaaggagagccctatctgaaggaggaacaggaccagcagtacatttgtagacgggatgtggtggaccgcggctgggggaacggatgcggcctcttcgggaaaggaggcgtcgtgacatgcgcgaagttttcttgttccggcaaaatcaccgggaatctggttcaaattgagaaccttgaatataccgtggtcgtgacagttcataatggagatacccacgccgtgggcaacgacacaagcaatcacggggtcacggctaccatcacacctagatctccctccgtggaggtcaagctgcctgattacggagaactcaccctggactgcgagccccggagcggcatcgacttcaacgagatgattctgatgaagatgaaaaagaaaacatggctcgtgcataagcagtggtttctggatcttccgctgccttggaccacgggggccgacacctctgaagttcactggaattacaaagagagaatggtgacattcaaggtcccccatgctaaacgccaggatgtgaccgttctcggctcccaggaaggagccatgcacagcgccctggctggcgcgacagaggtggactccggggatggaaaccacatgtttgccggccatcttaagtgtaaggtccggatggaaaaactgagaatcaaggggatgtcttataccatgtgcagcggaaaattctccattgacaaggagatggctgagacgcaacacggcacaaccgtggtgaaagttaagtacgaaggggccggcgccccttgtaaggtccccatcgagattcgcgatgtgaataaagaaaaggtggtcggacgggtgatcagcgctacacccctcgccgagaacaccaactctgttaccaatatcgagctggaacctccgttcggcgactcctatattgtgatcggggtcggaaacagcgcgctgacactccattggtttagaaaaggctctagcattgggaagatgttcgagtccacgtaccgcggagctaaacggatggccatcctgggcgaaaccgcctgggattttgggtctgtgggcggacttttcacaagcctgggcaaggctgttcaccaggtgtttgggtccgtctataccacaatgttcggaggcgtgagctggatgattagaatcctcatcgggtttctggttctgtggattggaaccaattctcgcaacacgtccatggccatgacatgcatcgctgtgggcgggattacccttttcctcggctttaccgtccaggccgacatgggatgtgtggtgagctggtctggccgggagctgaagtgcgggtccggaatcttcgtcgttgataatgtgcatacatggaccgaacaatacaaatttcagcccgagagccctgcgagactggcctccgctattctcaacgcccacaaggacggcgtgtgtgggatccgctctacaacgcggctggagaatgtcatgtggaaacagattaccaacgaacttaattatgtgctgtgggagggaggccacgacctcacagttgtggctggcgatgtcaagggggtgctgaccaaaggaaagagagccctgacaccccctgcgagcgaccttaagtactcctggaaaacctggggcaaggccaaaatcttcacgcccgaagctcggaactctacctttctcatcgatgggccggacacaagcgagtgccctaatgaacgcagagcctggaactccttcgaggttgaggattacggattcggcatgtttaccacaaatatttggatgaagttccgggaagggagctctgaggtgtgtgaccatagactgatgtccgctgccatcaaagatcagaaggccgtccacgctgacatgggatattggattgaaagctctaaaaaccaaacctggcagatcgagcgcgcgtccctgattgaagtgaagacatgcctctggcccaagacccatacgctgtggagcaatggcgttcttgagtctcagatgctgatccctaaaagctacgccggccccttttcccagcacaactatcggcaagggtacgctacacagaccgtgggaccttggcacctcggcaagctggagatcgatttcggggaatgccccggaaccacagtcaccattcaggaggactgtgatcatagaggcccgagcctgcgcacgacaaccgcctctgggaaacttgtgacacagtggtgctgtagatcctgcaccatgcctcccctccggtttctgggagaagacggctgttggtatggcatggagatccgccccctgagcgagaaggaagagaacatggtgaaatcccaagtcacagccgggcagggaacctctgaaacgttcagcatgggcctcctgtgccttaccctgtttgttgaggaatgtctcagacggcgcgtgacaagaaagcacatgattctggctgtggtcatcaccctgtgcgccattatccttgggggactcacatggatggatctgctgcgggcgctcatcatgctgggcgacaccatgtccgggcgcattggaggccagacgcatcttgctatcatggccgtgttcaagatgtctcctggctacgttctgggggtgtttctcagaaaactgacaagccgggagaccgccctgatggtcattggaatggctatgacaaccaccctttccatcccgcacgacctgatggagctcattgatggcatctctctggggctcatcctgcttaagattgtgacacagttcgacaatacgcaagttggaaccctggccctcagcctgacatttatccgctccaccatgagcctggtgatggcgtggagaacaattatggctgtccttttcgtggtcaccctgatccccctctgtcggacgtcttgcctgcagaaacagtcccattgggtggaaattacagccctcatcctgggcgcccaagctcttcctgtttatctgatgaccctcatgaagggggccagcagacgctcttggcccctgaacgagggaattatggctgtgggcctggtctcccttctgggcagcgccctcctgaaaaatgatgtgcctctcgcggggcccatggttgccggaggcctgcttctggctgcctacgtgatgtctgggtccagcgctgacctgtccctcgaaaaggccgccaacgtccagtgggatgagatggctgacatcaccggaagctctcctatcattgaagtgaagcaggatgaggacggcagcttttccatccgggatgtggaggaaacaaatatgattaccctgcttgttaaactggcgctcatcacagtctctgggctgtaccccctcgccattccggtgacgatgaccctgtggtatatgtggcaggtgaagacacaaagaagcggagctctttgggacgtcccttcccccgccgccacccagaaagctgccctgtctgagggcgtgtaccgcatcatgcagcggggcctgttcgggaagacacaggttggagtgggcatccacatggaaggggtcttccacaccatgtggcatgtgacgagaggaagcgttatttgtcacgagaccggccgcctcgaaccttcctgggcggatgtgcggaacgacatgatctcttatgggggaggctggagactgggcgataaatgggacaaggaggaggacgtccaagtgcttgctattgaacccgggaagaatccgaaacatgttcagacaaagcctggactgtttaaaaccctcacaggcgagatcggggccgtgaccctggatttcaagcccggaacaagcggctcccctattatcaaccgcaaagggaaggtcatcggcctctacggaaatggcgtggtgacgaaaagcggggactatgtctctgccattacccaggctgaacggatcggagagcccgattacgaggttgacgaagatatttttagaaagaagcggctgacaatcatggaccttcaccccggcgccgggaaaaccaagcgcattctgccttccatcgtgagagaggcgctgaaacggcgcctcagaaccctgattcttgctccgacacgggtggtcgccgccgaaatggaggaagctctgagaggactccccatccgctatcagacgcctgccgtgaagagcgagcataccggccgggagatcgttgatctgatgtgccacgctacattcaccacaagactcctgtcttccacccgcgtgcccaactacaatcttattgtcatggacgaagcccactttacggatcctagctccgtggcggcccgggggtacatctctacaagagttgagatgggcgaagctgccgctattttcatgaccgccaccccccctggagccacagacccgtttccccaaagcaactcccctatcgaggatattgaacgcgagatccccgagcggagctggaataccggcttcgactggatcacagactatcaggggaaaaccgtgtggtttgtcccttctattaaggctggaaacgatatcgcgaattgcctgagaaagtccggcaaaaaggtgattcagctgagccgcaaaacgttcgacacagaataccccaagaccaaactcacagattgggactttgtcgtgaccacggatatctctgagatgggggccaacttcagagctggacgggttattgacccgcgcagatgtctgaagcctgtgatccttaccgatggccccgaacgggtgatcctggccgggcccattcctgtcacacccgccagcgctgcccaacgcagaggccggatcggaagaaaccctgcgcaggaggacgatcagtatgttttctccggcgacccgctcaagaatgatgaagaccatgctcactggaccgaggccaaaatgctgctggataacatttacacacccgaggggatcattcctaccctctttggacccgaacgcgagaagacacaggccatcgacggcgaattccggcttagaggggagcaacgcaaaacctttgtggagctgatgcggagaggagacctgcctgtgtggctctcttataaggtcgctagcgccggcatttcctacaaagatcgggaatggtgcttcacgggcgagcgcaataaccagatcctggaagagaatatggaagtggagatctggacaagagagggggaaaagaagaaacttcggcccaagtggctggacgcgcgcgtttatgccgatccgatggctctcaaagactttaaggagttcgcctctggaagaaaaagcattaccctggatatcctgaccgaaattgcttccctccctacataccttagctctcgggccaagctggctctggacaacatcgtgatgctccataccacagagcgcggcgggagagcctaccagcacgcgctgaatgaacttcccgagtccctggagacgctcatgctggtcgccctgctcggagctatgaccgccggcatttttcttttctttatgcaggggaagggaatcggcaaactgagcatgggcctgatcacaattgctgtggcctccgggctcctgtgggtcgccgaaatccaacctcagtggattgctgcgtctatcattcttgagttctttctgatggtgctcctgatccccgaacctgagaagcagcggaccccccaggataaccaactgatctatgttattctcacaatccttaccattatcggactgattgccgctaatgaaatgggcctgatcgagaaaacgaagaccgacttcgggttttaccaggtgaaaacagagaccacaattctcgatgtcgacctgcgcccggccagcgcctggaccctttatgctgtggccacgacaatcctgacccctatgctcagacacacaatcgaaaacacctccgcgaatctgtctctggccgctattgccaaccaggctgccgttctcatgggacttggcaaggggtggcccctgcatcggatggatctgggagtgcccctcctggcgatgggctgttacagccaggtcaatcctaccacacttacggcctccctggtgatgctcctggtgcactatgctatcattggcccggggctgcaagccaaagctaccagagaggcccagaagcgcacagctgccggaatcatgaagaaccccaccgttgacggcattacagtcatcgatctcgaacctatcagctacgaccccaaattcgagaagcagcttgggcaagtgatgctgctggtgctctgcgcgggacagctgcttctgatgcggaccacgtgggccttctgtgaggtcctcacactggctaccggccctattctgaccctctgggaagggaatcccggaagattttggaacacaaccatcgccgtttctacagctaacattttccgcggctcctatcttgccggcgccgggctggcgtttagcctgatcaaaaatgctcagacgcctcggagaggaaccggcacaaccggggagacactcggagaaaagtggaaacgccagctgaactctcttgaccggaaggagttcgaagagtacaagagatccggcattctggaggtggatcgcaccgaagccaaaagcgctctcaaggacgggtctaaaatcaagcatgccgtgagccggggatcctctaaaatcagatggattgtcgagcgcggcatggtgaagccgaagggcaaagttgtggatctggggtgcggacggggcgggtggagctactatatggccacgctgaagaatgtcaccgaagtgaaaggatacacaaagggcgggcccggacacgaggaacctatccccatggctacctatggctggaacctcgttaaacttcattccggcgtggacgtcttttacaagcctacagagcaagtggataccctgctgtgtgacattggggagagctcctctaatcccacaatcgaagagggaagaaccctccgcgtgctgaagatggtcgaaccgtggcttagctccaaacctgagttctgcattaaggttctgaacccctatatgcccacggtgatcgaagagctcgagaaactgcagagaaagcacggcgggaatctggtgcggtgtcctctctctcgcaacagcacacacgaaatgtactgggtctccggagcctctggcaatattgtgagctccgttaacaccaccagcaaaatgcttctgaatagatttacaacgcggcatagaaagcccacctatgagaaagatgtggacctgggggcgggaacacggtctgtctccaccgaaacagagaagcctgatatgaccatcatcggccgcagactccagcggctgcaggaggaacacaaggagacatggcattacgaccaagaaaacccgtaccgcacctgggcctatcacggcagctacgaggctccctctacggggtccgccagctctatggtgaatggagttgtgaaacttctgaccaagccttgggatgtcattcccatggtgacacagctcgctatgaccgacacaacccctttcggccagcagagagtttttaaagaaaaggtggacacgcggacaccccaaccgaaacctgggacccgcatggtcatgacaaccacggccaactggctgtgggcgctgctcggaaagaagaaaaatcccagactgtgcacccgggaggagttcatctccaaggtgcgcagcaacgccgctattggcgccgtctttcaggaagagcaggggtggacatccgctagcgaagccgtgaatgattctagattctgggagcttgttgacaaagaacgggctctgcaccaagagggcaagtgtgagagctgcgtgtataacatgatgggaaaacgcgaaaagaagctcggcgagtttgggagagccaaaggatcccgggcgatctggtacatgtggctgggcgcccgcttccttgaattcgaggctctggggtttctcaacgaagatcattggttcggaagagagaattcttggagcggcgtcgagggggaaggcctgcaccggctgggatatattctcgaggaaatcgacaagaaagatggcgacctgatgtacgccgatgacaccgctgggtgggatacaagaatcaccgaggacgatcttcagaacgaggaactgattacagagcagatggcccctcatcacaagatcctcgccaaagcgatttttaagctgacctatcagaataaggtggtgaaagttcttcgccccacgcctcggggagctgtgatggacatcatttccagaaaggatcaacgcggctctgggcaggtcggaacatacggcctgaacaccttcaccaatatggaagtgcagctcatccggcagatggaggccgaaggggttatcacacaagacgacatgcagaaccccaaaggcctgaaggagagagtggagaaatggctgcgcgaatgcggagtcgatcggctcaagagaatggccattagcggcgacgattgtgtggtcaaaccgctggacgagcgctttgggacctcccttctgttcctcaatgatatgggaaaggtgcggaaggacatccctcagtgggaaccctctaaaggctggaagaactggcaggaggttcccttttgcagccatcacttccacaaaatttttatgaaggatgggagatccctggtggtcccttgtcgcaatcaagacgaacttatcggacgggctagaattagccagggcgccgggtggtctctgcgggagacagcttgcctcggcaaagcctacgcgcagatgtggtccctgatgtatttccatagacgcgatctgcggctcgccagcatggctatctgttctgccgtgccgacggagtggtttcccacctccagaacaacctggagcatccacgctcatcaccagtggatgacaaccgaagacatgctgaaggtttggaaccgcgtgtggattgaggataatcctaacatgatcgacaagacgcccgtccactcctgggaagacattccttaccttggaaaaagagaggatctgtggtgcggctctctcatcgggctgagctcccgggccacctgggcgaagaatattcatacagccatcacccaagtgcgcaaccttattggaaaagaagagtatgtggactacatgcccgttatgaagagatatagcgctccttctgagtccgaaggcgtcctgtga

SEQ ID NO: 21003 - RNA, 9867 nt, synthetic construct
  misc_feature 1..9867: note = derived and/or modified CDS sequence (opt5) from DENV-4__FJ639748__SS-prME
  source 1..9867: mol_type = other RNA
agcaccatgacactgctctgcctgatccccacggccatggctttccacctttccaccagagacggcgagcctctgatgattgtggccaagcatgaacgggggagaccgctcctgtttaaaaccaccgaggggatcaacaagtgtacccttattgccatggatctgggcgaaatgtgcgaggacaccgtgacatacaaatgtcccctcctggttaataccgaacctgaggatatcgactgctggtgtaacctgacgtctacctgggtgatgtatgggacatgcacccagagcggagagagacggagagaaaagagatccgtggctctcacaccccactctggcatggggctggagacccgggccgaaacgtggatgagctccgagggagcctggaaacatgctcaacgcgtcgagtcttggattcttagaaatcctggcttcgccctgctcgctggctttatggcctacatgatcgggcagacaggaatccagcggaccgtgttctttgttctgatgatgcttgtggcgcccagctatggcatgcgctgtgtcggggtgggaaacagagatttcgttgaaggcgtgtccgggggagcctgggtcgacctggtgctcgagcacggcggctgcgtgacaaccatggctcaggggaagcctaccctggattttgaactgacaaagacgaccgccaaagaggtcgctctcctgcggacatactgtattgaagcccttatcagcaatattaccacagcgacccgctgcccgacgcaaggagagccctatctgaaggaggaacaggaccagcagtacatctgtagacgggatgttgtggaccgcggctgggggaacggatgcggcctcttcgggaaaggaggcgtggtcacatgcgccaagttttcttgttccggcaaaattaccgggaatctggtgcaaatcgagaaccttgaatataccgttgtggtcacagtgcataatggagatacccacgctgttggcaacgacacaagcaatcacggggtgacggccaccattacacctagatctccctccgtcgaggtgcagctgcctgattacggagaactcaccctggactgcgagccccggagcggcatcgacttcaacgagatgatcctgatgaagatgaagaaaaagacatggctcgtccataaacagtggtttctggatcttccgctgccttggaccgctggggccgacacgtctgaagtgcactggaattacaaggagagaatggttaccttcaaagtgccccatgccaagcgccaggatgtcacagtgctcggctcccaagaaggagctatgcacagcgcgctggccggcgctaccgaggttgactccggggatggaaaccacatgtttgccggccatcttaaatgtaaggtgcggatggaaaagctgagaattaaagggatgtcttatacaatgtgcagcggaaagttctccatcgacaaagagatggccgagacccagcacggcacgacagtcgtgaaggtgaaatacgaaggggctggcgccccttgtaaggttcccattgagatccgcgatgtcaataaggaaaaagtggtgggacgggtcattagctctacacccctggcggagaacacaaactccgtgaccaatatcgagctggaacctccgttcggcgacagctatatcgttattggggtgggaaactctgctctgaccctccattggtttagaaagggcagctccatcgggaaaatgttcgagtctacataccgcggagccaagcggatggccattctgggcgaaacggcttgggattttgggagcgtcggcggacttttcacctccctgggcaaagccgtgcaccaggtttttgggagcgtgtatacaaccatgttcggaggcgtctcttggatgatccgcattctcatcgggctgctggtgctttggatcggaacaaattcccgcaacaccagcatggctatgacgtgcattgccgttggcgggatcacactctttctgggcttcaccgtgcaagcggacgtcggatgtgtggtgtcttggtccggccgggagctgaagtgcgggagcggaatttttgtcgttgataatgtgcatacctggacagaacagtacaagttccagcccgagtcccctgccagactcgcttctgccatcctgaacgctcacaaagacggcgtgtgtgggattcgcagcaccacacggcttgagaatgtcatgtggaagcagatcacgaacgaactgaattatgtgctctgggagggaggccacgacctgaccgttgtggccggcgatgtcaaaggggtgctgacaaagggaaaaagagcgcttacaccccctgtttccgacctcaagtactcttggaagacatggggcaaagccaagatttttacccccgaagctcggaacagcacgttcctgatcgatgggccggacacctccgagtgccctaatgaacgcagagcctggaacagcctggaggtggaggattacggatttggcatgttcacaaccaatatctggatgaaattccgggaagggtcttccgaggtctgtgaccatagactcatgagcgctgccattaaggatcaaaaagccgtgcacgctgacatgggatattggatcgaatcttccaagaaccagacatggcagattgagcgcgcgagcctgatcgaagttaaaacctgcctttggcccaagacacataccctgtggtctaatggcgtgctcgagagccagatgctgattcctaagtcctacgccggcccctttagccaacacaactatcggcaggggtacgctacgcagacagtcggaccttggcacctgggcaaacttgagatcgatttcggggaatgccccggaaccaccgtgacaatccaggaggactgtgatcatagaggcccgtctctccgcaccacgacagcctccgggaagctggtgacccaatggtgctgtagaagctgcacaatgcctcccctgcggtttctcggagaagacggctgttggtatggcatggagattcgccccctgtccgagaaagaagagaacatggtcaagtctcaggttaccgccgggcagggaacaagcgaaaccttctccatgggccttctgtgcctcacgctgtttgtggaggaatgtctgagacggcgcgtgaccagaaaacacatgatccttgctgtcgtgattacactctgcgccatcattctcggcgggctgacctggatggatctcctgcgggcgcttatcatgctgggggacacaatgtctgggcgcatcggaggccagacccatctcgctattatggccgttttcaagatgagccctggctacgtgctgggggtctttctgagaaaacttacgtcccgggagacagccctgatggtgatcggaatggctatgaccacaaccctctctattccgcacgacctgatggagctcatcgatggcattagcctggggcttatcctgctcaaaatcgttacccaattcgacaatacacaggtgggaacgctggccctgtcccttacctttattcgcagcacaatgtctctggtcatggcgtggagaaccatcatggctgtcctcttcgtcgtgacactgattcccctctgtcggacctcctgcctgcagaagcaaagccattgggttgaaatcacggcccttattctgggcgcccaggctctccctgtgtatctgatgacactgatgaaaggggcctctagacgctcctggccccttaacgagggaatcatggctgtcggcctggtgagcctcctgggctctgccctcctgaagaatgatgttcctcttgcggggcccatggtggccggaggcctgctgctcgctgcctacgtcatgtccgggagctccgctgacctgagccttgaaaaagccgccaacgtgcagtgggatgagatggctgacattaccggatctagccctatcatcgaagtgaagcaggatgaggacggctccttttctattcgggatgttgaggaaaccaatatgatcacactgctcgtcaagctggcgctcattaccgtgagcgggctgtacccccttgccatcccggtgacaatgacgctgtggtatatgtggcaagtcaaaacccagagatccggagctctgtgggacgtgccttctcccgccgccacacagaaggctgccctcagcgagggcgtttaccgcattatgcagcggggcctgttcgggaaaacccaagtgggagtcggcatccacatggaaggggtgtttcacacaatgtggcatgttaccagaggatccgtgatctgtcacgagacgggccgccttgaaccttcttgggcggatgtccggaacgacatgattagctatgggggaggctggagactgggcgataagtgggacaaagaggaggacgtgcaggttctcgctatcgaacccgggaagaatccgaagcatgtgcagaccaaacctggactgttcaagacactcaccggcgagattggggccgtcacactggatttcaaacccggaacctccggcagccctatcattaaccgcaaggggaaagtgatcggcctttacggaaatggcgtggtcacaaagtctggggactatgtttccgccatcacgcaggctgaacggattggagagcccgattacgaggtggacgaagatatctttcgcaagaagcggctgaccattatggacctgcaccccggcgccgggaagacaaaacgcatcctccctagcattgtgagagaggcgctgaagcggcgccttagaaccctgatcctcgctccgacccgggtcgtggccgccgaaatggaggaagctctgagaggactccccattcgctatcaaacccctgccgttaaatctgagcatacgggccgggagatcgtggatctgatgtgccacgctaccttcacaaccagacttctgtccagcacacgcgtccccaactacaatctgatcgtgatggacgaagcccactttaccgatccttcctctgttgcggcccgggggtacattagcacgagagtggagatgggcgaagctgccgctatcttcatgacagccacaccccctggagccaccgacccgtttccccagtccaacagccctattgaggatatcgaacgcgagattcccgagcggtcttggaatacaggcttcgactggatcaccgactatcaggggaagacagtctggtttgtgccttccatcaaagctggaaacgatattgcgaattgcctcagaaagagcggcaagaaagtcatccaactgtctcgcaagaccttcgacacggaataccccaaaacaaaacttaccgattgggactttgtggttacaaccgatattagcgagatgggggccaacttcagagctggacgggtgatcgacccgcgcagatgtctgaaacctgtgattctcacggatggccccgaacgggtcatcctggccgggcccatccctgttacccccgcctccgctgcccagcgcagaggccggattggaagaaaccctgcgcaggaggacgatcagtatgtgttttctggcgacccgctgaagaatgatgaagaccatgctcactggacagaggccaagatgctccttgataacatctacacccccgaggggattatccctacactgttcggacccgaacgcgagaaaacccaagccattgacggcgagttccggctgagaggggagcagcgcaagacatttgtggagctcatgcggagaggagacctgcctgtctggcttagctataaagtggcttccgccggcatctcttacaaggatcgggaatggtgcttcaccggcgagcgcaataaccagattctggaagagaatatggaagttgagatctggacgagagagggggagaagaagaagctccggccccgctggctggacgcgagagtgtatgccgatccgatggctctgaaagactttaaggagttcgccagcggacggaaatccatcacactcgatattcttaccgaaatcgctagcctgcctacctacctgtcttcccgcgccaagctcgctctggacaacattgtcatgcttcatacaaccgagagaggcgggcgggcctaccagcacgcgctgaatgaactccccgagagcctggagacactgatgctcgtggcccttctgggagctatgacggccggcatctttctgttctttatgcaagggaaaggaattggcaagctctccatgggcctgatcaccatcgctgtcgcctctgggcttctgtgggtggccgaaattcagcctcagtggatcgctgcgagcattatcctcgagttctttctgatggttctgctcattcccgaacctgagaagcagcgcacaccccaagataaccagcttatctatgtgatcctgaccattctgacaatcattggactcatcgccgctaatgaaatgggcctgattgagaaaaccaagacggacttcgggttttaccaggtcaaaaccgagacaaccatccttgatgtggacctgagaccggcctccgcctggacactctatgctgttgccaccacgattctgacacctatgctgcggcacaccatcgaaaacacatctgcgaatctcagccttgccgctatcgccaaccaggctgccgtgctgatgggactgggcaaggggtggcccctccatagaatggatctgggagtcccccttctggcgatgggctgttactcccaagtgaatcctaccaccctcacagccagcctggtgatgctgctcgttcactatgctattatcggcccggggcttcaggccaaagctacgcgcgaggcccagaagcggaccgctgccggaattatgaaaaaccccacagtcgacggcatcaccgtgattgatctggaacctatctcttacgaccccaagttcgagaagcaactgggacaggtgatgctcctggtcctttgcgcgggacagctgctcctgatgagaacaacctgggccttttgtgaggttctgacgctcgctacaggccctatccttaccctgtgggaagggaatcccggacgcttctggaacaccacaattgccgtgtccaccgctaacatcttccggggcagctatctggccggcgccgggctcgcgttttctctgattaaaaatgctcagacacctagacgcggaacgggcaccacaggggagacccttggagaaaagtggaaacggcaactgaactccctcgacagaaaggagttcgaagagtacaaacgcagcggcatcctggaggtggatcggacagaagccaagtctgctctgaaggacgggagcaaaattaagcatgccgtctccagaggatctagcaaaatccgctggatcgtggagcggggcatggttaagccgaaaggcaaggtggtcgatctcgggtgcggaagaggcgggtggtcctactatatggccacccttaagaatgtgacggaagttaaaggatacaccaagggcgggcccggacacgaggaacctattcccatggctacatatggctggaacctggtgaaactgcatagcggcgtcgacgtgttttacaagcctaccgaacaggtggatacactcctgtgtgacatcggggagtcctctagcaatcccaccattgaagagggacgcacacttagagtcctgaaaatggttgaaccgtggctctcctctaagcctgagttctgcatcaaggtgctgaacccctatatgcccaccgtgattgaggaactggagaaactccagcggaagcacggcgggaatcttgtccgctgtcctctgagcagaaactccacgcacgaaatgtactgggtgtctggagccagcggcaatatcgtttccagcgtgaacacaacctctaaaatgctgctcaatcggtttaccacaagacatcggaagcccacgtatgagaaagatgtcgacctgggggcgggaacccgctccgtgagcacagaaaccgagaagcctgatatgacaattatcggcagacggcttcagcgcctgcaagaggaacacaaagagacctggcattacgaccaggaaaacccgtacagaacatgggcctatcacggctcttacgaggctccctccaccgggagcgcctcttccatggttaatggagtggtcaagctcctgacgaagccttgggatgtgatccccatggttacccagctggctatgacagacaccacacctttcggccagcaacgggtgtttaaagaaaaggtcgacacccgcacgccccagagcaaaccggggacaagaatggtgatgaccacaaccgccaactggctctgggcgctgcttggaaagaaaaagaatcctcggctgtgcacgcgcgaggagttcatttccaaggtcagaagcaacgccgctatcggcgccgtgtttcaggaggaacaagggtggacctctgctagcgaagccgttaatgattcccggttctgggagctcgtggacaaagaacgcgctctgcaccaggagggcaagtgtgagtcttgcgtctataacatgatgggaaaaagagaaaagaaacttggcgagtttgggcgggccaagggaagccgcgcgatttggtacatgtggctgggcgccagattcctcgaatttgaggctctggggttcctgaacgaagatcattggttcggacgggaaaattcctggtctggcgtggagggggaaggcctccacagactgggatatatccttgaggaaattgacaagaaagatggcgacctgatgtacgccgatgacacagctgggtgggatacccgcatcacagaggacgatctccagaacgaggaactgatcaccgagcagatggcgccccatcacaagattcttgccaaagcgatctttaagctgacatatcaaaataaagtggttaaggtgctccggcctacccccagaggagctgtcatggacattatcagccgcaaggatcagcggggctccggacaggtgggaacgtacggcctgaacacattcaccaatatggaagttcagctgattagacaaatggaggccgaaggggtgatcacccaggacgacatgcagaaccctaaaggcctcaaggagcgcgtcgagaaatggctgcgggaatgcggagtggatagacttaagcgcatggccatctctggcgacgattgtgtcgtgaaacccctggacgagcggtttgctacaagcctcctgttccttaatgatatggggaaggttagaaaagacattccgcagtgggaaccttccaagggatggaagaactggcaagaggtgcccttttgcagccatcacttccacaaaatctttatgaaggatggccgctctctggtcgtgccctgtcggaatcaggacgaactcattgggagagcccggatctcccagggagctggctggagcctgagagagaccgcctgcctggggaaagcgtacgcccagatgtggtctctcatgtatttccatcgccgggatctgagacttgcttccatggccatttgtagcgctgttcctacagagtggtttccgacgtcccgcaccacatggtctatccacgcccatcaccaatggatgaccacagaagacatgctgaaggtgtggaacagagtctggatcgaggataatcccaacatgattgacaaaacccctgtgcacagctgggaagacatcccctacctcggcaagcgggaggatctgtggtgcggatcccttattggcctgagctctcgcgcgacgtgggccaagaatatccataccgctattacacaggtgagaaacctcatcgggaaagaagagtatgttgactacatgcctgtcatgaagcggtattccgcccccagcgagaatgaaggagtgctgtga

SEQ ID NO: 21004 - RNA, 9867 nt, synthetic construct
  misc_feature 1..9867: note = derived and/or modified CDS sequence (opt5) from DENV-4__FJ639764__SS-prME
  source 1..9867: mol_type = other RNA
agcaccatcaccctgctctgcctgattcccacggtgatggccttccacctttccaccagagacggcgagcctctgatgatcgtcgctaagcatgaacgggggagaccgctcctgtttaagaccaccgagggaaccaacaagtgtacccttattgccatggatctgggcgaaatgtgcgaggacacagttacctacaaatgtcccctcctggtgaatacggaacctgaggatatcgactgctggtgtaacctgacctctacatgggtgatgtatgggacctgcacacagagcggagagagacggcgcgaaaagagatccgtcgcgctcacaccccactctggcatggggctggagacgcgggctgaaacatggatgagctccgagggagcctggaaacatgcccaacgcgtggagtcttggattcttagaaatcctggcttcgctctgctcgccggctttatggcttacatgatcgggcagaccggaatccagcggacagttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcaccaccatggcccaggggaagcctacactggattttgaactgacgaagaccacagctaaagaggttgccctcctgcggacctactgtattgaagctcttatcagcaatattacaaccgccacgcgctgcccgacacaaggagagccctatctgaaggaggaacaggaccagcagtacatctgtagacgggatgtggtggaccgcggctgggggaacggatgcggcctcttcgggaaaggaggcgtcgtgacctgcgcgaagttttcttgttccggcaaaattaccgggaatctggttcaaatcgagaaccttgaatatacagtggtcgtgaccgttcataatggagatacacacgccgtgggcaacgacacgagcaatcacggggtcaccgctacaattacccctagatctccctccgtggaggtcaagctgcctgattacggagaactcacactggactgcgagccccggagcggcatcgacttcaacgagatgatcctgatgaagatgaaaaagaaaacctggctcgtgcataagcagtggtttctggatcttccgctgccttggacggccggggctgacacctctgaagttcactggaattacaaagagagaatggtgacattcaaggtcccccatgccaaacgccaggatgtgaccgttctcggctcccaggaaggagccatgcacagcgctctggcgggcgccacagaggtggactccggggatggaaaccacatgtttgctggccatcttaagtgtaaggtccggatggaaaaactgagaattaaggggatgtcttataccatgtgcagcggaaaattctccatcgacaaggagatggccgagacgcaacacggcacaaccgtggtgaaagttaagtacgaaggggccggcgctccttgtaaggtccccattgagatccgcgatgtgaataaagaaaaggtggtcggacgggtgattagctctacacccctcgccgagaacaccaactccgttaccaatatcgagctggaacctccgttcggcgacagctatatcgtgattggggtcggaaactctgcgctgacactccattggtttagaaaaggcagctccatcgggaagatgttcgagtctacgtaccgcggagctaaacggatggccattctgggcgaaaccgcctgggattttgggagcgtgggcggacttttcacatccctgggcaaggctgttcaccaggtgtttgggagcgtctataccacaatgttcggaggcgtgtcttggatgatccgcattctcatcgggtttctggttctgtggatcggaaccaattccagaaacacgagcatggccatgacatgcattgctgtgggcgggatcacccttttcctcggctttaccgtccaggccgacatgggatgtgtggtgtcttggtccggccgggagctgaagtgcgggagcggaattttcgtcgttgataatgtgcatacatggatcgaacaatacaaatttcagcccgagtcccctgcgagactggcctctgctattctcaacgcccacaaggacggcgtgtgtgggatccgcagcaccacacggctggagaatgtcatgtggaaacagattacgaacgaacttaattatgtgctgtgggagggaggccacgacctcaccgttgtggctggcgatgtcaagggggtgctgacaaaaggaaagagaaccctgacaccccctgtttccgaccttaagtactcttggaaaacctggggcaaggccaaaatcttcacgcccgaagcgcggaacagcacctttctcatcgatgggccggacacatccgagtgccctaatgaacgcagagcctggaacagcctggaggtggaggattacggattcggcatgttcaccacaaatatttggatgaagtttcgggaagggtcttccgaggtctgtgaccatagactgatgagcgctgccatcaaagatcagaaggctgtgcacgccgacatgggatattggattgaatcttccaaaaaccaaacctggcagatcgagcgcgccagcctcattgaagttaagacatgcctgtggcccaagacccatacgctttggtctaatggcgtgctggagagccagatgctcatccctaaatcctacgctggccccttcagccagcacaactatcggcaagggtacgcgacacagaccgtcggaccttggcacctgggcaagctggagatcgattttggggaatgccccggaaccacagtgaccattcaggaggactgtgatcatagaggcccgtctcttcgcacgacaaccgcctccgggaaactcgtgacacagtggtgctgtagaagctgcaccatgcctcccctgcggttcctgggagaagacggctgttggtatggcatggagatccgccccctctccgagaaggaagagaacatggtcaaatctcaagttacagctgggcagggaaccagcgaaacgttttccatgggcctgctttgcctgaccctcttcgtggaggaatgtctgagacggcgcgtgacaagaaagcacatgattctggccgtcgtgatcaccctttgcgccattatcctcgggggactgacatggatggatctgctccgggctctgatcatgcttggcgacaccatgtctgggcgcattggaggccagacgcatctggccatcatggcggtttttaagatgagccctggctacgtgctcggggtcttcctgagacggctgacatcccgcgagaccgctcttatggtgattggaatggccatgacaaccaccctgtctatcccgcacgacctcatggagctgattgatggcatcagcctcgggctgatccttctgaaaattgttacacagtttgacaatacgcaagtgggaaccctcgccctgtccctgacattcatcagaagcaccatgtctcttgtcatggcttggcggacaattatggccgtgctgtttgtcgtgaccctcatccccctgtgtagaacgtcctgcctccagaagcagagccattgggttgaaattacagcgctgatccttggcgctcaagccctgcctgtgtatctcatgaccctgatgaaaggggcctctcgccggtcctggcccctgaacgagggaattatggctgtcggccttgtgagcctgctcggctctgccctgctcaagaatgatgttcctctggctgggcccatggtggccggaggccttctgctggcggcctacgtcatgtccgggagctccgctgacctcagcctggaaaaagccgctaacgtgcagtgggatgagatggccgacatcaccggatctagccctatcattgaagtgaagcaggatgaggacggctccttctctatcagagatgttgaggaaacaaatatgattacccttctggtcaagctcgccctgatcacagtgagcgggctctaccccctggctattccggtgacgatgaccctttggtatatgtggcaggtcaaaacacaacgctccggagcgctgtgggacgtgccttctcccgccgctacccagaaggccgccctgagcgagggcgtttaccggatcatgcagagaggcctctttgggaaaacacaggtgggagtcggcatccacatggaaggggtgttccacaccatgtggcatgttacgcgcggatccgtgatttgtcacgagaccggccggctggaaccttcttgggctgatgtcagaaacgacatgatcagctatgggggaggctggcgccttggcgataagtgggacaaagaggaggacgtgcaagttctggccgtggaacccgggaagaatccgaagcatgtccagacaaaacctggactcttcaagaccattacaggcgagatcggggcggtgaccctggattttaaacccggaacatccggcagccctattatcaaccggaaggggaaagtgatcggcctctacggaaatggcgtcgttacgaagtctggggactatgtgtccgctattacccaggccgaaagaatcggagagcccgattacgaggtggacgaagatattttccggaaaaagcgcctgacaatcatggaccttcaccccggcgccgggaagaccaaacgcattctgcctagcatcgtccgggaggctctgaagcgcagactccggaccctgattcttgccccgacaagagtggttgcggctgaaatggaggaagccctgcgcggactccccatccggtatcagacgcctgccgtgaaatctgagcataccggcagagagatcgtcgatctgatgtgccacgctacatttaccacacgcctcctgtccagcacccgggtgcccaactacaatcttattgttatggacgaagcccacttcacggatccttcctctgtggctgccagagggtacatcagcacacgcgtcgagatgggcgaagcggccgctatttttatgaccgccacaccccctggagctacagacccgttcccccaatccaacagccctatcgaggatattgaacgggagatccccgagagatcttggaataccggctttgactggatcacagactatcaggggaagaccgtgtggttcgtcccttccattaaagccggaaacgatatcgccaattgcctgcgcaagagcggcaagaaagtgattcagctgtctagaaagacgtttgacacagaataccccaaaaccaagctcacagattgggacttcgttgtgaccacggatatcagcgagatgggggctaactttcgggcgggacgcgtgattgacccgagacggtgtctgaaacctgtcatccttaccgatggccccgaacgcgttatcctggccgggcccattcctgtgacacccgcttccgccgcccaaagacggggcagaatcggacgcaaccctgctcaggaggacgatcagtatgtgttctctggcgacccgctcaagaatgatgaagaccatgcccactggaccgaggcgaagatgctgctggataacatttacacacccgaggggatcattcctaccctcttcggacccgaacgggagaaaacacaggctatcgacggcgaatttagacttcgcggggagcaacggaagaccttcgtcgagctgatgagacggggagacctgcctgtgtggctcagctataaagttgcctccgccggcatttcttacaaggatcgcgaatggtgctttacgggcgagagaaataaccagatcctggaagagaatatggaagtggagatctggacacgggagggggagaagaagaaacttcgccccagatggctggacgctcgggtctatgccgatccgatggcgctcaaagacttcaaggagtttgccagcggacgcaaatccattaccctggatatcctgaccgaaattgctagcctccctacatacctttcttccagagccaagctggctctggacaacatcgtgatgctccataccacagagcggggcgggcgcgcctaccagcacgctctgaatgaacttcccgagagcctggagacgctcatgctggtcgccctgctcggagcgatgaccgccggcattttcctctttttcatgcaggggaaaggaatcggcaagctgtccatgggcctgatcacaattgctgtggcctctgggctcctgtgggttgctgaaatccaacctcagtggattgccgccagcatcattcttgagtttttcctgatggtgctcctgatccccgaacctgagaagcagagaacaccccaggataaccaactgatctatgtcattctcacaatccttaccattatcggactgattgctgcgaatgaaatgggcctgatcgagaaaacgaagaccgactttgggttctaccaggtgaaaacagagaccacaattctcgatgttgacctgcggccggcctccgcttggaccctttatgccgtggccacgacaatcctgacccctatgctcagacacacaatcgaaaacacctctgctaatctgagcctggccgcgattgccaaccaggctgccgtcctcatgggacttggcaaggggtggcccctgcatcgcatggatctgggagtgcccctcctggctatgggctgttactcccaggtgaatcctaccacacttacggccagcctggttatgctcctggtccactatgcgatcattggcccggggctgcaagccaaagctacccgggaggcccagaagagaacagctgccggaatcatgaaaaaccccaccgtggacggcattacagtgatcgatctcgaacctatctcttacgaccccaagtttgagaagcagcttgggcaagtcatgctgctggttctctgcgctggacagctgcttctgatgcgcaccacgtgggccttctgtgaggtgctcacactggcgaccggccctattctgaccctctgggaagggaatcccggacggttctggaacacaaccatcgccgtgtccacagctaacatttttagaggcagctatcttgccggcgctgggctggccttctctctgatcaaaaatgcccagacgcctcgccggggaaccggcacaaccggggagacactcggagaaaagtggaaaagacagctgaactcccttgaccgcaaggagtttgaagagtacaaacggagcggcattctggaggtcgatagaaccgaagcgaagtctgctctcaaggacgggagcaaaatcaagcatgccgtgtcccgcggatctagcaaaatccggtggattgttgagagaggcatggtgaagccgaaaggcaaggtcgtggatctggggtgcggacgcggcgggtggtcctactatatggctacgctgaagaatgttaccgaagtgaaaggatacacaaagggcgggcccggacacgaggaacctatccccatggccacctatggctggaacctcgtcaaacttcatagcggcgtggacgtgttctacaagcctacagagcaagtcgataccctgctgtgtgacattggggagtcctctagcaatcccacaatcgaagagggaagaaccctccgggttctgaaaatggtggaaccgtggctttcctctaagcctgagttttgcattaaggtgctgaacccctatatgcccacggtcatcgaagaacttgagaaactgcagcgcaagcacggcgggaatctggtgagatgtcctctcagccggaactccacacacgaaatgtactgggtttctggagccagcggcaatattgtgtccagcgtcaacaccacctctaaaatgcttctgaatagattcacaacgcggcatcgcaagcccacctatgagaaagatgtggacctgggggctggaacaagatccgttagcaccgaaacagagaagcctgatatgaccatcatcggccggcgcctccagagactgcaggaggaacacaaagagacatggcattacgaccaagaaaacccgtaccggacctgggcctatcacggctcttacgaggcgccctccacggggagcgcctcttccatggtgaatggagtcgtgaaacttctgaccaagccttgggatgttattcccatggtgacacagctcgctatgaccgacacaaccccttttggccagcagcgcgtcttcaaagaaaaggtggacacgagaacaccccaaccgaaacctgggacccggatggtcatgacaaccacggccaactggctgtgggctctgctcggaaagaaaaagaatccccgcctgtgcaccagagaggagtttatcagcaaggtgcggtccaacgccgcgattggcgccgttttccaggaagaacaggggtggacaagcgcttctgaagccgtgaatgatagccgcttttgggagcttgtcgacaaagaaagagctctgcaccaagagggcaagtgtgagtcctgcgtgtataacatgatgggaaaacgggaaaagaaactcggcgagttcgggcgcgccaagggatctagagctatctggtacatgtggctgggcgcccggtttcttgagttcgaggcgctggggttcctcaacgaagatcattggtttggaagagagaatagctggtccggcgtggagggggaaggcctgcaccgcctgggatatattctcgaggaaatcgacaagaaagatggcgacctgatgtacgccgatgacaccgctgggtgggatacacggatcaccgaggacgatcttcagaacgaggaactgattacagagcagatggcccctcatcacaagatcctcgctaaagccattttcaagctgacctatcagaataaagttgtgaaggtccttagacccacgcctcgcggagccgtgatggacatcatttctcggaaggatcaaagaggcagcgggcaggttggaacatacggcctgaacacctttaccaatatggaagtgcagctcatccgccagatggaggcggaaggggtcatcacacaagacgacatgcagaaccccaaaggcctgaaggagcgggtggagaaatggctgagagaatgcggagtcgatcgcctcaagcggatggctatttccggcgacgattgtgtggttaaaccgctggacgagagattcgggacctctcttctgtttctcaatgatatgggaaaggtgcgcaaagacatccctcagtgggaacccagcaagggctggaagaactggcaggaggtccccttctgctcccatcactttcacaaaattttcatgaaggatgggcggagcctggtggttccttgtagaaatcaagacgaacttatcggacgggccagaatttctcagggcgccgggtggtccctgcgcgagacagcttgcctcggcaaagcctacgctcagatgtggagcctgatgtattttcatcggagagatctgcgcctcgcctctatggcgatctgttccgccgtgccgacggagtggttccccaccagcagaacaacctggtccatccacgctcatcaccagtggatgacaaccgaagacatgctgaaggtctggaaccgggtgtggattgaggataatcctaacatgatcgacaaaacgcccgtgcactcttgggaagacattccttaccttggaaagcgcgaggatctgtggtgcggcagcctcatcgggctgtccagcagagccacctgggctaagaatattcatacagccatcacccaagttcggaaccttattggaaaagaagagtatgtcgactacatgcccgtgatgaagcgctattctgcgccttccgagagcgaaggcgtgctgtga

SEQ ID NO: 21005 - RNA, 9867 nt, synthetic construct
  misc_feature 1..9867: note = derived and/or modified CDS sequence (opt5) from DENV-4__FJ639773__SS-prME
  source 1..9867: mol_type = other RNA
agcaccatcaccctgctctgcctgattcccacggtgatggccttccacctttccaccagagacggagaacctctgatgatcgtcgctaagcatgaacgggggagaccgctcctgtttaagacaaccgaaggaattaacaagtgtacacttatcgccatggatctgggagaaatgtgcgaggacaccgttacatacaagtgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggatccttagaaatcctggcttcgctctgctcgccggctttatggcttacatgatcgggcagacaggcattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctcttattagcaatatcaccacagccacccgctgcccgacgcaaggagagccctatctgaaggaggaacaggaccagcagtacatttgtagacgggatgtggtggaccgcggctgggggaacggatgcggcctcttcgggaaaggaggcgtcgtgacatgcgcgaagttttcttgttccggcaaaatcaccgggaatctggttcaaattgagaaccttgaatataccgtggtcgtgacagttcataatggagatacccacgccgtgggcaacgacacaagcaatcacggggtcacggctaccatcacacctagatctccctccgtggaggtcaagctgcctgattacggagaactcaccctggactgcgagccccggagcggcatcgacttcaacgagatgattctgatgaagatgaaaaagaaaacatggctcgtgcataagcagtggtttctggatcttccgctgccttggaccacgggggccgacacctctgaagttcactggaattacaaagagagaatggtgacattcaaggtcccccatgctaaacgccaggatgtgaccgttctcggctcccaggaaggagccatgcacagcgccctggctggcgcgacagaggtggactccggggatggaaaccacatgtttgccggccatcttaagtgtaaggtccggatggaaagactgcgcatcaaagggatgtcttataccatgtgcagcggaaagttctccattgacaaagagatggctgagacgcaacacggcacaaccgtggtgaaggttaaatacgaaggggccggcgccccttgtaaggtccccatcgagattcgggatgtgaataaggaaaaagtggtcggaagagtgatcagcgctacacccctcgccgagaacaccaactctgttaccaatatcgagctggaacctccgttcggcgactcctatattgtgatcggggtcggaaacagcgcgctgacactccattggtttcgcaagggctctagcattgggaaaatgttcgagtccacgtaccggggagctaagagaatggccatcctgggcgaaaccgcctgggattttgggtctgtgggcggacttttcacaagcctgggcaaagctgttcaccaggtgtttgggtccgtctataccacaatgttcggaggcgtgagctggatgattcgcatcctcatcgggtttctggttctgtggattggaaccaattctcggaacacgtccatggccatgacatgcatcgctgtgggcgggattacccttttcctcggctttaccgtccaggccgacatgggatgtgtggtgagctggtctggcagagagctgaagtgcgggtccggaatcttcgtcgttgataatgtgcatacatggaccgaacaatacaagtttcagcccgagagccctgcgcgcctggcctccgctattctcaacgcccacaaagacggcgtgtgtgggatccggtctacaacgagactggagaatgtcatgtggaagcagattaccaacgaacttaattatgtgctgtgggagggaggccacgacctcacagttgtggctggcgatgtcaaaggggtgctgaccaagggaaaacgggccctgacaccccctgcgagcgaccttaagtactcctggaagacctggggcaaagccaagatcttcacgcccgaagctcgcaactctacctttctcatcgatgggccggacacaagcgagtgccctaatgaaagacgggcctggaactccttcgaggttgaggattacggattcggcatgtttaccacaaatatttggatgaaattcagagaagggagctctgaggtgtgtgaccatcgcctgatgtccgctgccatcaaggatcagaaagccgtccacgctgacatgggatattggattgaaagctctaagaaccaaacctggcagatcgagcgggcgtccctgattgaagtgaaaacatgcctctggcccaagacccatacgctgtggagcaatggcgttcttgagtctcagatgctgatccctaagagctacgccggccccttttcccagcacaactatagacaagggtacgctacacagaccgtgggaccttggcacctcggcaaactggagatcgatttcggggaatgccccggaaccacagtcaccattcaggaggactgtgatcatcgcggcccgagcctgagaacgacaaccgcctctgggaaacttgtgacacagtggtgctgtcggtcctgcaccatgcctcccctccgctttctgggagaagacggctgttggtatggcatggagatcagacccctgagcgagaaagaagagaacatggtgaagtcccaagtcacagccgggcagggaacctctgaaacgttcagcatgggcctcctgtgccttaccctgtttgttgaggaatgtctccggcgcagagtgacacggaaacacatgattctggctgtggtcatcaccctgtgcgccattatccttgggggactcacatggatggatctgctgcgcgcgctcatcatgctgggcgacaccatgtccgggagaattggaggccagacgcatcttgctatcatggccgtgttcaagatgtctcctggctacgttctgggggtgtttctccggaagctgacaagccgcgagaccgccctgatggtcattggaatggctatgacaaccaccctttccatcccgcacgacctgatggagctcattgatggcatctctctggggctcatcctgcttaaaattgtgacacagttcgacaatacgcaagttggaaccctggccctcagcctgacatttatcagatccaccatgagcctggtgatggcgtggcggacaattatggctgtccttttcgtggtcaccctgatccccctctgtagaacgtcttgcctgcagaagcagtcccattgggtggaaattacagccctcatcctgggcgcccaagcccttcctgtttatctgatgaccctcatgaaaggggccagccgccggtcttggcccctgaacgagggaattatggctgtgggcctggtctcccttctgggcagcgccctcctgaagaatgatgtgcctctcgcggggcccatggttgccggaggcctgcttctggctgcctacgtgatgtctgggtccagcgctgacctgtccctcgaaaaagccgccaacgtccagtgggatgagatggctgacatcaccggaagctctcctatcattgaagtgaagcaggatgaggacggcagcttttccatcagagatgtggaggaaacaaatatgattaccctgcttgttaagctggcgctcatcacagtctctgggctgtaccccctcgccattccggtgacgatgaccctgtggtatatgtggcaagtgaaaacacaacgcagcggagctctttgggacgtcccttcccccgccaccacacagaaggccgctctgtctgagggcgtgtaccggatcatgcagagaggcctgttcgggaaaacccaggttggagtgggcatccacatggaaggggtcttccacacgatgtggcatgtgacccgcggaagcgttatttgtcacgagacaggccggctcgaaccttcctgggccgatgtgagaaacgacatgatctcttatgggggaggctggcgcctgggcgataagtgggacaaagaggaggacgtccaagtgcttgcgattgaacccgggaagaatccgaagcatgttcagaccaaacctggactgtttaagacactcaccggcgagatcggggctgtgacactggatttcaaacccggaacgagcggctcccctattatcaaccggaaggggaaagtcatcggcctctacggaaatggcgtggtgaccaagagcggggactatgtctctgccattacacaggccgaaagaatcggagagcccgattacgaggttgacgaagatatttttcggaaaaagcgcctgaccatcatggaccttcaccccggcgctgggaagaccaaacgcattctgccttccatcgtgcgggaggccctgaagcgcagactccggacactgattcttgcgccgacgagagtggtcgctgccgaaatggaggaagccctgcgcggactccccatccggtatcagacccctgctgtgaaaagcgagcatacaggcagagagatcgttgatctgatgtgccacgccaccttcacaacccgcctcctgtcttccacgcgggtgcccaactacaatcttattgtcatggacgaagctcactttacagatcctagctccgtggccgcgagagggtacatctctacccgcgttgagatgggcgaagccgctgccattttcatgaccgctacaccccctggagccaccgacccgtttccccaaagcaactcccctatcgaggatattgaacgggagatccccgagagaagctggaatacaggcttcgactggatcaccgactatcaggggaagacggtgtggtttgtcccttctattaaagccggaaacgatatcgctaattgcctgcgcaagtccggcaagaaagtgattcagctgagcagaaagacattcgacaccgaataccccaaaacaaagctcaccgattgggactttgtcgtgacgaccgatatctctgagatgggggcgaacttccgggccggacgcgttattgacccgagacggtgtctgaaacctgtgatccttacagatggccccgaacgcgtgatcctggctgggcccattcctgtcacccccgccagcgccgctcaaagacggggcagaatcggacgcaaccctgcccaggaggacgatcagtatgttttctccggcgacccgctcaagaatgatgaagaccatgcgcactggacagaggctaagatgctgctggataacatttacacccccgaggggatcattcctacactctttggacccgaacgggagaaaacccaggccatcgacggcgagttcagacttcgcggggagcaacggaagacgtttgtggagctgatgagacggggagacctgcctgtgtggctctcttataaagtcgccagcgctggcatttcctacaaggatcgcgaatggtgcttcacaggcgagagaaataaccagatcctggaagagaatatggaagtggagatctggacccgggagggggagaagaagaaacttcgccccaaatggctggacgccagagtttatgcggatccgatggccctcaaggactttaaagagttcgcttctggaagaaagagcattaccctggatatcctgacagaaattgcctccctccctacctaccttagctctcgcgctaaactggccctggacaacatcgtgatgctccatacaacggagagaggcgggcgggcttaccagcacgccctgaatgaacttcccgagtccctggagaccctcatgctggtcgcgctgctcggagccatgacagctggcatttttcttttctttatgcaggggaagggaatcggcaagctgagcatgggcctgatcaccattgccgtggcttccgggctcctgtgggtcgccgaaatccaacctcagtggattgccgcttctatcattcttgagttctttctgatggtgctcctgatccccgaacctgagaaacagcgcacaccccaggataaccaactgatctatgttattctcaccatccttacgattatcggactgattgcggccaatgaaatgggcctgatcgagaagaccaaaacagacttcgggttttaccaggagaagaccgaaacaaccattctcgatgtggacctgagaccggctagcgcctggacgctttatgccgtcgctacaaccatcctgacacctatgctccggcacaccatcgagaacacctccgccaatctgtctctggcggccattgctaaccaggccgctgtgctcatgggacttggcaaagggtggcccctgcatagaatggatctgggagttcccctcctggccatgggctgttacagccaggtgaatcctacaacgcttaccgcgtccctggtcatgctcctggtgcactatgccatcattggcccggggctgcaagctaaggccacacgcgaagctcagaaacggaccgccgctggaatcatgaagaaccccacagtggacggcattaccgttatcgatctcgagcctatcagctacgaccccaagttcgagaaacagcttgggcaagtcatgctgctggtgctctgcgccggacagctgcttctgatgagaacgacatgggcgttctgtgaagtgctcaccctggccaccggccctattctgacactctgggaggggaatcccggacgcttttggaacaccacaatcgctgtctctacggccaacattttccggggctcctatcttgctggcgccgggctggcctttagcctgatcaagaatgcgcagacccctagacgcggaacaggcaccacaggggaaaccctcggagagaaatggaagcggcagctgaactctcttgacagaaaagagttcgaggagtacaagcgctccggcattctggaagttgatcggacggaggctaagagcgccctcaaagacgggtctaagatcaaacatgctgtgagcagaggatcctctaagatccgctggattgtggaacggggcatggtcaaaccgaagggcaaggtggttgatctggggtgcggaagaggcgggtggagctactatatggccaccctgaaaaatgtgacagaggtcaagggatacaccaaaggcgggcccggacacgaagaacctatccccatggccacatatggctggaacctcgtgaaacttcattccggcgttgacgtgttttacaaacctaccgagcaagtcgatacactgctgtgtgacattggggaaagctcctctaatcccaccatcgaggaaggacgcacgctcagagtgctgaagatggtggagccgtggcttagctccaagcctgagttctgcattaaagtcctgaacccctatatgcccacagttatcgaggagctcgaaaagctgcagcggaaacacggcgggaatctggtgcgctgtcctctctctagaaacagcacccacgagatgtactgggtgtccggagcttctggcaatattgtcagctccgtgaacaccacaagcaagatgcttctgaatcggtttacgaccagacatcggaaacccacatatgaaaaggatgttgacctgggggccggaacccgctctgtgtccacagagaccgagaaacctgatatgacaatcatcggcagacggctccagcgcctgcaggaagaacacaaggaaacctggcattacgaccaagagaacccgtacagaacgtgggcgtatcacggcagctacgaagccccctctaccgggtccgctagctctatggtcaatggagtggttaaacttctgacaaaaccttgggatgtgattcccatggtcacccagctcgccatgacagacaccacgcctttcggccagcagcgggtgtttaaggagaaagttgacacacgcacaccccagccgaagcctgggacaagaatggtgatgaccacgaccgctaactggctgtgggccctgctcggcaagaagaagaatccccggctgtgcacacgcgaggagttcatctccaaagtcagaagcaacgcggccattggcgctgtgtttcaggaggaacaggggtggacctccgccagcgaggctgtcaatgattctcggttctgggaacttgtggacaaggagcgcgccctgcaccaagagggcaaatgtgaaagctgcgtttataacatgatgggaaagagagagaaaaagctcggcgaatttgggcgggctaagggatcccgcgccatctggtacatgtggctgggcgcgagattccttgagttcgaagccctggggtttctcaacgaggatcattggttcggacgggaaaattcttggagcggcgtggaaggggagggcctgcacagactgggatatattctcgaagagatcgacaaaaaggatggcgacctgatgtacgctgatgacacagccgggtgggatacccgcatcacagaggacgatcttcagaacgaggaactgattaccgaacagatggctcctcatcacaaaatcctcgccaaggccatttttaaactgacgtatcagaataaggtcgtgaaggtgcttcggcccacacctagaggagcggttatggacatcatttcccgcaaagatcaacggggctctggacaggtgggaacctacggcctgaacaccttcacaaatatggaggtccagctcatcagacagatggaagctgagggggtgatcacccaagacgacatgcagaaccccaagggcctgaaagagcgcgttgaaaagtggctgcgggagtgcggagtggatagactcaaacgcatggccattagcggcgacgattgtgtcgtgaagccgctggacgaacggtttgggacatcccttctgttcctcaatgatatgggaaaagtcagaaaggacatccctcagtgggagccctctaagggctggaaaaactggcaggaagtgcccttttgcagccatcacttccacaagatttttatgaaagatgggcgctccctggttgtgccttgtcggaatcaagacgagcttatcgggcgggctcggattagccagggcgctgggtggtctctgagagagacggcctgcctcggcaaggcttacgcccagatgtggtccctgatgtatttccatcgccgggatctgagactcgcgagcatggccatctgttctgctgtcccgaccgaatggtttcccacatcccgcaccacatggagcatccacgcccatcaccagtggatgaccacggaggacatgctgaaagtgtggaacagagtttggattgaagataatcctaacatgatcgacaagacccccgtgcactcctgggaggacattccttaccttggaaagcgggaagatctgtggtgcggctctctcatcgggctgagctcccgcgctacatgggccaaaaatattcataccgcgatcacacaagtcagaaaccttattggaaaggaggagtatgtggactacatgcccgtgatgaaacggtatagcgccccttctgaatccgagggcgttctgtga

SEQ ID NO: 21006 - RNA, 9867 nt, synthetic construct
  misc_feature 1..9867: note = derived and/or modified CDS sequence (opt5) from DENV-4__FJ882580__SS-prME
  source 1..9867: mol_type = other RNA
agcaccatcacactgctctgcctgattcccacggtgatggccttccacctttccaccagagacggcgagcctctgatgatcgtcgctaagcatgaacgggggcgcccgctcctgtttaaaacaaccgagggaattaacaagtgtacacttatcgccatggatctgggcgaaatgtgcgaggacaccgttacatacaaatgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggatccttagaaatcctggcttcgctctgctcgccggctttatggcttacatgatcgggcagacaggaattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctcttattagcaatatcaccacagccacccgctgcccgacgcaaggagagccctatctgaaggaggaacaggaccagcagtacatttgtagacgggatgtggtggaccgcggctgggggaacggatgcggcctcttcgggaaaggaggcgtcgtgacatgcgcgaagttttcttgttccggcaaaatcaccgggaatctggttcaaattgagaaccttgaatataccgtggtcgtgacagttcataatggagatacccacgccgtgggcaacgacacaagcaatcacggggtcacggctaccatcacacctagatctccctccgtggaggtcaagctgcctgattacggagaactcaccctggactgcgagccccggagcggcatcgacttcaacgagatgattctgatgaagatgaaaaagaaaacatggctcgtgcataagcagtggtttctggatcttccgctgccttggaccacgggggccgacacctctgaagttcactggaattacaaagagagaatggtgacattcaaggtcccccatgctaaacgccaggatgtgaccgttctcggctcccaggaaggagccatgcacagcgccctggctggcgcgacagaggtggactccggggatggaaaccacatgtttgccggccatcttaagtgtaaggtccggatggaaaaactgagaatcaaggggatgtcttataccatgtgcagcggaaaattctccattgacaaggagatggctgagacgcaacacggcacaaccgtggtgaaagttaagtacgaaggggccggcgccccttgtaaggtccccatcgagattcgcgatgtgaataaagaacgggtggtcggaagagtgatcagcgctacacccctcgccgagaacaccaactctgttaccaatatcgagctggaacctccgttcggcgactcctatattgtgatcggggtcggaaacagcgcgctgacactccattggtttcgcaagggctctagcattgggaaaatgttcgagtccacgtaccggggagctaagagaatggccatcctgggcgaaaccgcctgggattttgggtctgtgggcggacttttcacaagcctgggcaaagctgttcaccaggtgtttgggtccgtctataccacaatgttcggaggcgtgagctggatgattcgcatcctcatcgggtttctggttctgtggattggaaccaattctcggaacacgtccatggccatgacatgcatcgctgtgggcgggattacccttttcctcggctttaccgtccaggccgacatgggatgtgtggtgagctggtctggcagagagctgaagtgcgggtccggaatcttcgtcgttgataatgtgcatacatggaccgaacaatacaagtttcagcccgagagccctgcgcgcctggcctccgctattctcaacgcccacaaagacggcgtgtgtgggatccggtctacaacgagactggagaatgtcatgtggaagcagattaccaacgaacttaattatgtgctgtgggagggaggccacgacctcacaatcgttgctggcgatgtgaaaggggtcctgaccaagggaaaacgggccctgacaccccctgcgagcgaccttaagtactcctggaagacctggggcaaagccaagatcttcacgcccgaagctcgcaactctacctttctcattgatgggccggacacaagcgagtgccctaatgaaagacgggcctggaactccttcgaggtggaggattacggattcggcatgtttaccacaaatatctggatgaaattcagagaagggagctctgaggtttgtgaccatcgcctgatgtccgctgccattaaggatcagaaagccgtgcacgctgacatgggatattggatcgaaagctctaagaaccaaacctggcagattgagcgggcgtccctgatcgaagtcaaaacatgcctctggcccaagacccatacgctgtggagcaatggcgtgcttgagtctcagatgctgatccctaagagctacgccggccccttttcccagcacaactatagacaagggtacgctacacagaccgttggaccttggcacctcggcaaactggagattgatttcggggaatgccccggaaccacagtgaccatccaggagaactgtgaccatcgcggcccgagcctgagaacgacaaccgcctctgggaagcttgtcacacagtggtgctgtcggtcctgcaccatgcctcccctccgctttctgggagaagatggctgttggtatggcatggagattagacccctgagcgagaaagaagagaatatggtgaagtcccaagtgacagccgggcagggaacctctgaaacgttcagcatgggcctcctgtgccttaccctgtttgtcgaggaatgtctccggcgcagagttacacggaaacacatgatcctggctgtggtgattaccctgtgcgccatcatccttgggggactcacatggatggacctgctgcgcgcgctcattatgctgggcgataccatgtccgggagaatcggaggccagacgcatcttgctattatggccgtcttcaagatgtctcctggctacgtgctgggggtttttctccggaagctgacaagccgcgagaccgccctgatggtgatcggaatggctatgacaaccaccctttccattccgcacgacctgatggagctcatcgacggcatctctctggggctcattctgcttaaaatcgtcacacagttcgataacacgcaagtgggaaccctggccctcagcctgacatttattagatccaccatgagcctggttatggcgtggcggacaatcatggctgtgcttttcgtcgtgaccctgattcccctctgtagaacgtcttgcctgcagaagcagtcccattgggtcgaaatcacagccctcattctgggcgcccaagctcttcctgtgtatctgatgaccctcatgaaaggggccagccgccggtcttggcccctgaatgagggaatcatggctgttggcctggtgtcccttctgggcagcgccctcctgaagaacgacgtccctctcgcggggcccatggtggccggaggcctgcttctggctgcctacgttatgtctgggtccagcgctgatctgtccctcgaaaaagccgccaatgtgcagtgggacgagatggctgatatcaccggaagctctcctattatcgaagtcaagcaggacgaggatggcagcttttccattagagacgtggaggaaacaaacatgatcaccctgcttgtgaagctggcgctcattacagtttctgggctgtaccccctcgccatcccgatcacgatgaccctgtggtatatgtggcaggtcaaaacacaacgcagcggagctctttgggatgtgccttcccccgccgccacccagaaggctgccctgtctgagggcgtgtaccggattatgcagagaggcctgttcgggaaaacacaggtcggagtgggcatccacatggaaggggttttccacaccatgtggcatgtgacgcgcggaagcgtcatttgtcacgagaccggccggctcgaaccttcctgggcggacgtgagaaatgatatgatctcttatgggggaggctggcgcctgggcgacaagtgggataaagaggaggacgttcaagtgcttgctattgaacccgggaagaacccgaagcatgtccagacaaaacctggactgtttaagaccctcacaggcgagatcggggccgtgaccctggacttcaaacccggaacaagcggctcccctatcattaatcggaaggggaaagttatcggcctctacggaaacggcgtggtcacgaagagcggggattatgtgtctgccattacccaggctgaaagaatcggagagcccgactacgaggtggatgaagacatttttcggaaaaagcgcctgacaatcatggatcttcaccccggcgccgggaagaccaaaagaattctgccttccatcgtccgggaggcgctgaagcgcagactccggaccctgatccttgctccgacaagagttgtggccgccgaaatggaggaagctctgcgcggactccccattcggtatcagacgcctgccgtgaaaagcgagcataccggcagagagatcgtcgacctgatgtgccacgctacattcaccacacgcctcctgtcttccacccgggtgcccaattacaaccttattgttatggatgaagcccactttacggaccctagctccgtggcggccagagggtacatctctacacgcgtcgagatgggcgaagctgccgctattttcatgaccgccaccccccctggagccacagatccgtttccccaaagcaattcccctatcgaggacatcgaacgggagattcccgagagaagctggaacaccggcttcgattggatcacagactatcaggggaagaccgtgtggtttgttccttctattaaagctggaaatgacatcgcgaactgcctgcgcaagtccggcaagaaagtgattcagctgagcagaaagacgttcgatacagaataccccaaaaccaagctcacagactgggattttgtcgtgaccacggacatctctgagatgggggccaacttccgggctggacgcgtcatcgatccgagacggtgtctgaaacctgtgattcttaccgacggccccgaacgcgttatcctggccgggcccattcctgtgacacccgccagcgctgcccaaagacggggcagaatcggacgcaatcctgcgcaggaggatgaccagtatgtgttctccggcgatccgctcaagaacgacgaagatcatgctcactggaccgaggccaagatgctgctggacaatatttacacacccgaggggatcattcctaccctctttggacccgaacgggagaaaacacaggccatcgatggcgaattcagacttcgcggggagcaacggaagacctttgtcgagctgatgagacggggagacctgcctgtttggctctcttataaagtggctagcgccggcatctcctacaaggaccgcgaatggtgcttcacgggcgagagaaacaatcagattctggaagagaacatggaagtggagatctggacacgggagggggaaaaaaagaagcttcgccccaaatggctggatgcgagagtctatgccgacccgatggctctcaaggattttaaagagttcgcctctggacggaagagcattaccctggacatcctgaccgaaattgcttccctccctacataccttagctctcgcgccaaactggctctggataatatcgtgatgctccataccacagagagaggcgggcgggcctaccagcacgcgctgaacgaacttcccgagtccctggagacgctcatgctggttgccctgctcggagctatgaccgccggcatctttcttttctttatgcaggggaagggaattggcaagctgagcatgggcctgatcacaattgctgtggcctccgggctcctgtgggtcgccgaaatccaacctcagtggattgctgcgtctatcatccttgagttctttctgatggtgctcctgattcccgaacctgagaaacagcgcaccccccaggacaatcaactgatctatgtcattctcacaatccttaccattatcggactgattgccgctaacgaaatgggcctgatcgagaagacgaaaaccgatttcgggttttaccaggtgaagacagagaccacaatcctcgacgttgatctgagaccggccagcgcctggaccctttatgctgtggccacgacaattctgacccctatgctccggcacacaatcgaaaatacctccgcgaacctgtctctggccgctattgccaatcaggctgccgtcctcatgggacttggcaaagggtggcccctgcatagaatggacctgggagtgcccctcctggcgatgggctgttacagccaggttaaccctaccacacttacggcctccctggtgatgctcctggtccactatgctatcattggcccggggctgcaagccaaggctacccgcgaggcccagaaacggacagctgccggaatcatgaagaatcccaccgtggatggcatcacagtgattgacctcgaacctatcagctacgatcccaagttcgagaaacagcttgggcaagttatgctgctggtcctctgcgcgggacagctgcttctgatgagaaccacgtgggccttctgtgaggtgctcacactggctaccggccctattctgaccctctgggaagggaaccccggacgcttttggaacacaaccatcgccgtgtctacagctaatattttccggggctcctatcttgccggcgccgggctggcgtttagcctgatcaagaacgctcagacgcctagacgcggaaccggcacaaccggggagacactcggagaaaaatggaagcggcagctgaattctcttgacagaaaagagttcgaagagtacaagcgctccggcatcctggaggtcgaccggaccgaagccaagagcgctctcaaagatgggtctaagattaaacatgccgttagcagaggatcctctaagatccgctggattgtggagcggggcatggtgaaaccgaagggcaaggtcgtggacctggggtgcggaagaggcgggtggagctactatatggccacgctgaaaaacgttaccgaagtgaagggatacacaaaaggcgggcccggacacgaggaacctatccccatggctacctatggctggaatctcgtcaagcttcattccggcgtggatgttttttacaaacctacagagcaagtggacaccctgctgtgtgatattggggagagctcctctaaccccacaatcgaagagggacgcaccctcagagtcctgaagatggtggaaccgtggcttagctccaagcctgagttctgcattaaagtgctgaatccctatatgcccacggtcatcgaagagctcgagaagctgcagcggaaacacggcgggaacctggttcgctgtcctctctctagaaatagcacacacgaaatgtactgggtgtccggagcctctggcaacatcgtgagctccgtcaataccaccagcaagatgcttctgaaccggtttacaacgagacatcggaaacccacctatgagaaggacgtggatctgggggcgggaacacgctctgtttccaccgaaacagagaaacctgacatgaccattatcggcagacggctccagcgcctgcaggaggaacacaaggagacatggcattacgatcaagaaaatccgtacagaacctgggcctatcacggcagctacgaggctccctctacggggtccgccagctctatggtgaacggagtcgtgaagcttctgaccaaaccttgggacgttattcccatggtgacacagctcgctatgaccgatacaacccctttcggccagcagcgggtctttaaggaaaaagtggacacgcgcacaccccaaccgaagcctgggaccagaatggttatgacaaccacggccaattggctgtgggcgctgctcggaaaaaagaagaacccccggctgtgcacccgcgaggagttcatctccaaagtgagaagcaatgccgctattggcgccgtctttcaggaagagcaggggtggacatccgctagcgaagccgtgaacgactctcggttctgggagcttgtcgataaggaacgcgctctgcaccaagagggcaaatgtgagagctgcgtgtataacatgatgggaaagagagaaaaaaagctcggcgagtttgggcgggccaagggatcccgcgcgatctggtacatgtggctgggcgccagattccttgaattcgaggctctggggtttctcaatgaagaccattggttcggacgggagaactcttggagcggcgttgagggggaaggcctgcacagactgggatatatcctcgaggaaattgataaaaaggacggcgatctgatgtacgccgacgataccgctgggtgggacacacgcatcaccgaggatgaccttcagaatgaggaactgattacagagcagatggcccctcatcacaaaatcctcgccaaggcgatttttaaactgacctatcagaacaaggtggtcaaggtgcttcggcccacgcctagaggagctgtgatggatatcatctcccgcaaagaccaacggggctctgggcaggttggaacatacggcctgaataccttcaccaacatggaagtgcagctcattagacagatggaggccgaaggggtcatcacacaagatgacatgcagaatcccaagggcctgaaagagcgcgtggagaagtggctgcgggaatgcggagttgacagactcaaacgcatggccattagcggcgatgactgtgtggtcaagccgctggatgagcggtttgggacctcccttctgttcctcaacgacatgggaaaagtgagaaaggatatccctcagtgggaaccctctaagggctggaaaaattggcaggaggtccccttttgcagccatcacttccacaagatttttatgaaagacgggcgctccctggtggttccttgtcggaaccaagatgaacttatcggaagagctcggatcagccagggcgccgggtggtctctgagagagacagcttgcctcggcaaggcctacgcgcagatgtggtccctgatgtatttccatcgccgggacctgagactcgccagcatggctatttgttctgccgtgccgacggagtggtttcccacctcccgcacaacctggagcatccacgctcatcaccagtggatgacaaccgaagatatgctgaaagtctggaatagagtgtggattgaggacaaccctaatatgatcgataagacgcccgttcactcctgggaagacattccttaccttggaaagcgggaggacctgtggtgcggctctctcatcgggctgagctcccgcgccacctgggcgaaaaacattcatacagccatcacccaagtgagaaatcttatcggaaaggaagagtatgtcgattacatgcccgtgatgaaacggtatagcgctccttctgagtccgaaggcgtgctgtga

SEQ ID NO: 21007 - RNA, 9867 nt, synthetic construct
  misc_feature 1..9867: note = derived and/or modified CDS sequence (opt5) from DENV-4__FJ882581__SS-prME
  source 1..9867: mol_type = other RNA
agcaccatcacactgctctgcctgattcccacggtgatggccttccacctttccaccagagacggcgagcctctgatgatcgtcgctaagcatgaacgggggcgcccgctcctgtttaaaacaaccgagggaattaacaagtgtacacttatcgccatggatctgggcgaaatgtgcgaggacaccgttacatacaaatgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggatccttagaaatcctggcttcgctctgctcgccggctttatggcttacatgatcgggcagacaggaattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctcttattagcaatatcaccacagccacccgctgcccgacgcaaggagagccctatctgaaggaggaacaggaccagcagtacatttgtagacgggatgtggtggaccgcggctgggggaacggatgcggcctcttcgggaaaggaggcgtcgtgacatgcgcgaagttttcttgttccggcaaaatcaccgggaatctggttcaaattgagaaccttgaatataccgtggtcgtgacagttcataatggagatacccacgccgtgggcaacgacacaagcaatcacggggtcacggctaccatcacacctagatctccctccgtggaggtcaagctgcctgattacggagaactcaccctggactgcgagccccggagcggcatcgacttcaacgagatgattctgatgaagatgaaaaagaaaacatggctcgtgcataagcagtggtttctggatcttccgctgccttggaccacgggggccgacacctctgaagttcactggaattacaaagagagaatggtgacattcaaggtcccccatgctaaacgccaggatgtgaccgttctcggctcccaggaaggagccatgcacagcgccctggctggcgcgacagaggtggactccggggatggaaaccacatgtttgccggccatcttaagtgtaaggtccggatggaaaaactgagaatcaaggggatgtcttataccatgtgcagcggaaaattctccattgacaaggagatggctgagacgcaacacggcacaaccgtggtgaaagttaagtacgaaggggccggcgccccttgtaaggtccccatcgagattcgcgatgtgaataaagaaaaggtggtcggacgggtgatcagcgctacacccctcgccgagaacaccaactctgttaccaatatcgagctggaacctccgttcggcgactcctatattgtgatcggggtcggaaacagcgcgctgacactccattggtttagaaaaggctctagcattgggaagatgttcgagtccacgtaccgcggagctaaacggatggccatcctgggcgaaaccgcctgggattttgggtctgtgggcggacttttcacaagcctgggcaaggctgttcaccaggtgtttgggtccgtctataccacaatgttcggaggcgtgagctggatgattagaatcctcatcgggtttctggttctgtggattggaaccaattctcgcaacacgtccatggccatgacatgcatcgctgtgggcgggattacccttttcctcggctttaccgtccaggccgacatgggatgtgtggtgagctggaatggccgggagctgaagtgcgggtctggaatcttcgtcgttgataacgtgcatacatggaccgaacaatacaaatttcagcccgagtcccctgcgagactggccagcgctattctcaatgcccacaaggacggcgtgtgtgggatccgctccacaacgcggctggagaacgtcatgtggaaacagattaccaatgaacttaactatgtgctgtgggagggaggccacgacctcacagttgtggctggcgatgtcaagggggtgctgaccaaaggaaagagagccctgacaccccctgcgtctgaccttaagtacagctggaaaacctggggcaaggccaaaatcttcacgcccgaagctcggaattccacctttctcatcgatgggccggacacatctgagtgccctaacgaacgcagagcctggaatagcttcgaggttgaggattacggattcggcatgtttaccacaaacatttggatgaagttccgggaagggtccagcgaggtgtgtgaccatagactgatgtctgctgccatcaaagatcagaaggccgtccacgctgacatgggatattggattgaatccagcaaaaatcaaacctggcagatcgagcgcgcgtctctgattgaagtgaagacatgcctctggcccaagacccatacgctgtggtccaacggcgttcttgagagccagatgctgatccctaaatcttacgccggcccctttagccagcacaactatcggcaagggtacgctacacagaccgtgggaccttggcacctcggcaagctggagatcgatttcggggaatgccccggaaccacagtcaccattcaggagaattgtgaccatagaggcccgtccctgcgcacgacaaccgccagcgggaaacttgtgacacagtggtgctgtagatcttgcaccatgcctcccctccggtttctgggagaagatggctgttggtatggcatggagatccgccccctgtccgagaaggaagagaacatggtgaaaagccaagtcacagccgggcagggaacctccgaaacgttctctatgggcctcctgtgccttaccctgtttgttgaggaatgtctcagacggcgcgtgacaagaaagcacatgattctggctgtggtcatcaccctgtgcgccattatccttgggggactcacatggatggacctgctgcgggcgctcatcatgctgggcgataccatgagcgggcgcattggaggccagacgcatcttgctatcatggccgtgttcaagatgtcccctggctacgttctgggggtgtttctcagaaaactgacatctcgggagaccgccctgatggtcattggaatggctatgacaaccacccttagcatcccgcacgacctgatggagctcattgacggcatctccctggggctcatcctgcttaagattgtgacacagttcgataatacgcaagttggaaccctggccctctctctgacatttatccgcagcaccatgtccctggtgatggcgtggagaacaattatggctgtccttttcgtggtcaccctgatccccctctgtcggacgagctgcctgcagaaacagtctcattgggtggaaattacagccctcatcctgggcgcccaagctcttcctgtttatctgatgaccctcatgaagggggcctccagacgcagctggcccctgaacgagggaattatggctgtgggcctggtctctcttctgggctccgccctcctgaaaaatgacgtgcctctcgcggggcccatggttgccggaggcctgcttctggctgcctacgtgatgagcgggtcttccgctgatctgagcctcgaaaaggccgccaacgtccagtgggacgagatggctgatatcaccggatccagccctatcattgaagtgaagcaggacgaggatggctcttttagcatccgggacgtggaggaaacaaatatgattaccctgcttgttaaactggcgctcatcacagtctccgggctgtaccccctcgccattccgatcacgatgaccctgtggtatatgtggcaggtgaagacacaaagatctggagctctttgggatgtgcctagccccgccgccacccagaaagctgccctgtccgagggcgtctaccgcatcatgcagcggggcctgttcgggaagacacaggtgggagttggcattcacatggaaggggtgttccacaccatgtggcatgtcacgagaggatctgtgatctgtcacgagaccggccgcctcgaacctagctgggcggacgttcggaacgatatgatttcctatgggggaggctggagactgggcgacaaatgggataaggaggaggacgtgcaagtccttgctatcgaacccgggaagaatccgaaacatgtgcagacaaagcctggactgtttaaaaccctcacaggcgagattggggccgttaccctggacttcaagcccggaacatctggcagccctatcatcaaccgcaaagggaaggtgattggcctctacggaaatggcgtcgtgacgaaatccggggattatgtgagcgccatcacccaggctgaacggattggagagcccgactacgaggtcgatgaagacatctttagaaagaagcggctgacaattatggatcttcaccccggcgccgggaaaaccaagcgcatcctgccttctattgttagagaggcgctgaaacggcgcctcagaaccctgatccttgctccgacacgggtggtggccgccgaaatggaggaagctctgagaggactccccatccgctatcagacgcctgccgtcaagtccgagcataccggccgggagattgtggacctgatgtgccacgctacattcaccacaagactcctgagctctacccgcgttcccaactacaatcttatcgtgatggatgaagcccactttacggacccttccagcgtcgcggcccgggggtacatttccacaagagtggagatgggcgaagctgccgctatcttcatgaccgccaccccccctggagccacagatccgtttccccaatctaacagccctattgaggacatcgaacgcgagatccccgagcggtcctggaataccggcttcgattggattacagactatcaggggaaaaccgtttggtttgtgcctagcatcaaggctggaaacgacattgcgaactgcctgagaaagtctggcaaaaaggtcatccagctgtcccgcaaaacgttcgatacagaataccccaagaccaaactcacagactgggattttgtggtcaccacggacattagcgagatgggggccaatttcagagctggacgggtgatcgatccgcgcagatgtctgaagcctgttatccttaccgacggccccgaacgggtgattctggccgggcccatccctgtgacacccgcctctgctgcccaacgcagaggccggattggaagaaacctcgcgcaggaggatgaccagtatgtcttcagcggcgatcctctgaagaatgacgaagatcatgctcactggaccgaggccaaaatgctgctcgacaacatctacacaccggaggggattatccccaccctttttggacctgaacgcgagaagacacaggccattgatggcgaattccggctgagaggggagcaacgcaaaacctttgttgagctgatgcggagaggagacctccccgtgtggctgtcctataaggtggcttctgccggcatcagctacaaagaccgggaatggtgcttcacgggcgagcgcaataaccagatccttgaagagaatatggaagtcgagatttggacaagagagggggaaaagaagaaactgcggcctaagtggctcgatgcgcgcgtgtatgccgaccccatggctctgaaagattttaaggagttcgcctccggaagaaaatctatcaccctggacattctcaccgaaatcgctagccttccgacatacctgtccagccgggccaagctggctctcgataacattgttatgctgcataccacagagcgcggcgggagagcctaccagcacgcgcttaatgaactgcctgagtctctcgagacgctgatgctggtggccctccttggagctatgaccgccggcatctttctgttctttatgcaggggaagggaatcggcaaactgtccatgggcctcattacaatcgctgtcgccagcgggctgctttgggtggccgaaattcaaccccagtggatcgctgcgtccattatcctggagttctttctcatggtcctgctgatccctgaacccgagaagcagcggacccctcaggacaaccaactcatttatgtgatccttacaattctgaccatcattggactgatcgccgctaatgaaatgggcctcattgagaaaacgaagaccgatttcgggttttaccaggttaaaacagagaccacaatcctggacgtggatcttcgccccgcctctgcctggaccctgtatgctgtcgccacgacaatcctcaccccgatgctgagacacacaattgaaaacaccagcgcgaatctgtccctcgccgctatcgccaaccaggctgccgtgcttatgggactgggcaaggggtggcctctgcatcggatggacctcggagttcccctgcttgcgatgggctgttactctcaggtgaatcccaccacactgacggccagcctcgtcatgctgctggtgcactatgctattatcggccctgggctccaagccaaagctaccagagaggcccagaagcgcacagctgccggaattatgaagaacccgaccgtggatggcatcacagttatcgaccttgaacccatttcctacgatcctaaattcgagaagcagctggggcaagtcatgctgctcgtgctgtgcgcgggacagcttctgctcatgcggaccacgtgggccttctgtgaggtgctgacactggctaccggccccatcctcaccctttgggaagggaaccctggaagattttggaatacaaccattgccgtcagcacagctaacatcttccgcggctcttatctggccggcgccgggctggcgttttccctcattaaaaatgctcagacgccccggagaggaaccggcacaaccggggagacactgggagaaaagtggaaacgccagcttaacagcctggaccggaaggagttcgaagagtacaagagatctggcatcctcgaggttgaccgcaccgaagccaaatccgctctgaaggatgggagcaaaatcaagcatgccgtgtctcggggaagctccaaaattagatggatcgtggagcgcggcatggtcaagcctaagggcaaagtggttgacctggggtgcggacggggcgggtggtcttactatatggccacgctcaagaatgtgaccgaagtcaaaggatacacaaagggcgggccgggacacgaggaacccattcctatggctacctatggctggaaccttgtgaaactgcatagcggcgttgatgtgttttacaagcccacagagcaagtcgacaccctgctctgtgatatcggggagtccagctccaatcctacaattgaagagggaagaaccctgcgcgtgcttaagatggtggaaccctggctgtctagcaaaccggagttctgcatcaaggtcctcaacccttatatgcccacggttattgaagagctggagaaactgcagagaaagcacggcgggaatctcgtgcggtgtcccctttcccgcaactctacacacgaaatgtactgggtgagcggagcctccggcaatatcgtctctagcgtgaacaccacctccaaaatgctgctgaatagatttacaacgcggcatagaaagcctacctatgagaaagacgttgatctcggggcgggaacacggagcgtgtctaccgaaacagagaagcccgacatgaccatcattggccgcagactgcagcggcttcaggaggaacacaaggagacatggcattacgatcaagaaaacccttaccgcacctgggcctatcacggctcctacgaggctccgagcacggggtctgcctccagcatggtcaatggagtggttaaactgctcaccaagccctgggacgtgatccctatggtcacacagctggctatgaccgatacaacccccttcggccagcagagagtgtttaaagaaaaggttgacacgcggacacctcaacccaaaccggggacccgcatggtgatgacaaccacggccaactggctgtgggcgctcctgggaaagaagaaaaatcctagactttgcacccgggaggagttcatttctaaggtccgctccaacgccgctatcggcgccgtgtttcaggaagagcaggggtggacaagcgcttccgaagccgtcaacgacagcagattctgggagctggtggataaagaacgggctctccaccaagagggcaagtgtgagtcttgcgtttataatatgatgggaaaacgcgaaaagaagctgggcgagtttgggagagccaaaggaagccgggcgatttggtacatgtggcttggcgcccgcttcctggaattcgaggctctcgggtttctgaacgaagaccattggttcggaagagagaattcctggtctggcgtggagggggaaggcctgcaccggctcggatatatcctggaggaaatcgataagaaagacggcgatcttatgtacgccgacgataccgctgggtgggacacaagaattaccgaggatgacctgcagaacgaggaactcatcacagagcagatggccccccatcacaagattctggccaaagcgatctttaagcttacctatcagaataaggtcgtgaaagtgctgcgccctacgccccggggagctgttatggatattatcagcagaaaggaccaacgcggctccgggcaggtgggaacatacggcctcaacaccttcaccaatatggaagtccagctgatccggcagatggaggccgaaggggtgattacacaagatgacatgcagaaccctaaaggcctgaaggagagagttgagaaatggctccgcgaatgcggagtggaccggctgaagagaatggccatctctggcgatgactgtgtcgtgaaaccccttgatgagcgctttgggaccagcctgctcttcctgaatgacatgggaaaggtccggaaggatattccgcagtgggaaccttccaaaggctggaagaactggcaggaggtgcccttttgctctcatcacttccacaaaatctttatgaaggacgggagaagccttgttgtgccctgtcgcaatcaagatgaactgattggacgggctagaatctcccagggcgccgggtggagcctccgggagacagcttgcctgggcaaagcctacgcgcagatgtggtctctgatgtatttccatagacgcgacctccggctggcctccatggctatctgtagcgccgtccctacggagtggtttccgacctctagaacaacctggtccattcacgctcatcaccagtggatgacaaccgaagatatgcttaaggtgtggaaccgcgtttggatcgaggacaatcccaacatgattgataagacgcctgtgcacagctgggaagacatcccctacctgggaaaaagagaggacctctggtgcggctccctgattgggctttctagccgggccacctgggcgaagaatatccatacagccattacccaagtccgcaacctgatcggaaaagaagagtatgtggattacatgcctgtgatgaagagatattccgctcccagcgagtctgaaggcgttctctga

SEQ ID NO: 21008 - RNA, 9867 nt, synthetic construct
  misc_feature 1..9867: note = derived and/or modified CDS sequence (opt5) from DENV-4__FJ882582__SS-prME
  source 1..9867: mol_type = other RNA
agcaccatcacactgctctgcctgattcccacggtgatggccttccacctttccaccagagacggcgagcctctgatgatcgtcgctaagcatgaacgggggcgcccgctcctgtttaaaacaaccgagggaattaacaagtgtacacttatcgccatggatctgggcgaaatgtgcgaggacaccgttacatacaaatgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggatccttagaaatcctggcttcgctctgctcgccggctttatggcttacatgatcgggcagacaggaattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctcttattagcaatatcaccacagccacccgctgcccgacgcaaggagagccctatctgaaggaggaacaggaccagcagtacatttgtagacgggatgtggtggaccgcggctgggggaacggatgcggcctcttcgggaaaggaggcgtcgtgacatgcgcgaagttttcttgttccggcaaaatcaccgggaatctggttcaaattgagaaccttgaatataccgtggtcgtgacagttcataatggagatacccacgccgtgggcaacgacacaagcaatcacggggtcacggctaccatcacacctagatctccctccgtggaggtcaagctgcctgattacggagaactcaccctggactgcgagccccggagcggcatcgacttcaacgagatgattctgatgaagatgaaaaagaaaacatggctcgtgcataagcagtggtttctggatcttccgctgccttggaccacgggggccgacacctctgaagttcactggaattacaaagagagaatggtgacattcaaggtcccccatgctaaacgccaggatgtgaccgttctcggctcccaggaaggagccatgcacagcgccctggctggcgcgacagaggtggactccggggatggaaaccacatgtttgccggccatcttaagtgtaaggtccggatggaaaaactgagaatcaaggggatgtcttataccatgtgcagcggaaaattctccattgacaaggagatggctgagacgcaacacggcacaaccgtggtgaaagttaagtacgaaggggccggcgccccttgtaaggtccccatcgagattcgcgatgtgaataaagaaaaggtggtcggacgggtgatcagcgctacacccctcgccgagaacaccaactctgttaccaatatcgagctggaacctccgttcggcgactcctatattgtgatcggggtcggaaacagcgcgctgacactccattggtttagaaaaggctctagcattgggaagatgttcgagtccacgtaccgcggagctaaacggatggccatcctgggcgaaaccgcctgggattttgggtctgtgggcggacttttcacaagcctgggcaaggctgttcaccaggtgtttgggtccgtctataccacaatgttcggaggcgtgagctggatgattagaatcctcatcgggtttctggttctgtggattggaaccaattctcgcaacacgtccatggccatgacatgcatcgctgtgggcgggattacccttttcctcggctttaccgtccaggccgacatgggatgtgtggtgagctggaatggccgggagctgaagtgcgggtctggaatcttcgtcgttgataacgtgcatacatggaccgaacaatacaaatttcagcccgagtcccctgcgagactggccagcgctattctcaatgcccacaaggacggcgtgtgtgggatccgctccacaacgcggctggagaacgtcatgtggaaacagattaccaatgaacttaactatgtgctgtgggagggaggccacgacctcacagttgtggctggcgatgtcaagggggtgctgaccaaaggaaagagagccctgacaccccctgcgtctgaccttaagtacagctggaaaacctggggcaaggccaaaatcttcacgcccgaagctcggaattccacctttctcatcgatgggccggacacatctgagtgccctaacgaacgcagagcctggaatagcttcgaggttgaggattacggattcggcatgtttaccacaaacatttggatgaagttccgggaagggtccagcgaggtgtgtgaccatagactgatgtctgctgccatcaaagatcagaaggccgtccacgctgacatgggatattggattgaatccagcaaaaatcaaacctggcagatcgagcgcgcgtctctgattgaagtgaagacatgcctctggcccaagacccatacgctgtggtccaacggcgttcttgagagccagatgctgatccctaaatcttacgccggcccctttagccagcacaactatcggcaagggtacgctacacagaccgtgggaccttggcacctcggcaagctggagatcgatttcggggaatgccccggaaccacagtcaccattcaggagaattgtgaccatagaggcccgtccctgcgcacgacaaccgccagcgggaaacttgtgacacagtggtgctgtagatcttgcaccatgcctcccctccggtttctgggagaagatggctgttggtatggcatggagatccgccccctgtccgagaaggaagagaacatggtgaaaagccaagtcacagccgggcagggaacctccgaaacgttctctatgggcctcctgtgccttaccctgtttgttgaggaatgtctcagacggcgcgtgacaagaaagcacatgattctggctgtggtcatcaccctgtgcgccattatccttgggggactcacatggatggacctgctgcgggcgctcatcatgctgggcgataccatgagcgggcgcattggaggccagacgcatcttgctatcatggccgtgttcaagatgtcccctggctacgttctgggggtgtttctcagaaaactgacatctcgggagaccgccctgatggtcattggaatggctatgacaaccacccttagcatcccgcacgacctgatggagctcattgacggcatctccctggggctcatcctgcttaagattgtgacacagttcgataatacgcaagttggaaccctggccctctctctgacatttatccgcagcaccatgtccctggtgatggcgtggagaacaattatggctgtccttttcgtggtcaccctgatccccctctgtcggacgagctgcctgcagaaacagtctcattgggtggaaattacagccctcatcctgggcgcccaagctcttcctgtttatctgatgaccctcatgaagggggcctccagacgcagctggcccctgaacgagggaattatggctgtgggcctggtctctcttctgggctccgccctcctgaaaaatgacgtgcctctcgcggggcccatggttgccggaggcctgcttctggctgcctacgtgatgagcgggtcttccgctgatctgagcctcgaaaaggccgccaacgtccagtgggacgagatggctgatatcaccggatccagccctatcattgaagtgaagcaggacgaggatggctcttttagcatccgggacgtggaggaaacaaatatgattaccctgcttgttaaactggcgctcatcacagtctccgggctgtaccccctcgccattccgatcacgatgaccctgtggtatatgtggcaggtgaagacacaaagatctggagctctttgggatgtgcctagccccgccgccacccagaaagctgccctgtccgagggcgtctaccgcatcatgcagcggggcctgttcgggaagacacaggtgggagttggcattcacatggaaggggtgttccacaccatgtggcatgtcacgagaggatctgtgatctgtcacgagaccggccgcctcgaacctagctgggcggacgttcggaacgatatgatttcctatgggggaggctggagactgggcgacaaatgggataaggaggaggacgtgcaagtccttgctatcgaacccgggaagaatccgaaacatgtgcagacaaagcctggactgtttaaaaccctcacaggcgagattggggccgttaccctggacttcaagcccggaacatctggcagccctatcatcaaccgcaaagggaaggtgattggcctctacggaaatggcgtcgtgacgaaatccggggattatgtgagcgccatcacccaggctgaacggattggagagcccgactacgaggtcgatgaagacatctttagaaagaagcggctgacaattatggatcttcaccccggcgccgggaaaaccaagcgcatcctgccttctattgttagagaggcgctgaaacggcgcctcagaaccctgatccttgctccgacacgggtggtggccgccgaaatggaggaagctctgagaggactccccatccgctatcagacgcctgccgtcaagtccgagcataccggccgggagattgtggacctgatgtgccacgctacattcaccacaagactcctgagctctacccgcgttcccaactacaatcttatcgtgatggatgaagcccactttacggacccttccagcgtcgcggcccgggggtacatttccacaagagtggagatgggcgaagctgccgctatcttcatgaccgccaccccccctggagccacagatccgtttccccaatctaacagccctattgaggacatcgaacgcgagatccccgagcggtcctggaataccggcttcgattggattacagactatcaggggaaaaccgtttggtttgtgcctagcatcaaggctggaaacgacattgcgaactgcctgagaaagtctggcaaaaaggtcatccagctgtcccgcaaaacgttcgatacagaataccccaagaccaaactcacagactgggattttgtggtcaccacggacattagcgagatgggggccaatttcagagctggacgggtgatcgatccgcgcagatgtctgaagcctgttatccttaccgacggccccgaacgggtgattctggccgggcccatccctgtgacacccgcctctgctgcccaacgcagaggccggattggaagaaacctcgcgcaggaggatgaccagtatgtcttcagcggcgatcctctgaagaatgacgaagatcatgctcactggaccgaggccaaaatgctgctcgacaacatctacacaccggaggggattatccccaccctttttggacctgaacgcgagaagacacaggccattgatggcgaattccggctgagaggggagcaacgcaaaacctttgttgagctgatgcggagaggagacctccccgtgtggctgtcctataaggtggcttctgccggcatcagctacaaagaccgggaatggtgcttcacgggcgagcgcaataaccagatccttgaagagaatatggaagtcgagatttggacaagagagggggaaaagaagaaactgcggcctaagtggctcgatgcgcgcgtgtatgccgaccccatggctctgaaagattttaaggagttcgcctccggaagaaaatctatcaccctggacattctcaccgaaatcgctagccttccgacatacctgtccagccgggccaagctggctctcgataacattgttatgctgcataccacagagcgcggcgggagagcctaccagcacgcgcttaatgaactgcctgagtctctcgagacgctgatgctggtggccctccttggagctatgaccgccggcatctttctgttctttatgcaggggaagggaatcggcaaactgtccatgggcctcattacaatcgctgtcgccagcgggctgctttgggtggccgaaattcaaccccagtggatcgctgcgtccattatcctggagttctttctcatggtcctgctgatccctgaacccgagaagcagcggacccctcaggacaaccaactcatttatgtgatccttacaattctgaccatcattggactgatcgccgctaatgaaatgggcctcattgagaaaacgaagaccgatttcgggttttaccaggttaaaacagagaccacaatcctggacgtggatcttcgccccgcctctgcctggaccctgtatgctgtcgccacgacaatcctcaccccgatgctgagacacacaattgaaaacaccagcgcgaatctgtccctcgccgctatcgccaaccaggctgccgtgcttatgggactgggcaaggggtggcctctgcatcggatggacctcggagttcccctgcttgcgatgggctgttactctcaggtgaatcccaccacactgacggccagcctcgtcatgctgctggtgcactatgctattatcggccctgggctccaagccaaagctaccagagaggcccagaagcgcacagctgccggaattatgaagaacccgaccgtggatggcatcacagttatcgaccttgaacccatttcctacgatcctaaattcgagaagcagctggggcaagtcatgctgctcgtgctgtgcgcgggacagcttctgctcatgcggaccacgtgggccttctgtgaggtgctgacactggctaccggccccatcctcaccctttgggaagggaaccctggaagattttggaatacaaccattgccgtcagcacagctaacatcttccgcggctcttatctggccggcgccgggctggcgttttccctcattaaaaatgctcagacgccccggagaggaaccggcacaaccggggagacactgggagaaaagtggaaacgccagcttaacagcctggaccggaaggagttcgaagagtacaagagatctggcatcctcgaggttgaccgcaccgaagccaaatccgctctgaaggatgggagcaaaatcaagcatgccgtgtctcggggaagctccaaaattagatggatcgtggagcgcggcatggtcaagcctaagggcaaagtggttgacctggggtgcggacggggcgggtggtcttactatatggccacgctcaagaatgtgaccgaagtcaaaggatacacaaagggcgggccgggacacgaggaacccattcctatggctacctatggctggaaccttgtgaaactgcatagcggcgttgatgtgttttacaagcccacagagcaagtcgacaccctgctctgtgatatcggggagtccagctccaatcctacaattgaagagggaagaaccctgcgcgtgcttaagatggtggaaccctggctgtctagcaaaccggagttctgcatcaaggtcctcaacccttatatgcccacggttattgaagagctggagaaactgcagagaaagcacggcgggaatctcgtgcggtgtcccctttcccgcaactctacacacgaaatgtactgggtgagcggagcctccggcaatatcgtctctagcgtgaacaccacctccaaaatgctgctgaatagatttacaacgcggcatagaaagcctacctatgagaaagacgttgatctcggggcgggaacacggagcgtgtctaccgaaacagagaagcccgacatgaccatcattggccgcagactgcagcggcttcaggaggaacacaaggagacatggcattacgatcaagaaaacccttaccgcacctgggcctatcacggctcctacgaggctccgagcacggggtctgcctccagcatggtcaatggagtggttaaactgctcaccaagccctgggacgtgatccctatggtcacacagctggctatgaccgatacaacccccttcggccagcagagagtgtttaaagaaaaggttgacacgcggacacctcaacccaaaccggggacccgcatggtgatgacaaccacggccaactggctgtgggcgctcctgggaaagaagaaaaatcctagactttgcacccgggaggagttcatttctaaggtccgctccaacgccgctatcggcgccgtgtttcaggaagagcaggggtggacaagcgcttccgaagccgtcaacgacagcagattctgggagctggtggataaagaacgggctctccaccaagagggcaagtgtgagtcttgcgtttataatatgatgggaaaacgcgaaaagaagctgggcgagtttgggagagccaaaggaagccgggcgatttggtacatgtggcttggcgcccgcttcctggaattcgaggctctcgggtttctgaacgaagaccattggttcggaagagagaattcctggtctggcgtggagggggaaggcctgcaccggctcggatatatcctggaggaaatcgataagaaagacggcgatcttatgtacgccgacgataccgctgggtgggacacaagaattaccgaggatgacctgcagaacgaggaactcatcacagagcagatggccccccatcacaagattctggccaaagcgatctttaagcttacctatcagaataaggtcgtgaaagtgctgcgccctacgccccggggagctgttatggatattatcagcagaaaggaccaacgcggctccgggcaggtgggaacatacggcctcaacaccttcaccaatatggaagtccagctgatccggcagatggaggccgaaggggtgattacacaagatgacatgcagaaccctaaaggcctgaaggagagagttgagaaatggctccgcgaatgcggagtggaccggctgaagagaatggccatctctggcgatgactgtgtcgtgaaaccccttgatgagcgctttgggaccagcctgctcttcctgaatgacatgggaaaggtccggaaggatattccgcagtgggaaccttccaaaggctggaagaactggcaggaggtgcccttttgctctcatcacttccacaaaatctttatgaaggacgggagaagccttgttgtgccctgtcgcaatcaagatgaactgattggacgggctagaatctcccagggcgccgggtggagcctccgggagacagcttgcctgggcaaagcctacgcgcagatgtggtctctgatgtatttccatagacgcgacctccggctggcctccatggctatctgtagcgccgtccctacggagtggtttccgacctctagaacaacctggtccattcacgctcatcaccagtggatgacaaccgaagatatgcttaaggtgtggaaccgcgtttggatcgaggacaatcccaacatgattgataagacgcctgtgcacagctgggaagacatcccctacctgggaaaaagagaggacctctggtgcggctccctgattgggctttctagccgggccacctgggcgaagaatatccatacagccattacccaagtccgcaacctgatcggaaaagaagagtatgctgattacatgcctgtgatgaagagatattccgcccccagcgagtctgaaggcgtgctctga

SEQ ID NO: 21009 - RNA, 9867 nt, synthetic construct
  misc_feature 1..9867: note = derived and/or modified CDS sequence (opt5) from DENV-4__FJ882584__SS-prME
  source 1..9867: mol_type = other RNA
agcaccatcaccctgctgtgcctgattcccacggtgatggctttccacctttccaccagagacggagagcctctgatgatcgtcgctaagcatgaacgggggcgcccgctcctgtttaagaccaccgagggaattaacaagtgtacacttatcgccatggatctgggcgaaatgtgcgaggacaccgttacatacaagtgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccagcgcgtggagtcttggatccttagaaatcctggcttcgctctgctcgccggctttatggcttacatgatcgggcagacaggcattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctagcatttctaatatcaccacagccacccgctgcccgacgcaaggagagccctatcttaaggaggaacaggaccagcagtacatttgtagacgggatgtggtggaccgcggctgggggaacggatgcggcctgttcgggaaaggaggcgtcgtgacatgcgcgaagttttcctgtagcggcaaaatcaccgggaatctcgttcaaattgagaacctggaatataccgtggtcgtgacagttcataatggagatacccacgccgtgggcaacgacacatctaatcacggggtcacggctaccatcacacctagatcccccagcgtggaggtcaaacttcctgattacggagaactgaccctcgactgcgagccccggtctggcatcgacttcaacgagatgattctgatgaagatgaaaaagaaaacatggctggtgcataagcagtggtttctcgatctgccgcttccttggaccacgggggccgacacctccgaagttcactggaattacaaagagagaatggtgacattcaaggtcccccatgctaaacgccaggatgtgaccgttctgggcagccaggaaggagccatgcactccgccctcgctggcgcgacagaggtggactctggggatggaaaccacatgtttgccggccatctgaagtgtaaggtccggatggaaaaacttagaatcaaggggatgagctataccatgtgctccggaaaattcagcattgacaaggagatggctgagacgcaacacggcacaaccgtggtgaaagttaagtacgaaggggccggcgccccttgtaaggtccccatcgagattcgcgatgtgaataaagaaaaggtggtcggacgggtgatctctgctacacccctggccgagaacaccaactccgttaccaatatcgagctcgaacctccgttcggcgacagctatattgtgatcggggtcggaaactctgcgctgacactgcattggtttagaaaaggcagctccattgggaagatgttcgagtctacgtaccgcggagctaaacggatggccatcctcggcgaaaccgcctgggattttgggagcgtgggcggactgttcacatcccttggcaaggctgttcaccaggtgtttgggagcgtctataccacaatgttcggaggcgtgtcttggatgattagaatcctgatcgggtttctcgttctgtggattggaaccaattcccgcaacacgagcatggccatgacatgcatcgctgtgggcgggattaccctgttccttggctttaccgtccaggccgacatgggatgtgtggtgtcttggtccggccgggagctcaagtgcgggagcggaatcttcgtcgttgataatgtgcatacatggaccgaacaatacaaatttcagcccgagtcccctgcgagactggcctctgctattctgaacgcccacaaggacggcgtgtgtgggatccgcagcacaacgcggctcgagaatgtcatgtggaaacagattaccaacgaactgaattatgtgctttgggagggaggccacgacctgacagttgtggctggcgatgtcaagggggtgctcaccaaaggaaagagagccctgacaccccctgcgtccgacctgaagtactcttggaaaacctggggcaaggccaaaatcttcacgcccgaagctcggaacagcacctttcttatcgatgggccggacacatccgagtgccctaatgaacgcagagcctggaacagcttcgaggttgaggattacggattcggcatgtttaccacaaatatttggatgaagttccgggaagggtcttccgaggtgtgtgaccatagactcatgagcgctgccatcaaagatcagaaggccgtccacgctgacatgggatattggattgaatcttccaaaaaccaaacctggcagatcgagcgcgcgagcctgattgaagtgaagacatgcctgtggcccaagacccatacgctctggtctaatggcgttctggagagccagatgcttatccctaaatcctacgccggcccctttagccagcacaactatcggcaagggtacgctacacagaccgtgggaccttggcacctgggcaagctcgagatcgatttcggggaatgccccggaaccacagtcaccattcaggagaactgtgaccatagaggcccgtctctgcgcacgacaaccgcctccgggaaactggtgacacagtggtgctgtagaagctgcaccatgcctccccttcggtttctcggagaagatggctgttggtatggcatggagatccgccccctgtccgagaaggaagagaatatggtgaaatctcaagtcacagccgggcagggaaccagcgaaacgttctccatgggcctgctctgcctgaccctttttgttgaggaatgtctgagacggcgcgtgacaagaaagcacatgattctcgctgtggtcatcaccctgtgcgccattatcctcggcgggcttacatggatggacctcctgcgggcgctgatcatgctcggggataccatgtctgggcgcattggaggccagacgcatctggctatcatggccgtgttcaagatgagccctggctacgttcttggggtgtttctgagaaaactcacatcccgggagaccgccctgatggtcattggaatggctatgacaaccaccctgtctatcccgcacgaccttatggagctgattgacggcatcagcctcgggctgatcctcctgaagattgtgacacagttcgataacacgcaagttggaacccttgccctgtccctcacatttatccgcagcaccatgtctctggtgatggcgtggagaacaattatggctgtcctgttcgtggtcacccttatccccctgtgtcggacgtcctgcctccagaaacagagccattgggtggaaattacagccctgatcctcggcgcccaagctctgcctgtttatcttatgaccctgatgaagggggcctctagacgctcctggcccctcaatgagggaattatggctgtgggcctggtcagcctgcttggctctgccctgctcaaaaacgacgtgcctctggcggggcccatggttgccggaggcctcctgcttgctgcctacgtgatgtccgggagctccgctgatctgagcctggaaaaggccgccaatgtccagtgggacgagatggctgatatcaccggatctagccctatcattgaagtgaagcaggacgaggatggctccttttctatccgggacgtggaggaaacaaacatgattaccctcctggttaaacttgcgctgatcacagtcagcgggctctaccccctggccattccgatcacgatgaccctctggtatatgtggcaagtgaagacacaaagatccggagctctgtgggatgtgccttctcccgccgccacccagaaagctgcccttagcgagggcgtctaccgcatcatgcagcggggcctgttcgggaagacacaggtgggagttggcattcacatggaaggggtgttccacaccatgtggcatgtcacgagaggatccgtgatctgtcacgagaccggccgcctggaaccttcttgggcggacgttcggaatgatatgattagctatgggggaggctggagactcggcgacaaatgggataaggaggaggacgtgcaagtcctggctatcgaacccgggaagaacccgaaacatgtgcagacaaagcctggactttttaaaaccctgacaggcgagattggggccgttaccctcgacttcaagcccggaacatccggcagccctatcatcaatcgcaaagggaaggtgattggcctgtacggaaacggcgtcgtgacgaaatctggggattatgtgtccgccatcacccaggctgaacggattggagagcccgactacgaggtcgatgaagacatctttagaaagaagcggctcacaattatggatctgcaccccggcgccgggaaaaccaagcgcatccttcctagcattgttagagaggcgctgaaacggcgcctgagaaccctcatcctggctccgacacgggtggtggccgccgaaatggaggaagctcttagaggactgcccatccgctatcagacgcctgccgtcaagtctgagcataccggccgggagattgtggacctcatgtgccacgctacattcaccacaagactgctctccagcacccgcgttcccaattacaacctgatcgtgatggatgaagcccactttacggacccttcctctgtcgcggcccgggggtacattagcacaagagtggagatgggcgaagctgccgctatcttcatgaccgccacaccccctggagccacagatccgtttccccaatccaatagccctattgaggacatcgaacgcgagatccccgagcggtcttggaacaccggcttcgattggattacagactatcaggggaaaaccgtttggtttgtgccttccatcaaggctggaaatgacattgcgaactgccttagaaagagcggcaaaaaggtcatccagctgtctcgcaaaacgttcgatacagaataccccaagaccaaactgacagactgggattttgtggtcaccacggacattagcgagatgggggccaacttcagagctggacgggtgatcgatccgcgcagatgtctcaagcctgttatcctgaccgacggccccgaacgggtgattcttgccgggcccatccctgtgacacccgcctccgctgcccaacgcagaggccggattggaagaaatcctgcgcaggaggatgaccagtatgtcttctctggcgatccgctgaagaacgacgaagatcatgctcactggaccgaggccaaaatgctcctggacaatatctacacacccgaggggattatccctaccctgtttggacccgaacgcgagaagacacaggccattgatggcgagttccggctcagaggggagcaacgcaaaacctttgttgagcttatgcggagaggagacctgcctgtgtggctgagctataaggtggcttccgccggcatctcttacaaagaccgggaatggtgcttcacgggcgagcgcaacaatcagatcctcgaagagaacatggaagtcgagatttggacaagagagggggaaaagaagaaactgcggcccaagtggcttgatgcgcgcgtgtatgccgacccgatggctctgaaagattttaaggagttcgccagcggaagaaaatccatcaccctcgacattctgaccgaaatcgctagcctgcctacatacctctcttcccgggccaaacttgctctggataatattgttatgctgcataccacagagcgcggcgggagagcctaccagcacgcgctcaacgaactgcccgagagccttgagacgctgatgctcgtggccctgctgggagctatgaccgccggcatctttctcttctttatgcaggggaagggaatcggcaaactttccatgggcctgattacaatcgctgtcgcctctgggctgctctgggtggccgaaattcaacctcagtggatcgctgcgagcattatcctggagttctttcttatggtcctgctcatccccgaacctgagaagcagcggacaccccaggacaatcaactgatttatgtgatcctgacaattctcaccatcattggacttatcgccgctaacgaaatgggcctgattgagaaaacgaagaccgatttcgggttttaccaggttaaaacagagaccacaatcctggacgtggatctccgcccggcctccgcctggaccctgtatgctgtcgccacgacaatccttacccctatgctgagacacacaattgaaaatacctctgcgaacctcagcctggccgctatcgccaatcaggctgccgtgctgatgggactcggcaaggggtggccccttcatcggatggacctgggagttcccctgctcgcgatgggctgttactcccaggtgaaccctaccacactgacggccagccttgtcatgctgctcgtgcactatgctattatcggcccggggctgcaagccaaagctaccagagaggcccagaagcgcacagctgccggaattatgaagaatcccaccgtggatggcatcacagttatcgacctggaacctatttcttacgatcccaaattcgagaagcagctcgggcaagtcatgcttctggtgctgtgcgcgggacagctcctgcttatgcggaccacgtgggccttctgtgaggtgctgacactcgctaccggccctatcctgaccctgtgggaagggaaccccggaagattttggaacacaaccattgccgtctccacagctaatatcttccgcggcagctatctcgccggcgccgggcttgcgttttctctgattaaaaacgctcagacgcctcggagaggaaccggcacaaccggggagacactgggagaaaagtggaaacgccagctcaattccctggaccggaaggagttcgaagagtacaagagaagcggcatccttgaggttgaccgcaccgaagccaaatctgctctgaaggatgggagcaaaatcaagcatgccgtgtcccggggatctagcaaaattagatggatcgtggagcgcggcatggtcaagccgaagggcaaagtggttgacctcgggtgcggacggggcgggtggtcctactatatggccacgctgaagaacgtgaccgaagtcaaaggatacacaaagggcgggcccggacacgaggaacctattcccatggctacctatggctggaatctggtgaaactccatagcggcgttgatgtgttttacaagcctacagagcaagtcgacacccttctgtgtgatatcggggagtcctctagcaaccccacaattgaagagggaagaaccctgcgcgtgctcaagatggtggaaccgtggctgtcctctaaacctgagttctgcatcaaggtccttaatccctatatgcccacggttattgaagaactggagaaactccagagaaagcacggcgggaacctggtgcggtgtcctctgagccgcaattccacacacgaaatgtactgggtgtctggagccagcggcaacatcgtctccagcgtgaataccacctctaaaatgctccttaacagatttacaacgcggcatagaaagcccacctatgagaaagacgttgatctgggggcgggaacacggtccgtgagcaccgaaacagagaagcctgacatgaccatcattggccgcagactgcagcggctccaggaggaacacaaggagacatggcattacgatcaagaaaatccgtaccgcacctgggcctatcacggctcttacgaggctccctccacggggagcgcctcttccatggtcaacggagtggttaaactgcttaccaagccttgggacgtgatccccatggtcacacagctggctatgaccgatacaacccctttcggccagcagagagtgtttaaagaaaaggttgacacgcggacaccccaaccgaaacctgggacccgcatggtgatgacaaccacggccaattggctctgggcgctgctgggaaagaagaaaaaccccagactctgcacccgggaggagttcattagcaaggtccgctccaatgccgctatcggcgccgtgtttcaggaagaacaggggtggacaagcgcttctgaagccgtcaacgacagcagattctgggagctggtggataaagaacgggcccttcaccaagagggcaagtgtgagtcctgcgtttataacatgatgggaaaacgcgaaaagaagctgggcgagtttgggagagccaaaggatctcgggcgatttggtacatgtggctcggcgcccgcttcctggagttcgaggctcttgggtttctgaatgaagaccattggttcggaagagagaacagctggtccggcgtggagggggaaggcctccaccggctgggatatatcctggaggaaatcgataagaaagacggcgatctcatgtacgccgacgataccgctgggtgggacacaagaattaccgaggatgacctgcagaatgaggaacttatcacagagcagatggcccctcatcacaagattctggccaaagcgatctttaagctcacctatcagaacaaggtcgtgaaagtgctgcgccccacgcctcggggagctgttatggatattatctctagaaaggaccaacgcggcagcggacaggtgggaacatacggccttaataccttcaccaacatggaagtccagctgatccggcagatggaggccgaaggggtgattacacaagatgacatgcagaatcccaaaggcctcaaggagagagttgagaaatggctgcgcgaatgcggagtggaccggctgaagagaatggccatctccggcgatgactgtgtcgtgaaaccgctcgatgagcgctttgggacctctctgcttttcctgaacgacatgggaaaggtccggaaggatattcctcagtgggaacccagcaaaggctggaagaattggcaggaggtgcccttttgctcccatcacttccacaaaatctttatgaaggacgggagaagcctcgttgtgccttgtcgcaaccaagatgaactgattggacgggctagaatctctcagggcgccgggtggtcccttcgggagacagcttgcctgggcaaagcctacgcgcagatgtggagcctcatgtatttccatagacgcgacctgcggctggcctctatggctatctgttccgccgtcccgacggagtggtttcccaccagcagaacaacctggtccattcacgctcatcaccagtggatgacaaccgaagatatgctcaaggtgtggaatcgcgtttggatcgaggacaaccctaatatgattgataagacgcccgtgcactcttgggaagacatcccttacctgggaaaaagagaggacctttggtgcggcagcctgattgggctctccagccgggccacctgggcgaagaacatccatacagccattacccaagtccgcaatctgatcggaaaagaagagtatgtggattacatgcccgtgatgaagagatattctgctccttccgagagcgaaggcgttctttga

SEQ ID NO: 21010 - RNA, 9867 nt, synthetic construct
  misc_feature 1..9867: note = derived and/or modified CDS sequence (opt5) from DENV-4__FJ882585__SS-prME
  source 1..9867: mol_type = other RNA
agcaccatcacactgctctgcctgattcccacggtgatggccttccacctttccaccagagacggcgagcctctgatgatcgtcgctaagcatgaacgggggcgcccgctcctgtttaaaacaaccgagggaattaacaagtgtacacttatcgccatggatctgggcgaaatgtgcgaggacaccgttacatacaaatgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggatccttagaaatcctggcttcgctctgctcgccggctttatggcttacatgatcgggcagacaggaattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctcttattagcaatatcaccacagccacccgctgcccgacgcaaggagagccctatctgaaggaggaacaggaccagcagtacatttgtagacgggatgtggtggaccgcggctgggggaacggatgcggcctcttcgggaaaggaggcgtcgtgacatgcgcgaagttttcttgttccggcaaaatcaccgggaatctggttcaaattgagaaccttgaatataccgtggtcgtgacagttcataatggagatacccacgccgtgggcaacgacacaagcaatcacggggtcacggctaccatcacacctagatctccctccgtggaggtcaagctgcctgattacggagaactcaccctggactgcgagccccggagcggcatcgacttcaacgagatgattctgatgaagatgaaaaagaaaacatggctcgtgcataagcagtggtttctggatcttccgctgccttggaccacgggggccgacacctctgaagttcactggaattacaaagagagaatggtgacattcaaggtcccccatgctaaacgccaggatgtgaccgttctcggctcccaggaaggagccatgcacagcgccctggctggcgcgacagaggtggactccggggatggaaaccacatgtttgccggccatcttaagtgtaaggtccggatggaaaaactgagaatcaaggggatgtcttataccatgtgcagcggaaaattctccattgacaaggagatggctgagacgcaacacggcacaaccgtggtgaaagttaagtacgaaggggccggcgccccttgtaaggtccccatcgagattcgcgatgtgaataaagaaaaggtggtcggacgggtgatcagcgctacacccctcgccgagaacaccaactctgttaccaatatcgagctggaacctccgttcggcgactcctatattgtgatcggggtcggaaacagcgcgctgacactccattggtttagaaaaggctctagcattgggaagatgttcgagtccacgtaccgcggagctaaacggatggccatcctgggcgaaaccgcctgggattttgggtctgtgggcggacttttcacaagcctgggcaaggctgttcaccaggtgtttgggtccgtctataccacaatgttcggaggcgtgagctggatgattagaatcctcatcgggtttctggttctgtggattggaaccaattctcgcaacacgtccatggccatgacatgcatcgctgtgggcgggattacccttttcctcggctttaccgtccaggccgacatgggatgtgtggtgagctggtctggccgggagctgaagtgcgggtccggaatcttcgtcgttgataatgtgcatacatggaccgaacaatacaaatttcagcccgagagccctgcgagactggcctccgctattctcaacgcccacaaggacggcgtgtgtgggatccgctctacaacgcggctggagaatgtcatgtggaaacagattaccaacgaacttaattatgtgctgtgggagggaggccacgacctcacagttgtggctggcgatgtcaagggggtgctgaccaaaggaaagagagccctgacaccccctgcgagcgaccttaagtactcctggaaaacctggggcaaggccaaaatcttcacgcccgaagctcggaactctacctttctcatcgatgggccggacacaagcgagtgccctaatgaacgcagagcctggaactccttcgaggttgaggattacggattcggcatgtttaccacaaatatttggatgaagttccgggaagggagctctgaggtgtgtgaccatagactgatgtccgctgccatcaaagatcagaaggccgtccacgctgacatgggatattggattgaaagctctaaaaaccaaacctggcagatcgagcgcgcgtccctgattgaagtgaagacatgcctctggcccaagacccatacgctgtggagcaatggcgttcttgagtctcagatgctgatccctaaaagctacgccggccccttttcccagcacaactatcggcaagggtacgctacacagaccgtgggaccttggcacctcggcaagctggagatcgatttcggggaatgccccggaaccacagtcaccattcaggagaactgtgaccatagaggcccgagcctgcgcacgacaaccgcctctgggaaacttgtgacacagtggtgctgtagatcctgcaccatgcctcccctccggtttctgggagaagatggctgttggtatggcatggagatccgccccctgagcgagaaggaagagaatatggtgaaatcccaagtcacagccgggcagggaacctctgaaacgttcagcatgggcctcctgtgccttaccctgtttgttgaggaatgtctcagacggcgcgtgacaagaaagcacatgattctggctgtggtcatcaccctgtgcgccacaattcttgggggactcacctggatggacctgctgcgggcgctcatcatgctgggcgatacgatgtccgggcgcatcggaggccagacacatcttgctattatggccgtgttcaagatgtctcctggctacgttctgggggtgtttctcagaaaactgaccagccgggagacagccctgatggtcatcggaatggctatgaccaccacactttccattccgcacgacctgatggagctcatcgacggcatttctctggggctcatcctgcttaagatcgtgacgcagttcgataacacccaagttggaacactggccctcagcctgacctttattcgctccacaatgagcctggtgatggcgtggagaaccatcatggctgtccttttcgtggtcacgctgattcccctctgtcggacatcttgcctgcagaaacagtcccattgggtggaaatcaccgccctcattctgggcgcccaagctcttcctgtttatctgatgaccctcatgaagggggccagcagacgctcttggcccctgaatgagggaatcatggctgtgggcctggtctcccttctgggcagcgccctcctgaaaaacgacgtgcctctcgcggggcccatggttgccggaggcctgcttctggctgcctacgtgatgtctgggtccagcgctgatctgtccctcgaaaaggccgccaatgtccagtgggacgagatggctgcgattacaggaagctctcctatcatcgaagtgaagcaggatgaggacggcagcttttccattcgggatgtggaggaaaccaacatgatcacactgcttgttaaactggccctcattacggtctctgggctgtaccccctcgctatcccgattaccatgacactgtggtatatgtggcaggtgaagacccaaagaagcggagccctttgggacgtgccttcccccgccgctacacagaaagccgcgctgtctgagggcgtctaccgcatcatgcagcggggcctgttcgggaagacccaggtgggagttggcatccacatggaaggggtgttccacacgatgtggcatgtcaccagaggaagcgtgatttgtcacgagacaggccgcctcgaaccttcctgggctgatgttcggaatgacatgatctcttatgggggaggctggagactgggcgataaatgggacaaggaggaggatgtgcaagtccttgccattgaacccgggaagaacccgaaacatgtgcagaccaagcctggactgtttaaaacactcaccggcgagatcggggccgttacactggacttcaagcccggaacgagcggctcccctattatcaatcgcaaagggaaggtgatcggcctctacggaaacggcgtcgtgaccaaaagcggggactatgtgtctgctattacacaggccgaacggatcggagagcccgattacgaggtcgacgaagatatttttagaaagaagcggctgaccatcatggaccttcaccccggcgcggggaaaaccaagcgcattctgccttccatcgttagagaggctctgaaacggcgcctcagaacactgattcttgccccgacgcgggtggtggccgctgaaatggaggaagccctgagaggactccccatccgctatcagacccctgctgtcaagagcgagcatacaggccgggagatcgtggatctgatgtgccacgccaccttcacaaccagactcctgtcttccacgcgcgttcccaattacaaccttattgtgatggacgaagcgcactttacagatcctagctccgtcgccgctcgggggtacatctctaccagagtggagatgggcgaagccgctgccattttcatgaccgccacaccccctggagctaccgacccgtttccccaaagcaattcccctatcgaggatattgaacgcgagatccccgagcggagctggaacacaggcttcgactggatcaccgattatcaggggaaaacggtttggtttgtgccttctattaaggcgggaaatgacatcgccaactgcctgagaaagtccggcaaaaaggtcattcagctgagccgcaaaacattcgacaccgaataccccaagacaaaactcaccgattgggactttgtggtcacgaccgatatctctgagatgggggctaacttcagagccggacgggtgattgacccgcgcagatgtctgaagcctgttatccttacagatggccccgaacgggtgatcctggccgggcccattcctgtgacccccgctagcgccgcgcaacgcagaggccggatcggaagaaatcctgctcaggaggacgatcagtatgtcttctccggcgacccgctcaagaacgatgaagaccatgcccactggacagaggccaaaatgctgctggataatatttacacccccgaggggatcattcctacactctttggacccgaacgcgagaagacccaggctatcgacggcgaattccggcttagaggggagcaacgcaaaacgtttgttgagctgatgcggagaggagatctgcctgtgtggctctcttataaggtggccagcgcgggcatttcctacaaagaccgggaatggtgcttcacaggcgagcgcaacaatcagatcctggaagagaacatggaagtcgagatctggaccagagagggggaaaagaagaaacttcggcccaagtggctggacgcccgcgtgtatgctgatccgatggccctcaaagactttaaggagttcgcttctggaagaaaaagcaccacactggatattctgaccgaaatcgcctccctccctacataccttagctctcgggctaagctggccctggacaatattgttatgctccatacgaccgagcgcggcgggagagcgtaccagcacgccctgaacgaacttcccgagtccctggagacactcatgctggtggctctgctcggagccatgaccgctggcatctttcttttctttatgcaggggaagggaattggcaaactgagcatgggcctgatcacaatcgccgtcgcctccgggctcctgtgggtggctgaaattcaacctcagtggatcgcggcctctattatccttgagttctttctgatggtcctcctgattcccgaacctgagaagcagcggaccccccaggataatcaactgatctatgtgatcctcacgattcttaccatcattggactgatcgctgccaacgaaatgggcctgattgagaaaacaaagaccgacttcgggttttaccaggttaaaacagagaccacgatcctcgatgtggacctgcgcccggccagcgcttggacactttatgccgtcgcgaccacaattctgacccctatgctcagacacaccatcgaaaatacatccgccaacctgtctctggctgccatcgctaatcaggccgcggtgctcatgggacttggcaaggggtggcccctgcatcggatggatctgggagttcccctcctggccatgggctgttacagccaggtgaaccctacgacccttacagcttccctggtcatgctcctggtgcactatgccattatcggcccggggctgcaagctaaagccaccagagaggctcagaagcgcacagccgcgggaattatgaagaatcccaccgtggacggcatcacggttattgatctcgaacctatcagctacgaccccaaattcgagaagcagcttgggcaagtcatgctgctggtgctctgcgccggacagctgcttctgatgcggacaacctgggctttctgtgaggtgctcaccctggccacaggccctatcctgaccctctgggaagggaaccccggaagattttggaacacaacgattgctgtctctaccgccaatatcttccgcggctcctatcttgccggcgcggggctggcttttagcctgattaaaaacgcccagacacctcggagaggaaccggcacaaccggggagacgctcggagaaaagtggaaacgccagctgaattctcttgatcggaaggagttcgaagagtacaagagatccggcatcctggaggttgaccgcaccgaagctaaaagcgccctcaaggacgggtctaaaattaagcatgccgtgagccggggatcctctaaaatcagatggatcgtggagcgcggcatggtcaagccgaagggcaaagtggttgatctggggtgcggacggggcgggtggagctactatatggctacactgaagaacgtgaccgaagtcaaaggatacacaaagggcgggcccggacacgaggaacctattcccatggccacctatggctggaatctcgtgaaacttcattccggcgttgacgtgttttacaagcctacagagcaagtcgataccctgctgtgtgacatcggggagagctcctctaaccccacgattgaagagggaagaacactccgcgtgctgaagatggtggaaccgtggcttagctccaaacctgagttctgcatcaaggtcctgaatccctatatgcccaccgttattgaagagctcgagaaactgcagagaaagcacggcgggaacctggtgcggtgtcctctctctcgcaatagcacccacgaaatgtactgggtgtccggagcgtctggcaacatcgtcagctccgtgaatacaacgagcaaaatgcttctgaacagatttaccacacggcatagaaagcccacctatgagaaagatgttgacctgggggccggaacacggtctgtgtccaccgaaacagagaagcctgatatgaccattatcggccgcagactccagcggctgcaggaggaacacaaggagacgtggcattacgaccaagaaaatccgtaccgcacctgggcttatcacggcagctacgaggccccctctacagggtccgctagctctatggtcaacggagtggttaaacttctgaccaagccttgggatgtgatccccatggtcacacagctcgccatgaccgacacgacacctttcggccagcagagagtgtttaaagaaaaggttgatacccggacaccccaaccgaaacctgggacccgcatggtgatgacgaccacagcgaattggctgtgggccctgctcggaaagaagaaaaaccccagactgtgcaccaaggaggagttcatttccaaagtccggagcaatgctgccatcggcgctgtgtttcaggaagagcaggggtggacatccgccagcgaagctgtcaacgactctcgcttctgggagcttgtggacaaggaaagagccctgcaccaagagggcaaatgtgagagctgcgtttataacatgatgggaaagcgggaaaagaaactcggcgagtttgggcgcgcgaagggatccagagccatttggtacatgtggctgggcgctcggttccttgaattcgaggccctggggtttctcaatgaagatcattggttcggacgcgagaactcttggagcggcgtggagggggaaggcctgcacagactgggatatatcctcgaggaaattgacaaaaaggatggcgacctgatgtacgctgatgacaccgccgggtgggatacacggatcaccgaggacgatcttcagaatgaggaactgatcacggagcagatggcccctcatcacaaaattctcgcgaaggctatctttaagctgacatatcagaacaaagtcgtgaaggtgcttagacccacccctcgcggagccgttatggacattatctcccggaaagatcaaagaggctctgggcaggtgggaacctacggcctgaatacattcaccaacatggaagtccagctcattcgccagatggaggccgaaggggtgatcacacaagacgatatgcagaatcccaagggcctgaaagagcgggttgagaagtggctgagagaatgcggagtggaccgcctcaaacggatggctatcagcggcgacgattgtgtcgtgaagccgctggacgagagatttgggacgtcccttctgttcctcaacgatatgggaaaggtccgcaaagacattcctcagtgggaaccctctaagggctggaaaaattggcaggaggtgcccttttgcagccatcacttccacaagatctttatgaaagatgggcggtccctggttgtgccttgtagaaaccaagacgaacttattggacgcgcccggatcagccagggcgctgggtggtctctgagagagaccgcctgcctcggcaaggcgtacgcccagatgtggtccctgatgtatttccatcggagagatctgcgcctcgctagcatggccatttgttctgctgtcccgacagagtggtttcccacctcccggacaacctggagcatccacgcccatcaccagtggatgacgaccgaagacatgctgaaggtgtggaatagagtttggatcgaggataaccctaatatgacagacaaaacccccgtgcactcctgggaagatattccttaccttggaaagcgcgaggacctgtggtgcggctctctcatcgggctgagctccagagcgacatgggccaaaaacattcataccgctatcacgcaagtccggaatcttattggaaaggaagagtatgtggactacatgcccgtgatgaaacgctatagcgccccttctgagtccgaaggcgttctgtga

SEQ ID NO: 21011 - RNA, 9867 nt, synthetic construct
  misc_feature 1..9867: note = derived and/or modified CDS sequence (opt5) from DENV-4__FJ882586__SS-prME
  source 1..9867: mol_type = other RNA
agcaccatcacactgctctgcctgattcccacggtgatggccttccacctttccaccagagacggcgagcctctgatgatcgtcgctaagcatgaacgggggcgcccgctcctgtttaaaacaaccgagggaattaacaagtgtacacttatcgccatggatctgggcgaaatgtgcgaggacaccgttacatacaaatgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggatccttagaaatcctggcttcgctctgctcgccggctttatggcttacatgatcgggcagacaggaattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctcttattagcaatatcaccacagccacccgctgcccgacgcaaggagagccctatctgaaggaggaacaggaccagcagtacatttgtagacgggatgtggtggaccgcggctgggggaacggatgcggcctcttcgggaaaggaggcgtcgtgacatgcgcgaagttttcttgttccggcaaaatcaccgggaatctggttcaaattgagaaccttgaatataccgtggtcgtgacagttcataatggagatacccacgccgtgggcaacgacacaagcaatcacggggtcacggctaccatcacacctagatctccctccgtggaggtcaagctgcctgattacggagaactcaccctggactgcgagccccggagcggcatcgacttcaacgagatgattctgatgaagatgaaaaagaaaacatggctcgtgcataagcagtggtttctggatcttccgctgccttggaccacgggggccgacacctctgaagttcactggaattacaaagagagaatggtgacattcaaggtcccccatgctaaacgccaggatgtgaccgttctcggctcccaggaaggagccatgcacagcgccctggctggcgcgacagaggtggactccggggatggaaaccacatgtttgccggccatcttaagtgtaaggtccggatggaaaaactgagaatcaaggggatgtcttataccatgtgcagcggaaaattctccattgacaaggagatggctgagacgcaacacggcacaaccgtggtgaaagttaagtacgaaggggccggcgccccttgtaaggtccccatcgagattcgcgatgtgaataaagaaaaggtggtcggacgggtgatcagcgctacacccctcgccgagaacaccaactctgttaccaatatcgagctggaacctccgttcggcgactcctatattgtgatcggggtcggaaacagcgcgctgacactccattggtttagaaaaggctctagcattgggaagatgttcgagtccacgtaccgcggagctaaacggatggccatcctgggcgaaaccgcctgggattttgggtctgtgggcggacttttcacaagcctgggcaaggctgttcaccaggtgtttgggtccgtctataccacaatgttcggaggcgtgagctggatgattagaatcctcatcgggtttctggttctgtggattggaaccaattctcgcaacacgtccatggccatgacatgcatcgctgtgggcgggattacccttttcctcggctttaccgtccaggccgacatgggatgtgtggtgagctggtctggccgggagctgaagtgcgggtccggaatcttcgtcgttgataatgtgcatacatggaccgaacaatacaaatttcagcccgagagccctgcgagactggcctccgctattctcaacgcccacaaggacggcgtgtgtgggatccgctctacaacgcggctggagaatgtcatgtggaaacagattaccaacgaacttaattatgtgctgtgggagggaggccacgacctcacagttgtggctggcgatgtcaagggggtgctgaccaaaggaaagagagccctgacaccccctgcgagcgaccttaagtactcctggaaaacctggggcaaggccaaaatcttcacgcccgaagctcggaactctacctttctcatcgatgggccggacacaagcgagtgccctaatgaacgcagagcctggaactccttcgaggttgaggattacggattcggcatgtttaccacaaatatttggatgaagttccgggaagggagctctgaggtgtgtgaccatagactgatgtccgctgccatcaaagatcagaaggccgtccacgctgacatgggatattggattgaaagctctaaaaaccaaacctggcagatcgagcgcgcgtccctgattgaagtgaagacatgcctctggcccaagacccatacgctgtggagcaatggcgttcttgagtctcagatgctgatccctaaaagctacgccggccccttttcccagcacaactatcggcaagggtacgctacacagaccgtgggaccttggcacctcggcaagctggagatcgatttcggggaatgccccggaaccacagtcaccattcaggagaactgtgaccatagaggcccgagcctgcgcacgacaaccgcctctgggaaacttgtgacacagtggtgctgtagatcctgcaccatgcctcccctccggtttctgggagaagatggctgttggtatggcatggagatccgccccctgagcgagaaggaagagaatatggtgaaatcccaagtcacagccgggcagggaacctctgaaacgttcagcatgggcctcctgtgccttaccctgtttgttgaggaatgtctcagacggcgcgtgacaagaaagcacatgattctggctgtggtcatcaccctgtgcgccattatccttgggggactcacatggatggacctgctgcgggcgctcatcatgctgggcgataccatgtccgggcgcattggaggccagacgcatcttgctatcatggccgtgttcaagatgtctcctggctacgttctgggggtgtttctcagaaaactgacaagccgggagaccgccctgatggtcattggaatggctatgacaaccaccctttccatcccgcacgacctgatggagctcattgacggcatctctctggggctcatcctgcttaagattgtgacacagttcgataacacgcaagttggaaccctggccctcagcctgacatttatccgctccaccatgagcctggtgatggcgtggagaacaattatggctgtccttttcgtggtcaccctgatccccctctgtcggacgtcttgcctgcagaaacagtcccattgggtggaaattacagccctcatcctgggcgcccaagctcttcctgtttatctgatgaccctcatgaagggggccagcagacgctcttggcccctgaatgagggaattatggctgtgggcctggtctcccttctgggcagcgccctcctgaaaaacgacgtgcctctcgcggggcccatggttgccggaggcctgcttctggctgcctacgtgatgtctgggtccagcgctgatctgtccctcgaaaaggccgccaatgtccagtgggacgagatggctgatatcaccggaagctctcctatcattgaagtgaagcaggacgaggatggcagcttttccatccgggacgtggaggaaacaaacatgattaccctgcttgttaaactggcgctcatcacagtctctgggctgtaccccctcgccattccgatcacgatgaccctgtggtatatgtggcaggtgaagacacaaagaagcggagctctttgggatgtgccttcccccgccgccacccagaaagctgccctgtctgagggcgtctaccgcatcatgcagcggggcctgttcgggaagacacaggtgggagttggcattcacatggaaggggtgttccacaccatgtggcatgtcacgagaggaagcgtgatctgtcacgagaccggccgcctcgaaccttcctgggcggacgttcggaatgatatgatttcttatgggggaggctggagactgggcgacaaatgggataaggaggaggacgtgcaagtccttgctatcgaacccgggaagaacccgaaacatgtgcagacaaagcctggactgtttaaaaccctcacaggcgagattggggccgttaccctggacttcaagcccggaacaagcggctcccctatcatcaatcgcaaagggaaggtgattggcctctacggaaacggcgtcgtgacgaaaagcggggattatgtgtctgccatcacccaggctgaacggattggagagcccgactacgaggtcgatgaagacatctttagaaagaagcggctgacaattatggatcttcaccccggcgccgggaaaaccaagcgcatcctgccttccattgttagagaggcgctgaaacggcgcctcagaaccctgatccttgctccgacacgggtggtggccgccgaaatggaggaagctctgagaggactccccatccgctatcagacgcctgccgtcaagagcgagcataccggccgggagattgtggacctgatgtgccacgctacattcaccacaagactcctgtcttccacccgcgttcccaattacaaccttatcgtgatggatgaagcccactttacggaccctagctccgtcgcggcccgggggtacatttctacaagagtggagatgggcgaagctgccgctatcttcatgaccgccaccccccctggagccacagatccgtttccccaaagcaattcccctattgaggacatcgaacgcgagatccccgagcggagctggaacaccggcttcgattggattacagactatcaggggaaaaccgtttggtttgtgccttctatcaaggctggaaatgacattgcgaactgcctgagaaagtccggcaaaaaggtcatccagctgagccgcaaaacgttcgatacagaataccccaagaccaaactcacagactgggattttgtggtcaccacggacatttctgagatgggggccaacttcagagctggacgggtgatcgatccgcgcagatgtctgaagcctgttatccttaccgacggccccgaacgggtgattctggccgggcccatccctgtgacacccgccagcgctgcccaacgcagaggccggattggaagaaatcctgcgcaggaggatgaccagtatgtcttctccggcgatccgctcaagaacgacgaagatcatgctcactggaccgaggccaaaatgctgctggacaatatctacacacccgaggggattatccctaccctctttggacccgaacgcgagaagacacaggccattgatggcgaattccggcttagaggggagcaacgcaaaacctttgttgagctgatgcggagaggagacctgcctgtgtggctctcttataaggtggctagcgccggcatctcctacaaagaccgggaatggtgcttcacgggcgagcgcaacaatcagatcctggaagagaacatggaagtcgagatttggacaagagagggggaaaagaagaaacttcggcccaagtggctggatgcgcgcgtgtatgccgacccgatggctctcaaagattttaaggagttcgcctctggaagaaaaagcatcaccctggacattctgaccgaaatcgcttccctccctacataccttagctctcgggccaagctggctctggataatattgttatgctccataccacagagcgcggcgggagagcctaccagcacgcgctgaacgaacttcccgagtccctggagacgctcatgctggtggccctgctcggagctatgaccgccggcatctttcttttctttatgcaggggaagggaatcggcaaactgagcatgggcctgattacaatcgctgtcgcctccgggctcctgtgggtggccgaaattcaacctcagtggatcgctgcgtctattatccttgagttctttctgatggtcctcctgatccccgaacctgagaagcagcggaccccccaggacaatcaactgatttatgtgatcctcacaattcttaccatcattggactgatcgccgctaacgaaatgggcctgattgagaaaacgaagaccgatttcgggttttaccaggttaaaacagagaccacaatcctcgacgtggatctgcgcccggccagcgcctggaccctttatgctgtcgccacgacaatcctgacccctatgctcagacacacaattgaaaatacctccgcgaacctgtctctggccgctatcgccaatcaggctgccgtgctcatgggacttggcaaggggtggcccctgcatcggatggacctgggagttcccctcctggcgatgggctgttacagccaggtgaaccctaccacacttacggcctccctggtcatgctcctggtgcactatgctattatcggcccggggctgcaagccaaagctaccagagaggcccagaagcgcacagctgccggaattatgaagaatcccaccgtggatggcatcacagttatcgacctcgaacctattagctacgatcccaaattcgagaagcagcttgggcaagtcatgctgctggtgctctgcgcgggacagctgcttctgatgcggaccacgtgggccttctgtgaggtgctcacactggctaccggccctatcctgaccctctgggaagggaaccccggaagattttggaacacaaccattgccgtctctacagctaatatcttccgcggctcctatcttgccggcgccgggctggcgtttagcctgattaaaaacgctcagacgcctcggagaggaaccggcacaaccggggagacactcggagaaaagtggaaacgccagctgaattctcttgaccggaaggagttcgaagagtacaagagatccggcatcctggaggttgaccgcaccgaagccaaaagcgctctcaaggatgggtctaaaatcaagcatgccgtgagccggggatcctctaaaattagatggatcgtggagcgcggcatggtcaagccgaagggcaaagtggttgacctggggtgcggacggggcgggtggagctactatatggccacgctgaagaacgtgaccgaagtcaaaggatacacaaagggcgggcccggacacgaggaacctattcccatggctacctatggctggaatctcgtgaaacttcattccggcgttgatgtgttttacaagcctacagagcaagtcgacaccctgctgtgtgatatcggggagagctcctctaaccccacaattgaagagggaagaaccctccgcgtgctgaagatggtggaaccgtggcttagctccaaacctgagttctgcatcaaggtcctgaatccctatatgcccacggttattgaagagctcgagaaactgcagagaaagcacggcgggaacctggtgcggtgtcctctctctcgcaatagcacacacgaaatgtactgggtgtccggagcctctggcaacatcgtcagctccgtgaataccaccagcaaaatgcttctgaacagatttacaacgcggcatagaaagcccacctatgagaaagacgttgatctgggggcgggaacacggtctgtgtccaccgaaacagagaagcctgacatgaccatcattggccgcagactccagcggctgcaggaggaacacaaggagacatggcattacgatcaagaaaatccgtaccgcacctgggcctatcacggcagctacgaggctccctctacggggtccgccagctctatggtcaacggagtggttaaacttctgaccaagccttgggacgtgatccccatggtcacacagctcgctatgaccgatacaacccctttcggccagcagagagtgtttaaagaaaaggttgacacgcggacaccccaaccgaaacctgggacccgcatggtgatgacaaccacggccaattggctgtgggcgctgctcggaaagaagaaaaaccccagactgtgcacccgggaggagttcatttccaaggtccgcagcaatgccgctatcggcgccgtgtttcaggaagagcaggggtggacatccgctagcgaagccgtcaacgactctagattctgggagcttgtggataaagaacgggctctgcaccaagagggcaagtgtgagagctgcgtttataacatgatgggaaaacgcgaaaagaagctcggcgagtttgggagagccaaaggatcccgggcgatttggtacatgtggctgggcgcccgcttccttgaattcgaggctctggggtttctcaatgaagaccattggttcggaagagagaactcttggagcggcgtggagggggaaggcctgcaccggctgggatatatcctcgaggaaatcgataagaaagacggcgatctgatgtacgccgacgataccgctgggtgggacacaagaattaccgaggatgaccttcagaatgaggaactgatcacagagcagatggcccctcatcacaagattctcgccaaagcgatctttaagctgacctatcagaacaaggtcgtgaaagtgcttcgccccacgcctcggggagctgttatggatattatctccagaaaggaccaacgcggctctgggcaggtgggaacatacggcctgaataccttcaccaacatggaagtccagctcatccggcagatggaggccgaaggggtgattacacaagatgacatgcagaatcccaaaggcctgaaggagagagttgagaaatggctgcgcgaatgcggagtggaccggctcaagagaatggccatcagcggcgatgactgtgtcgtgaaaccgctggatgagcgctttgggacctcccttctgttcctcaacgacatgggaaaggtccggaaggatattcctcagtgggaaccctctaaaggctggaagaattggcaggaggtgcccttttgcagccatcacttccacaaaatctttatgaaggacgggagatccctggttgtgccttgtcgcaaccaagatgaacttattggacgggctagaatcagccagggcgccgggtggtctctgcgggagacagcttgcctcggcaaagcctacgcgcagatgtggtccctgatgtatttccatagacgcgacctgcggctcgccagcatggctatctgttctgccgtcccgacggagtggtttcccacctccagaacaacctggagcattcacgctcatcaccagtggatgacaaccgaagatatgctgaaggtgtggaatcgcgtttggatcgaggacaaccctaatatgattgataagacgcccgtgcactcctgggaagacatcccttaccttggaaaaagagaggacctgtggtgcggctctctcattgggctgagctcccgggccacctgggcgaagaacatccatacagccattgctcaagtccgcaatcttatcggaaaagaagagtatgtggattacatgcccgtgatgaagagatatagcgccccttctgagtccgaaggcgttctgtga

SEQ ID NO: 21012 - RNA, 9867 nt, synthetic construct
  misc_feature 1..9867: note = derived and/or modified CDS sequence (opt5) from DENV-4__JN819406__SS-prME
  source 1..9867: mol_type = other RNA
agcaccatcacactgctctgcctgattcccacggtgatggccttccacctttccaccagagacggcgagcctctgatgatcgtcgctaagcatgaacgggggcgcccgctcctgtttaaaacaaccgagggaattaacaagtgtacacttatcgccatggatctgggcgaaatgtgcgaggacaccgttacatacaaatgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggatccttagaaatcctggcttcgctctgctcgccggctttatggcttacatgatcgggcagacaggaattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctcttattagcaatatcaccacagccacccgctgcccgacgcaaggagagccctatctgaaggaggaacaggaccagcagtacatttgtagacgggatgtggtggaccgcggctgggggaacggatgcggcctcttcgggaaaggaggcgtcgtgacatgcgcgaagttttcttgttccggcaaaatcaccgggaatctggttcaaattgagaaccttgaatataccgtggtcgtgacagttcataatggagatacccacgccgtgggcaacgacacaagcaatcacggggtcacggctaccatcacacctagatctccctccgtggaggtcaagctgcctgattacggagaactcaccctggactgcgagccccggagcggcatcgacttcaacgagatgattctgatgaagatgaaaaagaaaacatggctcgtgcataagcagtggtttctggatcttccgctgccttggaccacgggggccgacacctctgaagttcactggaattacaaagagagaatggtgacattcaaggtcccccatgctaaacgccaggatgtgaccgttctcggctcccaggaaggagccatgcacagcgccctggctggcgcgacagaggtggactccggggatggaaaccacatgtttgccggccatcttaagtgtaaggtccggatggaaaaactgagaatcaaggggatgtcttataccatgtgcagcggaaaattctccattgacaaggagatggctgagacgcaacacggcacaaccgtggtgaaagttaagtacgaaggggccggcgccccttgtaaggtccccatcgagattcgcgatgtgaataaagaaaaggtggtcggacgggtgatcagcgctacacccctcgccgagaacaccaactctgttaccaatatcgagctggaacctccgttcggcgactcctatattgtgatcggggtcggaaacagcgcgctgacactccattggtttagaaaaggctctagcattgggaagatgttcgagtccacgtaccgcggagctaaacggatggccatcctgggcgaaaccgcctgggattttgggtctgtgggcggacttttcacaagcctgggcaaggctgttcaccaggtgtttgggtccgtctataccacaatgttcggaggcgtgagctggatgattagaatcctcatcgggtttctggttctgtggattggaaccaattctcgcaacacgtccatggccatgacatgcatcgctgtgggcgggattacccttttcctcggctttaccgtccaggccgacatgggatgtgtggtgagctggtctgcgcgggagctgaagtgcggctccgggatcttcgtcgttgataatgtgcatacatggaccgaacaataccagtttcagcccgagagccctgccagactggcttccgccattctcaacgctcacaaagacggagtgtgtggcatccgctctacaacgcggctggagaatgtcatgtggaagcagattaccaacgaacttaattatgtgctgtgggaggggggacacgacctcacagttgtggccggcgatgtcaaaggcgtgctgaccaaggggaaaagagcgctgacaccccctgccagcgaccttaagtactcctggaagacctggggaaaagctaagatcttcacgcccgaagcccggaactctacctttctcatcgatggcccggacacaagcgagtgccctaatgaacgcagagcttggaactccttcgaggttgaggattacgggttcggaatgtttaccacaaatatttggatgaaattccgggaaggcagctctgaggtgtgtgaccatagactgatgtccgccgccatcaaggatcaaaaagctgtccacgcggacatggggtattggattgaaagctctaagaaccagacctggcagatcgagcgcgcctccctgattgaagtgaaaacatgcctctggcccaagacccatacgctgtggagcaatggagttcttgagtctcagatgctgatccctaagagctacgctggccccttttcccaacacaactatcggcagggctacgccacacagaccgtggggccttggcacctcggaaaactggagatcgatttcggcgaatgccccgggaccacagtcaccattcaggagaactgtgaccatagaggaccgagcctgcgcacgacaaccgcctctggcaagcttgtgacacaatggtgctgtagatcctgcaccatgcctcccctccggtttctgggggaagatggatgttggtatggcatggagatccgccccctgagcgagaaagaagagaatatggtgaagtcccaggtcacagctggccaggggacctctgaaacgttcagcatgggactcctgtgccttaccctgtttgttgaggaatgtctcagacggcgcgtgacaagaaaacacatgattctggccgtggtcatcaccctgtgcgcgattatccttggcgggctcacatggatggacctgctgcgggctctcatcatgctgggagataccatgtccggccgcattgggggacagacgcatcttgccatcatggccgtgttcaagatgtctcctggctacgttctgggcgtgtttctcagaaagctgacaagccgggagaccgctctgatggtcattgggatggccatgacaaccaccctttccatcccgcacgacctgatggagctcattgacggaatctctctgggcctcatcctgcttaaaattgtgacacaattcgataacacgcaggttgggaccctggcgctcagcctgacatttatccgctccaccatgagcctggtgatggcttggagaacaattatggccgtccttttcgtggtcaccctgatccccctctgtcggacgtcttgcctgcagaagcaatcccattgggtggaaattacagccctcatcctgggagctcaggcccttcctgtttatctgatgaccctcatgaaaggcgctagcagacgctcttggcccctgaatgaggggattatggccgtgggactggtctcccttctgggcagcgcgctcctgaagaacgacgtgcctctcgccggccccatggttgctgggggactgcttctggccgcttacgtgatgtctggctccagcgccgatctgtccctcgaaaaagccgctaatgtccagtgggacgagatggcggatatcaccgggagctctcctatcattgaagtgaagcaggacgaggatggaagcttttccatccgggacgtggaggaaacaaacatgattaccctgcttgttaagctggccctcatcacagtctctggcctgtaccccctcgctattccgatcacgatgaccctgtggtatatgtggcaagtgaaaacacagagaagcggggccctttgggatgtgccttcccccgccgctacccagaaggccgcgctgtctgagggagtctaccgcatcatgcagcggggcctgttcggcaaaacacaagtgggggttggaattcacatggaaggcgtgttccacaccatgtggcatgtcacgagagggagcgtgatctgtcacgagaccggacgcctcgaaccttcctgggctgacgttcggaatgatatgatttcttatggcgggggatggagactgggcgacaagtgggataaagaggaggacgtgcaggtccttgccatcgaacccggcaagaacccgaagcatgtgcagacaaaacctgggctgtttaagaccctcacaggagagattggcgccgttaccctggacttcaaacccgggacaagcggatcccctatcatcaatcgcaagggcaaagtgattgggctctacggcaacggagtcgtgacgaagagcggcgattatgtgtctgctatcacccaggccgaacggattggggagcccgactacgaggtcgatgaagacatctttagaaaaaagcggctgacaattatggatcttcaccccggagcgggcaagaccaaacgcatcctgccttccattgttagagaggctctgaagcggcgcctcagaaccctgatccttgccccgacacgggtggtggccgctgaaatggaggaagccctgagagggctccccatccgctatcaaacgcctgctgtcaaaagcgagcataccggacgggagattgtggacctgatgtgccacgccacattcaccacaagactcctgtcttccacccgcgttcccaattacaaccttatcgtgatggatgaagcgcactttacggaccctagctccgtcgccgctcggggctacatttctacaagagtggagatgggggaagccgctgccatcttcatgaccgccaccccccctggcgctacagatccgtttccccagagcaattcccctattgaggacatcgaacgcgagatccccgagcggagctggaacaccggattcgattggattacagactatcagggcaagaccgtttggtttgtgccttctatcaaagcggggaatgacattgccaactgcctgagaaagtccggaaagaaagtcatccaactgagccgcaagacgttcgatacagaataccccaaaaccaagctcacagactgggattttgtggtcaccacggacatttctgagatgggcgctaacttcagagccgggcgggtgatcgatccgcgcagatgtctgaaacctgttatccttaccgacggacccgaacgggtgattctggccggccccatccctgtgacacccgctagcgccgcgcagcgcagagggcggattggcagaaatcctgctcaggaggatgaccagtatgtcttctccggagatccgctcaagaacgacgaagatcatgcccactggaccgaggccaagatgctgctggacaatatctacacacccgagggcattatccctaccctctttgggcccgaacgcgagaaaacacaagctattgatggagaattccggcttagaggcgagcagcgcaagacctttgttgagctgatgcggagaggggacctgcctgtgtggctctcttataaagtggccagcgcgggaatctcctacaaggaccgggaatggtgcttcacgggcgagcgcaacaatcagatcctggaagagaacatggaagtcgagatttggacaagagagggcgaaaaaaagaagcttcggcccaaatggctggatgcccgcgtgtatgctgacccgatggccctcaaggattttaaagagttcgcttctgggagaaagagcatcaccctggacattctgaccgaaatcgcctccctccctacataccttagctctcgggctaaactggccctggataatattgttatgctccataccacagagcgcggaggcagagcgtaccagcacgccctgaacgaacttcccgagtccctggagacgctcatgctggtggctctgctcggggccatgaccgctggaatctttcttttctttatgcaaggcaaggggatcggaaagctgagcatgggcctgattacaatcgccgtcgcctccggcctcctgtgggtggctgaaattcagcctcagtggatcgcggcctctattatccttgagttctttctgatggtcctcctgatccccgaacctgagaaacagcggaccccccaagacaatcagctgatttatgtgatcctcacaattcttaccatcattgggctgatcgctgccaacgaaatgggactgattgagaagacgaaaaccgatttcggcttttaccaggttaagacagagaccacaatcctcgacgtggatctgcgcccggccagcgcttggaccctttatgccgtcgcgacgacaatcctgacccctatgctcagacacacaattgaaaatacctccgccaacctgtctctggctgccatcgctaatcaggccgcggtgctcatggggcttggaaaaggctggcccctgcatcggatggacctgggggttcccctcctggccatgggatgttacagccaagtgaaccctaccacacttacggcttccctggtcatgctcctggtgcactatgccattatcggcccgggcctgcaggctaaggccaccagagaggctcagaaacgcacagccgcggggattatgaagaatcccaccgtggatggaatcacagttatcgacctcgaacctattagctacgatcccaagttcgagaaacaacttggccaggtcatgctgctggtgctctgcgccgggcagctgcttctgatgcggaccacgtgggctttctgtgaggtgctcacactggccaccggacctatcctgaccctctgggaaggcaaccccgggagattttggaacacaaccattgctgtctctacagccaatatcttccgcggatcctatcttgccggcgcgggcctggcttttagcctgattaagaacgcccagacgcctcggagagggaccggaacaaccggcgagacactcggggaaaaatggaagcgccaactgaattctcttgaccggaaagagttcgaagagtacaagagatccggaatcctggaggttgaccgcaccgaagctaagagcgccctcaaagatggctctaagatcaaacatgccgtgagccgggggtcctctaagattagatggatcgtggagcgcggaatggtcaaaccgaagggcaaggtggttgacctgggctgcgggcggggaggctggagctactatatggctacgctgaaaaacgtgaccgaagtcaaggggtacacaaaaggaggccccgggcacgaggaacctattcccatggccacctatggatggaatctcgtgaagcttcattccggcgttgatgtgttttacaaacctacagagcaggtcgacaccctgctgtgtgatatcggcgagagctcctctaaccccacaattgaagaggggagaaccctccgcgtgctgaagatggtggaaccgtggcttagctccaagcctgagttctgcatcaaagtcctgaatccctatatgcccacggttattgaagagctcgagaagctgcagagaaaacacggaggcaacctggtgcggtgtcctctctctcgcaatagcacacacgaaatgtactgggtgtccggggcgtctggaaacatcgtcagctccgtgaataccaccagcaagatgcttctgaacagatttacaacgcggcatagaaaacccacctatgagaaggacgttgatctgggcgccgggacacggtctgtgtccaccgaaacagagaaacctgacatgaccatcattggacgcagactccagcggctgcaagaggaacacaaggagacatggcattacgatcaggaaaatccgtaccgcacctgggcttatcacggcagctacgaggccccctctacgggctccgctagctctatggtcaacggggtggttaagcttctgaccaaaccttgggacgtgatccccatggtcacacagctcgccatgaccgatacaacccctttcggacagcaaagagtgtttaaggaaaaagttgacacgcggacaccccagccgaagcctggcacccgcatggtgatgacaaccacggcgaattggctgtgggccctgctcgggaaaaagaagaaccccagactgtgcacccgggaggagttcatttccaaagtccgcagcaatgctgccatcggagctgtgtttcaggaagagcaaggctggacatccgccagcgaagctgtcaacgactctagattctgggagcttgtggataaggaacgggccctgcaccaggaggggaaatgtgagagctgcgtttataacatgatgggcaagcgcgaaaaaaagctcggagagtttggcagagcgaaggggtcccgggccatttggtacatgtggctgggagctcgcttccttgaattcgaggccctgggctttctcaatgaagaccattggttcgggagagagaactcttggagcggagtggagggcgaagggctgcaccggctgggctatatcctcgaggaaatcgataaaaaggacggagatctgatgtacgctgacgataccgccggctgggacacaagaattaccgaggatgaccttcagaatgaggaactgatcacagagcagatggcccctcatcacaaaattctcgcgaaggctatctttaaactgacctatcaaaacaaggtcgtgaaggtgcttcgccccacgcctcggggggccgttatggatattatctccagaaaagaccagcgcggatctggccaggtggggacatacggactgaataccttcaccaacatggaagtccagctcatccggcaaatggaggccgaaggcgtgattacacaggatgacatgcagaatcccaaggggctgaaagagagagttgagaagtggctgcgcgaatgcggcgtggaccggctcaaaagaatggctatcagcggagatgactgtgtcgtgaagccgctggatgagcgctttggcacctcccttctgttcctcaacgacatggggaaagtccggaaggatattcctcagtgggaaccctctaagggatggaaaaattggcaagaggtgcccttttgcagccatcacttccacaagatctttatgaaagacggcagatccctggttgtgccttgtcgcaaccaggatgaacttattgggcgggccagaatcagccagggagctggctggtctctgcgggagacagcctgcctcgggaaggcgtacgcccagatgtggtccctgatgtatttccatagacgcgacctgcggctcgctagcatggccatctgttctgctgtcccgacggagtggtttcccacctccagaacaacctggagcattcacgcccatcaccaatggatgacaaccgaagatatgctgaaagtgtggaatcgcgtttggatcgaggacaaccctaatatgattgataagacgcccgtgcactcctgggaagacatcccttaccttggcaagagagaggacctgtggtgcggatctctcattggcctgagctcccgggcgacctgggccaaaaacatccatacagctattacccaggtccgcaatcttatcgggaaggaagagtatgtggattacatgcccgtgatgaaaagatatagcgccccttctgagtccgaaggagttctgtga

SEQ ID NO: 21013 - RNA, 9867 nt, synthetic construct
  misc_feature 1..9867: note = derived and/or modified CDS sequence (opt5) from DENV-4__GQ199876__SS-prME
  source 1..9867: mol_type = other RNA
agcaccatcacactgctctgcctgattcccacggtgatggccttccacctttccaccagagacggcgagcctctgatgatcgtcgctaagcatgaacgggggcgcccgctcctgtttaaaacaaccgagggaattaacaagtgtacacttatcgccatggatctgggcgaaatgtgcgaggacaccgttacatacaaatgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggatccttagaaatcctggcttcgctctgctcgccggctttatggcttacatgatcgggcagacaggaattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctcttattagcaatatcaccacagccacccgctgcccgacgcaaggagagccctatctgaaggaggaacaggaccagcagtacatttgtagacgggatgtggtggaccgcggctgggggaacggatgcggcctcttcgggaaaggaggcgtcgtgacatgcgcgaagttttcttgttccggcaaaatcaccgggaatctggttcaaattgagaaccttgaatataccgtggtcgtgacagttcataatggagatacccacgccgtgggcaacgacacaagcaatcacggggtcacggctaccatcacacctagatctccctccgtggaggtcaagctgcctgattacggagaactcaccctggactgcgagccccggagcggcatcgacttcaacgagatgattctgatgaagatgaaaaagaaaacatggctcgtgcataagcagtggtttctggatcttccgctgccttggaccacgggggccgacacctctgaagttcactggaattacaaagagagaatggtgacattcaaggtcccccatgctaaacgccaggatgtgaccgttctcggctcccaggaaggagccatgcacagcgccctggctggcgcgacagaggtggactccggggatggaaaccacatgtttgccggccatcttaagtgtaaggtccggatggaaaaactgagaatcaaggggatgtcttataccatgtgcagcggaaaattctccattgacaaggagatggctgagacgcaacacggcacaaccgtggtgaaagttaagtacgaaggggccggcgccccttgtaaggtccccatcgagattcgcgatgtgaataaagaaaaggtgatcggacgggtcatcagcgctacacccctcgccgagaacaccaactctgtgaccaatattgagctggaacctccgttcggcgactcctatatcgttattggggtgggaaacagcgcgctgacactccattggtttagaaaaggctctagcatcgggaagatgttcgagtccacgtaccgcggagctaaacggatggccattctgggcgaaaccgcctgggattttgggtctgtcggcggacttttcacaagcctgggcaaggctgtgcaccaggtttttgggtccgtgtataccacaatgttcggaggcgtcagctggatgatcagaatcctcattgggtttctggtgctgtggatcggaaccaattctcgcaacacgtccatggccatgacatgcattgctgttggcgggatcacccttttcctcggctttaccgtgcaggccgacatgggatgtgtcgtgagctggtctggccgggagctgaagtgcgggtccggaattttcgtggtcgataatgttcatacatggaccgaacaatacaaatttcagcccgagagccctgcgagactggcctccgctatcctcaacgcccacaaggacggcgtgtgtgggattcgctctacaacgcggctggagaatgtgatgtggaaacagatcaccaacgaacttaattatgtcctgtgggagggaggccacgacctcacagtggttgctggcgatgtgaagggggtcctgaccaaaggaaagagagccctgacaccccctgcgagcgaccttaagtactcctggaaaacctggggcaaggccaaaatcttcacgcccgaagctcggaactctacctttctcattgatgggccggacacaagcgagtgccctaatgaacgcagagcctggaactccttcgaggtggaggattacggattcggcatgtttaccacaaatatctggatgaagttccgggaagggagctctgaggtttgtgaccatagactgatgtccgctgccattaaagatcagaaggccgtgcacgctgacatgggatattggatcgaaagctctaaaaaccaaacctggcagattgagcgcgcgtccctgatcgaagtcaagacatgcctctggcccaagacccatacgctgtggagcaatggcgtgcttgagtctcagatgctgatccctaaaagctacgccggccccttttcccagcacaactatcggcaagggtacgctacacagaccgttggaccttggcacctcggcaagctggagattgatttcggggaatgccccggaaccacagtgaccatccaggagaactgtgaccatagaggcccgagcctgcgcacgacaaccgcctctgggaaacttgtcacacagtggtgctgtagatcctgcaccatgcctcccctccggtttctgggagaagatggctgttggtatggcatggagattcgccccctgagcgagaaggaagagaatatggtgaaatcccaagtgacagccgggcagggaacctctgaaacgttcagcatgggcctcctgtgccttaccctgtttgtcgaggaatgtctcagacggcgcgttacaagaaagcacatgatcctggctgtggtgattaccctgtgcgccatcatccttgggggactcacatggatggacctgctgcgggcgctcattatgctgggcgataccatgtccgggcgcatcggaggccagacgcatcttgctattatggccgtcttcaagatgtctcctggctacgtgctgggggtttttctcagaaaactgacaagccgggagaccgccctgatggtgatcggaatggctatgacaaccaccctttccattccgcacgacctgatggagctcatcgacggcatctctctggggctcattctgcttaagatcgtcacacagttcgataacacgcaagtgggaaccctggccctcagcctgacatttattcgctccaccatgagcctggttatggcgtggagaacaatcatggctgtgcttttcgtcgtgaccctgattcccctctgtcggacgtcttgcctgcagaaacagtcccattgggtcgaaatcacagccctcattctgggcgcccaagctcttcctgtgtatctgatgaccctcatgaagggggccagcagacgctcttggcccctgaatgagggaatcatggctgttggcctggtgtcccttctgggcagcgccctcctgaaaaacgacgtccctctcgcggggcccatggtggccggaggcctgcttctggctgcctacgttatgtctgggtccagcgctgatctgtccctcgaaaaggccgccaatgtgcagtgggacgagatggctgatatcaccggaagctctcctattatcgaagtcaagcaggacgaggatggcagcttttccattcgggacgtggaggaaacaaacatgatcaccctgcttgtgaaactggcgctcattacagtttctgggctgtaccccctcgccatcccgatcacgatgaccctgtggtatatgtggcaggtcaagacacaaagaagcggagctctttgggatgtgccttcccccgccgccacccagaaagctgccctgtctgagggcgtgtaccgcattatgcagcggggcctgttcgggaagacacaggtcggagtgggcatccacatggaaggggttttccacaccatgtggcatgtgacgagaggaagcgtcatttgtcacgagaccggccgcctcgaaccttcctgggcggacgtgcggaatgatatgatctcttatgggggaggctggagactgggcgacaaatgggataaggaggaggacgttcaagtgcttgctattgaacccgggaagaacccgaaacatgtccagacaaagcctggactgtttaaaaccctcacaggcgagatcggggccgtgaccctggacttcaagcccggaacaagcggctcccctatcattaatcgcaaagggaaggttatcggcctctacggaaacggcgtggtcacgaaaagcggggattatgtgtctgccattacccaggctgaacggatcggagagcccgactacgaggtggatgaagacatttttagaaagaagcggctgacaatcatggatcttcaccccggcgccgggaaaaccaagcgcattctgccttccatcgtcagagaggcgctgaaacggcgcctcagaaccctgatccttgctccgacacgggttgtggccgccgaaatggaggaagctctgagaggactccccgtgcgctatcagacgcctgccgtcaagagcgagcataccggccgggagattgtggacctgatgtgccacgctacattcaccacaagactcctgtcttccacccgcgttcccaattacaaccttatcgtgatggatgaagcccactttacggaccctagctccgtcgcggcccgggggtacatttctacaagagtggagatgggcgaagctgccgctatcttcatgaccgccaccccccctggagccacagatccgtttccccaaagcaattcccctattgaggacatcgaacgcgagatccccgagcggagctggaacaccggcttcgattggattacagactatcaggggaaaaccgtttggtttgtgccttctatcaaggctggaaatgacattgcgaactgcctgagaaagtccggcaaaaaggtcatccagctgagccgcaaaacgttcgatacagaataccccaagaccaaactcacagactgggattttgtggtcaccacggacatttctgagatgggggccaacttcagagctggacgggtgatcgatccgcgcagatgtctgaagcctgttatccttaccgacggccccgaacgggtgattctggccgggcccatccctgtgacacccgccagcgctgcccaacgcagaggccggattggaagaaatcctgcgcaggaggatgaccagtatgtcttctccggcgatccgctcaagaacgacgaagatcatgctcactggaccgaggccaaaatgctgctggacaatatctacacacccgaggggattatccctaccctctttggacccgaacgcgagaagacacaggccattgatggcgaattccggcttagaggggagcaacgcaaaacctttgttgagctgatgcggagaggagacctgcctgtgtggctctcttataaggtggctagcgccggcatctcctacaaagaccgggaatggtgcttcacgggcgagcgcaacaatcagatcctggaagagaacatggaagtcgagatttggacaagagagggggaaaagaagaaacttcggcccaagtggctggatgcgcgcgtgtatgccgacccgatggctctcaaagattttaaggagttcgcctctggaagaaaaagcatcaccctggacattctgaccgaaatcgcttccctccctacataccttagctctcgggccaagctggctctggataatattgttatgctccataccacagagcgcggcgggagagcctaccagcacgcgctgaacgaacttcccgagtccctggagacgctcatgctggtggccctgctcggagctatgaccgccggcatctttcttttctttatgcaggggaagggaatcggcaaactgagcatgggcctgattacaatcgctgtcgcctccgggctcctgtgggtggccgaaattcaacctcagtggatcgctgcgtctattatccttgagttctttctgatggtcctcctgatccccgaacctgagaagcagcggaccccccaggacaatcaactgatttatgtgatcctcacaattcttaccatcattggactgatcgccgctaacgaaatgggcctgattgagaaaacgaagaccgatttcgggttttaccaggttaaaacagagaccacaatcctcgacgtggatctgcgcccggccagcgcctggaccctttatgctgtcgccacgacaatcctgacccctatgctcagacacacaattgaaaatacctccgcgaacctgtctctggccgctatcgccaatcaggctgccgtgctcatgggacttggcaaggggtggcccctgcatcggatggacctgggagttcccctcctggcgatgggctgttacagccaggtgaaccctaccacacttacggcctccctggtcatgctcctggtgcactatgctattatcggcccggggctgcaagccaaagctaccagagaggcccagaagcgcacagctgccggaattatgaagaatcccaccgtggatggcatcacagttatcgacctcgaacctattagctacgatcccaaattcgagaagcagcttgggcaagtcatgctgctggtgctctgcgcgggacagctgcttctgatgcggaccacgtgggccttctgtgaggtgctcacactggctaccggccctatcctgaccctctgggaagggaaccccggaagattttggaacacaaccattgccgtctctacagctaatatcttccgcggctcctatcttgccggcgccgggctggcgtttagcctgattaaaaacgctcagacgcctcggagaggaaccggcacaaccggggagacactcggagaaaagtggaaacgccagctgaattctcttgaccggaaggagttcgaagagtacaagagatccggcatcctggaggttgaccgcaccgaagccaaaagcgctctcaaggatgggtctaaaatcaagcatgccgtgagccggggatcctctaaaattagatggatcgtggagcgcggcatggtcaagccgaagggcaaagtggttgacctggggtgcggacggggcgggtggagctactatatggccacgctgaagaacgtgaccgaagtcaaaggatacacaaagggcgggcccggacacgaggaacctattcccatggctacctatggctggaatctcgtgaaacttcattccggcgttgatgtgttttacaagcctacagagcaagtcgacaccctgctgtgtgatatcggggagagctcctctaaccccacaattgaagagggaagaaccctccgcgtgctgaagatggtggaaccgtggcttagctccaaacctgagttctgcatcaaggtcctgaatccctatatgcccacggttattgaagagctcgagaaactgcagagaaagcacggcgggaacctggtgcggtgtcctctctctcgcaatagcacacacgaaatgtactgggtgtccggagcctctggcaacatcgtcagctccgtgaataccaccagcaaaatgcttctgaacagatttacaacgcggcatagaaagcccacctatgagaaagacgttgatctgggggcgggaacacggtctgtgtccaccgaaacagagaagcctgacatgaccatcattggccgcagactccagcggctgcaggaggaacacaaggagacatggcattacgatcaagaaaatccgtaccgcacctgggcctatcacggcagctacgaggctccctctacggggtccgccagctctatggtcaacggagtggttaaacttctgaccaagccttgggacgtgatccccatggtcacacagctcgctatgaccgatacaacccctttcggccagcagagagtgtttaaagaaaaggttgacacgcggacaccccaaccgaaacctgggacccgcatggtgatgacaaccacggccaattggctgtgggcgctgctcggaaagaagaaaaaccccagactgtgcacccgggaggagttcatttccaaggtccgcagcaatgccgctatcggcgccgtgtttcaggaagagcaggggtggacatccgctagcgaagccgtcaacgactctagattctgggagcttgtggataaagaacgggctctgcaccaagagggcaagtgtgagagctgcgtttataacatgatgggaaaacgcgaaaagaagctcggcgagtttgggagagccaaaggatcccgggcgatttggtacatgtggctgggcgcccgcttccttgaattcgaggctctggggtttctcaatgaagaccattggttcggaagagagaactcttggagcggcgtggagggggaaggcctgcaccggctgggatatatcctcgaggaaatcgataagaaagacggcgatctgatgtacgccgacgataccgctgggtgggacacaagaattaccgaggatgaccttcagaatgaggaactgatcacagagcagatggcccctcatcacaagattctcgccaaagcgatctttaagctgacctatcagaacaaggtcgtgaaagtgcttcgccccacgcctcggggagctgttatggatattatctccagaaaggaccaacgcggctctgggcaggtgggaacatacggcctgaataccttcaccaacatggaagtccagctcatccggcagatggaggccgaaggggtgattacacaagatgacatgcagaatcccaaaggcctgaaggagagagttgagaaatggctgcgcgaatgcggagtggaccggctcaagagaatggccatcagcggcgatgactgtgtcgtgaaaccgctggatgagcgctttgggacctcccttctgttcctcaacgacatgggaaaggtccggaaggatattcctcagtgggaaccctctaaaggctggaagaattggcaggaggtgcccttttgcagccatcacttccacaaaatctttatgaaggacgggagatccctggttgtgccttgtcgcaaccaagatgaacttattggacgggctagaatcagccagggcgccgggtggtctctgcgggagacagcttgcctcggcaaagcctacgcgcagatgtggtccctgatgtatttccatagacgcgacctgcggctcgccagcatggctatctgttctgccgtcccgacggagtggtttcccacctccagaacaacctggagcattcacgctcatcaccagtggatgacaaccgaagatatgctgaaggtgtggaatcgcgtttggatcgaggacaaccctaatatgacggataagacccccgtgcactcctgggaagacattccttaccttggaaaaagagaggacctgtggtgcggctctctcatcgggctgagctcccgggccacatgggcgaagaacattcataccgccatcacacaagtccgcaatcttattggaaaagaagagtatgtggattacatgcccgtgatgaagagatatagcgctccttctgagtccgaaggcgttctgtga

SEQ ID NO: 21014 - RNA, 9867 nt, synthetic construct
  misc_feature 1..9867: note = derived and/or modified CDS sequence (opt5) from DENV-4__KP723482__SS-prME
  source 1..9867: mol_type = other RNA
agcaccatgacactgctctgcctgatccccacggtgatggccttccacctttccaccagagacggcgagcctctgatgattgtcgctaagcatgaacgggggcgcccgctcctgtttaaaacaaccgagggaatcaacaagtgtacacttattgccatggatctgggcgaaatgtgcgaggacaccgttacatacaaatgtcccctcctggtgaataccgaacctgaggatatcgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggattcttagaaatcctggcttcgctctgctcgccggctttatggcttacatgatcgggcagacaggaatccagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtattgaagctagcatctctaatattaccacagccacccgctgcccgacgcaaggagagccctatcttaaggaggaacaggaccagcagtacatctgtagacgggatgtggtggaccgcggctgggggaacggatgcggcctgttcgggaaaggaggcgtcgtgacatgcgcgaagtttctctgttccggcaaaattaccgggaatctggttcaaatcgagaaccttgaatataccgtggtcgtgacagttcataatggaaacacccacgccgtgggcaatgatacaagcaaccacggggtcacggctaccattacacctagatctccctccgtggaggtcaagctgcctgactacggagaactcaccctggattgcgagccccggagcggcatcgacttcaatgagatgatcctgatgaagatgaaaaagaaaacatggctcgtgcataagcagtggtttctggaccttccgctgccttggaccgccggggctgatacgtctgaagttcactggaactacaaagagagaatggtgaccttcaaggtcccccatgccaaacgccaggacgtgacagttctcggctcccaggaaggagccatgcacagcgctctggcgggcgccaccgaggtggattccggggacggaaatcacatgtttgctggccatcttaagtgtaaggtccggatggaaaaactgagaattaaggggatgtcttatacaatgtgcagcggaaaattctccatcgataaggagatggccgagacccaacacggcacgacagtggtgaaagttaagtacgaaggggccggcgctccttgtaaggtccccattgagatccgcgacgtgaacaaagaaaaggtggtcggacggattatcagctctacccccttcgccgagaacacaaattccgtgaccaacatcgagctcgaacctccgtttggcgatagctatattgttatcggggtgggagactctgcgctgaccctgcattggttcagaaaaggcagctccattgggaagatgtttgagtctacataccgcggagctaaacggatggccatcctcggcgaaacggcctgggatttcgggagcgtcggcggactgtttacctcccttggcaaggctgtgcaccaggttttcgggagcgtgtatacaaccatgtttggaggcgtctcttggatgattagaatcctgatcgggttcctcgtgctgtggattggaacaaattcccgcaacaccagcatggccatgacgtgcatcgctgttggcgggattacactgtttcttggcttcaccgtgcaggccgacatgggatgtgtcgtgtcttggaatggcaaggagctcaaatgcgggtccggaatctttgtggtcgataacgttcatacctggacagaacaatacaagttccagcccgagagccctgcgcggctggcctccgctattctgaatgcccacaaagacggcgtgtgtgggatcagatctaccacacgcctcgagaacgtgatgtggaagcagattacgaatgaactgaactatgtcctttgggagggaggccacgacctgaccgtggttgctggcgatgtgaaaggggtcctcacaaagggaaagcgggccctgaccccccctgtgaatgacctgaaatacagctggaagacatggggcaaagcgaagatctttacccccgaagccagaaactccacgttccttatcgatgggccggacacctctgagtgccctaatgaacggcgcgcttggaacttctttgaggttgaggattacggattcggcatgtttacaaccaatatttggatgaaattcagagaagggagctccgaggtgtgtgaccatcggctcatgagcgccgctatcaaggatcagaaagccgtccacgccgacatgggatattggattgaatcttccaagaaccaaacatggcagatcgagaaggctagcctgattgaagtgaaaacctgcctgtggcccaagacacataccctctggtctaacggcgttctggagtcccagatgcttatccctagaagctacgcgggccccttttctcagcacaattatcgccaagggtacgccacgcagacagctggaccttggcacctgggcaaactcgagatcgatttcggggaatgccccggaaccaccgtgacaattcaggaggactgtgatcatcggggcccgagcctgagaaccacgacagcctccgggaagctggtcacccagtggtgctgtcgcagctgcacaatgcctccccttagatttctcggagaagacggctgttggtatggcatggagatccggcccctgtctgagaaagaagagaacatggtgaagtcccaagtgaccgccgggcagggaacaagcgaaaccttctccatgggcctgctctgcctgacgctttttgtcgaggaatgtctgcgcagacgggttacccgcaagcacatgattctcgctgtggtgatcacattctgcgccattatcctggggggactgacctggatggatcttctcagagtcctgatcatgctgggcgacacaatgtctgggcggattggaggccagatccatctcgcgattatggctgtgtttaaaatgagccctggctacgttctgggggtgttccttcgcaagctgacctccagagagacggccctcatggtcatcggaatggccatgacaaccgtgttttctattccgcacgacctgatggagctgatcgatggcatcagccttgggctgattctcctgaaaatcgttacacatttcgacaatacccaggtgggaaccctcgctctgtcccttacattcattcggtctacgacccccctggtcatggcctggcgcacaatcatggcggtgtttttcgtcgtgaccctcattcctctgtgtagaacaagctgcctgcaaaagcagtcccactgggttgaaatcaccgctcttattctgggcgcccaggccctccccgtgtatctgatgacgctcatgaaaggggctagccggagatcttggcctctgaacgagggaatcatggccgtcggccttgtgtccctgctcggcagcgctctgctgaagaatgatgttccccttgccgggcctatggtggcgggaggcctgctcctggccgcttacgtcatgtctgggtccagcgccgacctctctctggaaaaggctgccaacgtgcaatgggatgagatggccgacatcacaggatccagccccattatcgaagtgaaacaggatgaggacggctcctttagcattcgcgatgttgaggaaaccaatatgatcacccttctggtcaagctggctctcattacagtgtctgggctgtacccgcttgcgatccctgtgaccatggccctgtggtatgtctggcaggtgaaaacacagcggagcggagctctctgggacgttccctccccttctgccacgcaaaaggccaccctgagcgagggcgtgtacagaatcatgcagcgcggcctcttcgggaaaacacaggtcggagtgggcattcacatggaaggggtttttcataccatgtggcacgtgacacggggatccgtcatctgtcatgagaccggcagactggaaccctcttgggctgatgtgcgcaacgacatgattagctatgggggaggctggcggcttggcgataagtgggacaaggaggaggacgttcaggtgctggccatcgaaccggggaaaaatcctaagcacgtccaaacgaaacccggactgttcaagaccctcacaggcgagattggggcggtgaccctggattttaaacctggaacatccggctctcccatcatcaacaagaaagggaaggtgattggcctttacggaaatggcgtcgttaccaagagcggggactatgtgtccgctatcacacaggccgaaagaattggagagcccgattacgaggtggacgaagatatcttccgcaaaaagcggctgacgattatggacctccatcctggcgccgggaaaaccaagagaatcctgccgagcattgtccgggaggctctcaaacgcagactgcggacacttatcctggcccccacccgcgtggttgcggctgaaatggaggaagccctgagaggactccctatccggtatcagacccccgccgtgaagtctgagcacacaggcagagagattgtcgatctgatgtgccacgctacgtttaccacacgccttctgtccagcacccgggtgcctaactacaatctcatcgttatggacgaagcccatttcacagatccctgctctgtggctgccagagggtacatttccacccgcgtcgagatgggcgaagcggccgctatctttatgacggccacacctccgggaagcattgaccccttccctcagtccaactctcccatcgaggatatcgaacgggagattcctgagagaagctggaataccggcttcgactggatcaccgactatcaagggaagacagtgtggtttgtcccctccattaaagctggaaacgatatcgccaactgtctgcgcaagagcggcaaacgggtgattcagctctctagaaagaccttcgacacagaatacccgaaaaccaagctgacggattgggactttgttgtgacaaccgatatctccgagatgggggccaatttccgcgctggaagagtgatcgaccctcggcgctgccttaagcccgtcattctgacagatggccccgaaagagttatcctggcggggcctattcccgtgacccctgccagcgctgcccagcggcgcggcagaatcggacggaacccggcccaagaggacgatcagtatgtgttttctggcgaccccctcaaaaatgatgaagaccacgctcattggacggaggccaagatgctgcttgataacatttacacccctgaggggatcattcccacactgttcggacctgaaagagagaaaacccaggcgatcgacggcgaatttcgcctccggggggagcagagaaagacattcgtcgagctgatgcgccggggagacctgcccgtgtggctcagctataaagttgcttccgccggcatctcttacaaggatagagaatggtgttttaccggcgagcggaataaccaaattcttgaagagaatatggaagtggagatctggacacgcgagggggaaaagaaaaagctgagaccgaaatggctggacgcccgggtctatgctgatcctatggccctcaaggacttcaaagagtttgcgagcggacgcaagtccattaccctggatatccttacggaaattgccacactgcccacctacctctctagcaaggctaaactggccctggacaacatcgtgatgctccacaccacagagaagggcgggagagcttaccagcacgcccttaatgaactgcctgagtccctggagaccctcatgctggtcgctcttctgggagccatgacagcgggcatcttcctctttttcatgcaggggaaaggaattggcaagctgagcatgggcctgatcgccattgctgtggcctctgggctcctttgggttgctgaaatccagccccaatggattgccgcctccatcatcctggagttctttctgatggtgctcctgattcctgaacccgagaaacagcggacgccgcaggataaccagcttatctatgtcattctgaccatcctcacaattatcggactgattgctgcgaatgaaatgggcctgatcgagaagaccaaaacagacttcgggttttaccaagtgaagcctgagaccacgatcctcgatgttgaccttcgccccgccagcgcttggaccctgtatgccgtggccacaaccattctgacacccatgctcagacataccatcgaaaacacgtccgctaatctgtctcttgccgcgattgccaaccaggctgccgtcctgatgggactcggcaaggggtggcctctgcaccggatggatctgggagtgccgctccttgctatgggctgctacagccaggtgaatcccacaaccctgacagcctccctggttatgctcctggtccattatgcgatcattggccctgggcttcaggccaaagctacccgcgaggcccaaaagagaaccgctgccggaatcatgaaaaaccccacagtggacggcatcacggtgattgatctggaacctatctcttacgaccccaagttcgagaaacagctcgggcaggtcatgctgctggttctctgtgtgggacaacttctgctgatgcggaccacatgggctctctgcgaggtgctgacccttgccacaggccctgtcatgaccctgtgggaagggaacccgggaagattttggaatacgacaattgcggtgagcaccgccaacatcttccgcggctcctatctcgctggcgccgggctggcttttagcctgattaagaatgcccagaccccccggagaggaacaggcaccacaggggagacgctcggagaaaagtggaaacgccagcttaactctctggaccggaaggagttcgaagagtacaaaagatccggcatcctggaggttgatcgcaccgaagccaagagcgcgctccgggacgggacaaaaatcaagtacgctgtgtctagaggatccagcaagattcgctggatcgtcgagcggggcatgattaaacctaagggcaaagtggttgatctggggtgtggaagaggcgggtggtcttattacatggccacccttaagaatgtgacagaagtcaaaggatataccaagggcgggcccggacacgaggaacctatccccatggctacgtacggctggaacctggtgaagctccatagcggcgtggacgtcttttataaaccgaccgagcaggttgatacactgctgtgcgacattggggagtcctctagcaatcctaccatcgaagagggacgcacactccgggtgcttaagatggtggaaccctggctgtccagcaaacccgagttctgtattaaggtcctgaacccttacatgcccaccgtgatcgaagagctcgagaaactgcaaagacgccacggcgggtcccttgttagatgccctctgtctcggaatagcacacacgaaatgtattgggtgtccggagcctctggcaacatcgtcagctccgtgaataccatttctaagatgctcctgaaccgctttacgacaagacatcggaaaccgacctacgagaaggatgttgacctgggggccggaaccagaagcgtgtccacagaaacggagaagcccgatatgaccgtcatcggccggcgcctccagagacttcgggaggaacacaaagagacatggcattacgaccaggaaaatccttatcgcacctgggcttaccacggcagctatgaggccccctctacagggtccgcgagctctatggtgaacggagttgtgaagctgctgaccaaaccttgggatgtcattcccatggtgacacagctcgccatgaccgacacgaccccgttcggccaacagagagtctttaaggaaaaagtggacacacggacccctcagcccaagcctgggacacgcatgatcatgaccacgacagctaattggctgtgggcccttctgggaaagaaaaagtcccccagactctgtacccgggaggagttcattagcaaagttcgctctaacgctgccatcggcgcggtgttccaggaagagcaagggtggacatccgccagcgaagctgtcaatgattccagattttgggagctggtggacaaggaacgggccctgcaccaggagggcaaatgcgagagctgcgtgtacaacatgatgggaaagcgcgaaaagaaactcggcgagttcgggagagctaagggatctcgggccatctggtatatgtggctgggcgctcgctttcttgaattcgaggccctggggtttctcaacgaagatcattggttcagcagagagaattcctggtctggagttgagggcgaagggctgcaccggcttggctacattctggaggacatcgataaaaaggacggagatctcatttatgcggacgataccgccggctgggacacgagaatcaccgaagatgacctgctgaacgaggagctcattacagaacagatggctcctcatcacaaaaccctggccaaggctatctttaagcttacataccaaaataaagtggtcaaggtgctgcgccccaccccgaaaggggccgttatggatatcattagccggaaggaccagagaggatccggccaggtggggacatacggactcaacaccttcacgaatatggaggtccagctgatccgccaaatggaagccgagggcgtgattacacaggacgatatgcagaaccctaaagggcttaaggaacgggtcgagaaatggctgaaggagtgtggcgtggacagactcaagcgcatggcgatctctggagatgactgcgttgtgaaacccctggatgaacggtttagcacctccctgctcttcctgaatgacatgggcaaggtcagaaaagatattccccagtgggagccttctaaggggtggaaaaactggcaagaagtgccgttttgtagccatcacttccacaagatctttatgaaggacggacgctcccttgttgtgccctgccggaatcaggatgagctgatcggcagagctcgcattagccagggggccggatggtctctccgggaaaccgcctgtctgggcaaagcttatgcccagatgtggtcccttatgtacttccatagacgggacctgagactcgctagcatggccatctgctctgcggtccctacagagtggttccccacctcccgcacaacgtggagcattcacgcccatcaccaatggatgaccacagaggatatgctgaaggtgtggaaccgggtgtggatcgaagacaatcctaacatgaccgacaaaacacccgttcactcctgggaggatattccttatctggggaagagagaagacctctggtgtggctctctgatcggacttagctcccgcgctacctgggccaaaaatattcatacggctatcacccaggtcagaaacctgatcggcaaggaggaatacgtggattatatgcccgccatgaagcggtacagcgcgccgtttgagtctgagggggtgctctga

SEQ ID NO: 21015 - RNA, 9867 nt, synthetic construct
  misc_feature 1..9867: note = derived and/or modified CDS sequence (opt5) from DENV-4__JN638570__SS-prME
  source 1..9867: mol_type = other RNA
agcaccatcaccctgctctgcctgattcccacggtgatggccttccacctttccaccagagacggagagcctctgatgatcgtggctaagcatgaacgggggagaccgctcctgtttaagaccaccgagggaattaacaagtgtacacttatcgccatggatctgggcgaaatgtgcgaggacaccgttacatacaaatgtcccctcctggtgaataccgaacctgaggatattgactgctggtgtaacctgacgtctgcgtgggtgatgtatgggacctgcacacagagcggagagagacggcgcgaaaagagatccgtcgctctcacaccccactctggcatggggctggagacacgggccgaaacctggatgagctccgagggagcctggaaacatgctcaacgcgtggagtcttggatccttagaaatcctggcttcgccctgctcgctggctttatggcctacatgatcgggcagacgggcattcagcggacagttttctttatcctgatgatgcttgtggcccccagctatggcatgcgctgtgtcggggtgggaaacagagatttcgttgaaggcgtgtccgggggagcctgggtcgacctggtgctcgagcacggcggctgcgtgaccacaatggctcaggggaagcctaccctggattttgaactgattaagaccacagccaaagaggtcgctctcctgcggacgtactgtatcgaagccagcatttctaatatcaccacagcgacccgctgccccacacaaggagagccctatcttaaggaggaacaggaccagcagtacatttgtagacgggatatggttgaccgcggctgggggaacggatgcggcctgttcgggaaaggaggcgtggtgacctgcgccaagttttcctgtctcggcaaaatcacggggaatctggtccaaatcgagaaccttgaatatacagtggttgtgaccgtccataatggagatacccacgctgtgggcaacgacacaagcaatcacggggttaccgccacaattacgcctagatctccctccgtggaggtcaagctgcctgattacggagaactcaccctggactgcgagccccggagcggcatcgacttcaacgagatgattctgatgaagatgaaaacaaagacctggctcgtgcataaacagtggtttctggatcttccgctgccttggacaaccggggctgacacgctcgaagtccactggaatcataaggagagaatggtgaccttcaaagttccccacgccaagcgccaggatgtgacagtcctgggctctcaggaaggagccatgcactccgctcttgcgggcgccaccgaggtggacagcggggatggaaaccatatgtttgctggccacctgaaatgtaaggttcggatggaaaagctcagaatcaaagggatgtcctacacaatgtgctctggaaagttcagcattgacaaagagatggccgagacccaacatggcacgacagtggtcaaggtgaaatatgaagggaccggcgccccttgtaaggtgcccatcgagatccgcgatgttaataaggaaaaagtcgtgggacggattatctccagcacacccttcgctgagaacaccaactctgtgaccaatattgagctggaacctccgtttggcgactcctacatcgtcattggggtgggagatggcgccctgacactccactggttcagaaaggggagctctatcggaaaaatgtttgagagcacgtatcgcggcgcgaagcggatggctatcctgggggaaaccgcctgggacttcggctccgttggaggccttctgacatctctcgggaaagccgtgcatcaggtctttggaagcgtgtacaccacaatgttcggcggggtttcctggatggtgcgcattctgatcggactgcttgtcctctggattggcaccaacagccgcaatacgtctatggctatgtcctgcatcgccgttgggggaattacactgtttctgggattcaccgtgcacgctgatatgggctgtgtggtcagctggtctgggaaggagctcaagtgcggatccggcatctttgtgattgacaacgtgcacacctggacagaacagtataaattccaacccgagagccctgcccggctggcgtccgccatccttaatgctcataaggagggggtctgtggaatcagatctaccacacgcctggaaaacgttatgtggaaacagattacgaatgagctcaactacgtgctgtgggaaggcggccacgacctgaccgtggtcgccggggatgtgaagggagttcttagcaaaggcaagcgggctctcgcgccccctgtgaatgacctgaagtattcctggaaaacatgggggaaggcgaaaatctttacccccgagacaagaaactctaccttcctggtcgatggaccggacacgagcgaatgccctaatgagcggcgcgcctggaactttctcgaggtggaagattacggcttcgggatgttcaccacaaatatttggatgaagtttagagagggatcccccgaagtttgtgaccatcggctgatgagcgctgccatcaaagatcagaaggctgtgcacgccgacatgggctactggattgagtcttccaaaaaccagacctggcaaatcgaaaaggccagccttatcgaggtcaagacatgcctgtggcctaaaacccacacactctggtctaatggcgtgctggagtcccagatgctgattcccaaggcttatgcggggcctatcagccagcataactacagacagggatatgccacccaaacggctggcccctggcaccttgggaaactcgaaattgatttcggagagtgcccgggcacaaccgttaccgtgcaggaagactgtgatcatcgcgggccttctctgcggacaaccacggccagcggaaagctggtcacacagtggtgctgtagatcctgcaccatgccgcccctccgctttctgggcgaggacggctgttggtacgggatggagatcagacctcttaacgaaaaagaggaaaatatggtcaagagccaggtgtctgccggacaaggcacatccgagaccttcagcatggggctgctctgcctgacactgtttgtcgaagagtgtcttcggcgcagagttacccggaagcacatgatgctcgtggtggtcacgaccctgtgcgctattatcctgggaggcctcacatggatggatctgcttcgcgccctgatcatgctcggggacaccatgtccggaagaatgggcggccagattcatctggcgatcatggctgtgttcaaaatgtctccggggtatgttctgggaatttttcttcggaagctgacaagccgcgagaccgccctcatggtgatcggcatggccatgacgacagtcctggctattccccacgacctcatggagttcatcgatgggatctccctgggacttattctgctcaaaatggtgacccactttgacaacacacaggttggcaccctggccctggcgcttaccttcatcaagtctacaatgcctctggtgatggcttggagaacgattatggccgtcctctttgtggtcaccctgatccccctctgtcggacaagctgcctgcagaaacaatcccattgggtggagattaccgcccttatcctgggggctcaggccctccctgtttacctgatgacactgatgaagggagcttctaagcgcagctggccccttaatgaaggcattatggccgtgggcctggtctccctcctggggagcgcgctcctgaaaaacgatgtgcctcttgccggacccatggttgctggcgggctgctgctcgccgcttatgtgatgtctggatccagcgccgacctgtctcttgagaaggccgctaatgtcagatgggatgaaatggcggacatcaccggctccagcccgatcattgaggtgaaacaggatgaggacgggtctttctccatccgggatgtggaagagacgaacatgattacactgctcgttaagctggccctcatcaccgtcagcggactgtaccctcttgctattcccgtgaccatgacactgtggtacatgtggcaagtgaaaacccagagatccggcgccctgtgggacgtccctagccccgccgctgcccagaaggcgacactcacggaaggcgtgtatcgcatcatgcagcgggggctgtttggaaagacccaagttggcgtggggatccacacagagggagtcttccataccatgtggcacgtgacaagaggctctgttatttgtcatgaaagcgggcgccttgagccgtcctgggctgatgtgcggaatgacatgatctcttacggaggcggctggagactgggggataaatgggacaaggaggaagacgtccaggtgctcgccattgagcctggcaagaaccccaagcacgttcagaccaaacctggcctgttcaagacgctcaccggggaaatcggagccgtgacactggattttaaacccggcaccagcgggtcccccattatcaatcgcaagggcaaggtcatcggactttatggcaacggggtggtgacaaaatctggagactacgtcagcgctattacccaggccgagcggatcggcgagcctgattatgaagttgacgaggatattttcagaaagaaacgcctgacaatcatggacctgcacccgggggcgggaaagacgaaacggattctcccctccatcgtgagagaagctctgaagcggcgccttagaaccctgattctcgcccctacacgggtggtcgccgctgagatggaagaggccctgcgcggcctccccatcagataccaaacccctgctgtgaagtctgagcataccgggcgggaaatcgttgatctgatgtgccacgccacatttacgaccagacttctgagctccacacgcgtgcccaattataacctgattgtcatggacgaggcgcatttcaccgatcctagctctgtggccgctcggggctacatctccacaagagttgaaatgggagaggccgctgccatttttatgaccgccacgccgcccggcacaaccgaccctttcccccagagcaattctcctatcgaagatattgagcgcgagatccccgaacggtcctggaacaccgggtttgactggatcacagactaccagggaaaaaccgtgtggttcgtcccgagcattaaggctggcaatgatatcgcgaactgcctcagaaaatccgggaagaaagtgattcagctgtctcgcaagacatttgacaccgagtatcctaagacgaaacttacagattgggacttcgtcgtgaccacagatatcagcgaaatgggagccaactttcgggctggcagagttattgacccccgcagatgtctgaagcccgtgatcctcaccgatgggcctgagcgggtgatcctggccggccccattcctgtcacgccggcctccgctgcccaacgcagaggacggatcggccgcaatcccgcgcaggaagacgatcagtacgttttcagcggggaccctctgagaaacgatgaggaccacgctcactggaccgaggccaaaatgctccttgataatatttatacacccgaaggaatcattcctaccctgttcggccccgagcgggaaaagacacaagccatcgacggggagtttagactgcgcggagagcagcggaaaaccttcgtggaactcatgagacgcggcgacctgccggtgtggctttcttacaaggtcgcttccgccggcattagctataaggatcgggagtggtgctttacaggggaaagaaacaatcagatcctggaggaaaacatggaggtggagatctggacccgggaaggagagaaaaagaaactccgccctaagtggctggacgcgagagtttacgccgatcccatggctctgaaagacttcaaggaatttgcctctggccggaaaagcattacgctcgatatccttacagagattgcttccctgcctacctatctgtctagccgcgccaaactcgctctggacaatatcgtgatgcttcataccacagaaagagggggaaaggcctaccagcacgcgctgaacgagctccccgagtccctggaaaccctgatgctcgtcgcccttctgggcgctatgacagccgggattttcctgtttttcatgcaaggaaaaggcatcggcaagctctctatggggctgatcgctattgccgtggccagcggacttctgtgggtcgctgagatccagcctcagtggattgcggcctccatcattctcgaatttttcctgatggtgctgctcgttcccgagccggaaaaacagcggacgcctcaagataatcagcttatctacgtgatcctgaccattctgacaatcattgctctcgtcgccgccaacgagatgggcctgatcgagaagaccaaaacagactttgggttctatcaggtgaaggctgaaaccacgattcttgatgttgacctgcgccccgccagcgcgtggaccctctacgccgtggctacaaccatcctgacacccatgctgagacataccattgagaatacgtctgccaacctctcccttgctgccatcgcgaatcaggccgctgtcctgatgggactgggcaaggggtggcctctccaccggatggatctgggagtgccgcttctggccatgggctgttatagccaagtgaaccccacaaccctcacagcttccctggttatgctgctcgtccattacgccatcattggccctgggcttcaggctaaagccacccgcgaagcgcagaagagaaccgccgctggaatcatgaaaaatcccacagtggacggcattacggtgatcgatctggagcctatttcttatgaccccaagtttgagaaacagctggggcaagtcatgctcctggttctttgcgccggacagctgctcctgatgcggaccacatgggctttctgtgaagtgctgaccctcgccacaggccctatccttaccctgtgggaggggaacccgggaagattctggaacacgacaatcgccgtgagcaccgcgaatatttttcgcggctcctacctggctggcgccgggctcgctttctctctgatcaagaacgcccagacaccccggagaggaacaggcaccacaggggaaacgcttggagagaagtggaaacgccaactgaatagcctcgaccggaaggaatttgaggagtataaaagatccggcattctggaagtcgatcgcaccgaggccaagagcgctctgaaagacgggtctaagatcaagtacgccgtgtcccggggaacaagcaaaattagatggatcgttgaacgcggcatggtgaagcctaaaggcaaggtcgtggatctcgggtgcggacggggcgggtggtcttactatatggcgacccttaaaaacgttacagaggtgaagggatacaccaagggcgggcccggacacgaagaacctatccccatggccacgtatggctggaatctggtcaaactgcactccggcgtggacgtgttctacaagccgaccgagcaggtcgatacactcctgtgtgacattggggaaagctctagcaaccctaccatcgaggaaggaagaacacttcgcgttctgaaaatggtggagccctggctctcctctaagcccgaattttgcattaaagtgctgaatccttatatgcccaccgtcatcgaggagctggaaaagctccagcggagatacggcgggagccttgtgcgctgtcctctgtccagaaacagcacacatgagatgtattgggtttccggagtgtctggcaatattgtcagctccgtgaacaccacgtctaaaatgctgctcaatcggttcacaacccgccacagaaagccgacctacgaacgggatgctgacctgggggccggaacaagaagcgtttccacggagaccgagaagcccgatatgacaatcattggccggcgccttcagagactgcaagaagaacataaagaaacctggcactacgaccacgagaacccttatcggacatgggcttaccatggctcttatgaagcccccagcaccgggtccgcgagctctatggtgaatggagtcgtgaagctcctgacaaaaccttgggatgttgtgcccatggtcacccagctggccatgacggacaccacaccgtttggccagcagcgcgtgttcaaggagaaagtcgacaccagaacacctcaacccaagcctgggacccgggtggttatgacgacaaccgctaactggctctggacactgcttggacgcaagaaaaatcccagactgtgcacccgggaggaatttatctccaaggtgcgcagcaacgccgctatcggcgccgtcttccaggaggaacaggggtggacgtctgcttccgaggccgtgaatgatagcagattttgggaactcgtggacaaagagcgggcgctgcaccaggagggcaagtgtgaatcttgcgtttacaacatgatgggaaaacgcgagaagaaacttggcgagttcgggagagccaaaggatcccgggctatttggtatatgtggctgggcgcccgctttctcgagttcgaagctctggggttcctgaacgaggatcattggtttggaagagagaatagctggtccggcgtggaaggggagggcctccaccggctgggatacatccttgaagacattgataagaaagacggcgatctgatctatgccgacgataccgccgggtgggacacaagaattaccgaggatgacctcctgaacgaggaacttatcacagagcaaatggcgcctcatcacaagatcctggctaaagccattttcaagctcacctaccagaataaggtcgtgaaagttctgcgccccacaccgaagggagccgtgatggatatcattagccggaaagaccagagaggctctgggcaagtcggaacctacggcctgaacacgtttacaaatatggaagtgcagctcatccgccagatggaggctgaaggggtcattacccgggacgatatgcacaaccctaagggcctgaaagagagagtggagaagtggcttaaagaatgcggagttgaccgcctgaagcggatggccatcagcggcgatgactgtgtggtcaagcccctcgatgagagattctccacctctctgctttttctgaatgacatggggaaagtgcgcaaggatatcccccagtgggaacctagcaaaggatggaagaactggcaagaggttccgttctgctcccatcactttcataaaattttcatgaaggacggccggtctctcgtggtcccctgtagaaatcaggatgaactgatcgggcgcgctcggattagccagggagccggctggtccctgagagagacagcgtgcctcgggaaggcctatgctcagatgtggtctctgatgtactttcaccggagagaccttcgcctggccagcatggctatctgttccgccgtgcctaccgagtggttccccacaagccggacgacctggtctattcacgcgcatcaccaatggatgacaaccgaagatatgctcaaagtgtggaacagagtttggatcgaggacaatcctaacatgatcgacaagacacccgtccattcctgggaagatattccttatctgggcaaacgcgaggacctttggtgcggaagcctgatcggcctctcttccagagccacctgggctaagaatattcacacggccatcacccaggtgcggaacctgattgggaaagaagagtacgtggattatatgcccgctatgcgcagatacagcgcccattttgagtccgaaggagtcctgtga

SEQ ID NO: 21016 - RNA, 9867 nt, synthetic construct
  misc_feature 1..9867: note = derived and/or modified CDS sequence (opt5) from DENV-4__JN638571__SS-prME
  source 1..9867: mol_type = other RNA
agcaccatcaccctgctgtgcctgattcccacggtgatggccttccacctttccaccagagacggagagcctctgatgatcgtggctaagcatgaacgggggagaccgctcctgtttaaaacaaccgagggaattaacaagtgtacacttatcgccatggatctgggcgaaatgtgcgaggacaccgttacatacaaatgtcccctcctggtgaataccgaacctgaggatattgactgctggtgtaacctgacgtctgcgtgggtgatgtatgggacctgcacacagagcggagagagacggcgcgaaaagagatccgtcgctctcacaccccactctggcatggggctggagacacgggccgaaacctggatgagctccgagggagcctggaaacatgctcaacgcgtggagtcttggatccttagaaatcctggcttcgccctgctcgctggctttatggcctacatgatcgggcagacgggcattcagcggacagttttctttatcctgatgatgcttgtggcccccagctatggcatgcgctgtgtcggggtgggaaacagagatttcgttgaaggcgtgtccgggggagcctgggtcgacctggtgctcgagcacggcggctgcgtgaccacaatggctcaggggaagcctaccctggattttgaactgattaagaccacagccaaagaggtcgctctcctgcggacgtactgtatcgaagccagcatttctaatatcaccacagcgacccgctgcccgacacaaggagagccctatcttaaggaggaacaggaccagcagtacatttgtagacgggatatggttgaccgcggctgggggaacggatgcggcctgttcgggaaaggaggcgtggtgacctgcgccaagttttcctgtctcggcaaaatcacggggaatctggtccaaatcgagaaccttgaatatacagtggttgtgaccgtccataatggagatacccacgctgtgggcaacgacacaagcaatcacggggttaccgccacaattacgcctagatctccctccgtggaggtcaagctgcctgaatacggagagctcaccctggattgcgagccccggagcggcatcgacttcaacgaaatgattctgatgaagatgaaaacaaagacctggctcgtgcataaacagtggtttctggaccttccgctgccttggacaaccggggctgatacgctcgaggtccactggaatcataaggaaagaatggtgaccttcaaagttccccacgccaagcgccaggacgtgacagtcctgggctctcaggagggagccatgcactccgctcttgcgggcgccaccgaagtggatagcggggacggaaaccatatgtttgctggccacctgaaatgtaaggttcggatggagaagctcagaatcaaagggatgtcctacacaatgtgctctggaaagttcagcattgataaagagatggccgaaacccaacatggcacgacagtggtcaaggtgaaatatgaggggaccggcgccccttgtaaggtgcccatcgaaatccgcgacgttaataaggagaaagtcgtgggacggattatctccagcacacccttcgctgagaacaccaactctgtgaccaatattgaactggagcctccgtttggcgattcctacatcgtcattggggtgggagacggcgccctgacactccactggttcagaaaggggagctctatcggaaaaatgtttgaaagcacgtatcgcggcgcgaagcggatggctatcctgggggagaccgcctgggatttcggctccgttggaggccttctgacatctctcgggaaagccgtgcatcaggtctttggaagcgtgtacaccacaatgttcggcggggtttcctggatggtgcgcattctgatcggactgcttgtcctctggattggcaccaacagccgcaatacgtctatggctatgtcctgcatcgccgttgggggaattacactgtttctgggattcaccgtgcacgctgacatgggctgtgtggtcagctggtctgggaaggaactcaagtgcggatccggcatctttgtgattgataacgtgcacacctggacagagcagtataaattccaacccgagagccctgcccggctggcgtccgccatccttaatgctcataaggaaggggtctgtggaatcagatctaccacacgcctggagaacgttatgtggaaacagattacgaatgaactcaactacgtgctgtgggagggcggccacgacctgaccgtggtcgccggggacgtgaagggagttcttagcaaaggcaagcgggctctcgcgccccctgtgaatgatctgaagtattcctggaaaacatgggggaaggcgaaaatctttacccccgaaacaagaaactctaccttcctggtcgacggaccggatacgagcgagtgccctaatgagcggcgcgcctggaactttctcgaagtggaggactacggcttcgggatgttcaccacaaatatttggatgaagtttagagaaggatccagcgaggtttgtgatcatcggctgatgtctgctgccatcaaagaccagaaggctgtgcacgccgatatgggctactggattgaatccagcaaaaaccagacctggcaaatcgagaaggcctctcttatcgaggtcaagacatgcctgtggcccaaaacccacacactctggtccaatggcgtgctggaaagccagatgctgattcctaaggcttatgcggggcccatctctcagcataactacagacagggatatgccacccaaacggctggcccttggcaccttgggaaactcgagattgacttcggagaatgccccggcacaaccgttaccgtgcaggaggattgtgaccatcgcgggccgagcctgcggacaaccacggcctccggaaagctggtcacacagtggtgctgtagaagctgcaccatgcctcccctccgctttctgggcgaggatggctgttggtacgggatggaaatcagaccccttaacgagaaagaagagaatatggtgaagtctcaggtgtccgccggacaaggcacaagcgaaaccttctccatggggctgctctgcctgacactgtttgtcgaggagtgtcttcggcgcagagttacccggaagcacatgatgctcgtggtggtcacgaccctgtgcgctattatcctgggaggcctcacatggatggacctgcttcgcgccctgatcatgctcggggataccatgtctggaagaatgggcggccagattcatctggcgatcatggctgtgttcaaaatgagccctgggtatgttctgggaatttttcttcggaagctgacatcccgcgaaaccgccctcatggtgatcggcatggccatgacgacagtcctggctattccgcacgacctcatggagttcatcgacgggatctctctgggacttattctgctcaaaatggtgacccactttgataacacacaggttggcaccctggccctggcgcttaccttcatcaagagcacaatgcccctggtgatggcttggagaacgattatggccgtcctctttgtggtcaccctgatccctctctgtcggacatcctgcctgcagaaacaatctcattgggtggaaattaccgcccttatcctgggggctcaggccctccccgtttacctgatgacactgatgaagggagctagcaagcgctcctggcctcttaatgagggcattatggccgtgggcctggtcagcctcctggggtctgcgctcctgaaaaacgacgtgccccttgccggacctatggttgctggcgggctgctgctcgccgcttatgtgatgtccggaagctctgccgatctgtcccttgaaaaggccgctaatgtcagatgggacgagatggcggatatcaccggcagctctcccatcattgaggtgaaacaggacgaagatgggtccttcagcatccgggacgtggaggaaacgaacatgattacactgctcgttaagctggccctcatcaccgtctccggactgtacccgcttgctattcctgtgaccatgacactgtggtacatgtggcaagtgaaaacccagagaagcggcgccctgtgggatgtcccctctcctgccgctgcccagaaggcgacactcacggagggcgtgtatcgcatcatgcagcgggggctgtttggaaagacccaagttggcgtggggatccacacagaaggagtcttccataccatgtggcacgtgacaagaggcagcgttatttgtcatgagtccgggcgccttgagccctcttgggctgacgtgcggaatgatatgatcagctacggaggcggctggagactgggggacaaatgggataaggaagaggacgtccaggtgctcgccattgaaccgggcaaaaaccctaagcacgttcagaccaaacccggcctgttcaagacgctcaccggggagatcggagccgtgacactggactttaaacctggcacctccgggtctcccattatcaatcgcaagggcaaggtcatcggactttatggcaacggggtggtgacaaaaagcggagattacgtctccgctattacccaggccgagcggatcggcgaacccgactatgaggttgatgaagacattttcagaaagaaacgcctgacaatcatggatctgcaccctggggcgggaaagacgaaacggattctcccgtctatcgtgagagaggctctgaagcggcgccttagaaccctgattctcgcccccacacgggtggtcgccgctgaaatggaggaggccctgcgcggcctccctatcagataccaaacccccgctgtcaagagcgaacataccgggcgggagatcgttgacctgatgtgccacgccacatttacgaccagacttctgtccagcacacgcgtgcctaattataacctgattgtcatggatgaagcgcatttcaccgacccctcttccgtggccgctcggggctacatcagcacaagagttgagatgggagaagccgctgccatttttatgaccgccacgcctccgggcacaaccgatcccttccctcagtctaattcccccatcgaggacattgagcgcgaaatccctgagcggagctggaacaccgggtttgattggatcacagactaccagggaaaaaccgtgtggttcgtcccctccattaaggctggcaatgacatcgcgaactgcctcagaaaatctgggaagaaagtgattcagctgagccgcaagacatttgataccgaatatccgaagacgaaacttacagactgggatttcgtcgtgaccacagacatctccgagatgggagccaactttcgggctggcagagttattgatcctcgcagatgtctgaagcccgtgatcctcaccgacgggcccgaacgggtgatcctggccggccctattcccgtcacgcctgccagcgctgcccaacgcagaggacggatcggccgcaatccggcgcaggaggatgaccagtacgttttctctggggatcccctgagaaacgacgaggatcacgctcactggaccgaagccaaaatgctccttgacaatatttatacacctgagggaatcattcccaccctgttcggccctgaacgggagaagacacaagccatcgatggggagtttagactgcgcggagaacagcggaaaaccttcgtggagctcatgagacgcggcgacctgcccgtgtggctttcctacaaggtcgctagcgccggcatttcttataaggaccgggaatggtgctttacaggggagagaaacaatcagatcctggaagagaacatggaggtggaaatctggacccgggagggagagaaaaagaaactccgcccgaagtggctggatgcgagagtttacgccgaccctatggctctgaaagatttcaaggagtttgccagcggccggaagtccattacgctcgacatccttacagaaattgcttctctgcccacctatctgagctcccgcgccaaactcgctctggataatatcgtgatgcttcataccacagagagagggggaaaggcctaccagcacgcgctgaacgagctccctgaatctctggagaccctgatgctcgtcgcccttctgggcgctatgacagccgggattttcctgtttttcatgcaaggaaaaggcatcggcaagctcagcatggggctgatcgctattgccgtggcctccggacttctgtgggtcgctgaaatccagccccagtggattgcggccagcatcattctcgagtttttcctgatggtgctgctcgttcctgaacccgagaaacagcggacgccgcaagacaatcagcttatctacgtgatcctgaccattctgacaatcattgctctcgtcgccgccaacgagatgggcctgatcgaaaagaccaaaacagattttgggttctatcaggtgaaggctgagaccacgattcttgacgttgatctgcgccctgcctctgcgtggaccctctacgccgtggctacaaccatcctgacacccatgctgagacataccattgaaaatacgtccgccaacctcagccttgctgccatcgcgaatcaggccgctgtcctgatgggactgggcaaggggtggcccctccaccggatggacctgggagtgcctcttctggccatgggctgttattcccaagtgaacccgacaaccctcacagcttctctggttatgctgctcgtccattacgccatcattggccccgggcttcaggctaaagccacccgcgaggcgcagaagagaaccgccgctggaatcatgaaaaatcctacagtggatggcattacggtgatcgacctggagcccattagctatgatcctaagtttgaaaaacagctggggcaagtcatgctcctggttctttgcgccggacagctgctcctgatgcggaccacatgggctttctgtgaggtgctgaccctcgccacaggccccatccttaccctgtgggaagggaaccctggaagattctggaacacgacaatcgccgtgtccaccgcgaatatttttcgcggctcttacctggctggcgccgggctcgctttcagcctgatcaagaacgcccagaccccgcggagaggaacaggcaccacaggggagacgcttggagaaaagtggaaacgccaactcaattccctcgaccggaaggagtttgaggaatataaaagaagcggcattctggaggtcgaccgcaccgaagccaagtctgctctgaaagatgggtccaagatcaagtacgccgtgagccggggaacatctaaaattagatggatcgttgagcgcggcatggtgaagcccaaaggcaaggtcgtggacctcgggtgcggacggggcgggtggtcctactatatggcgacccttaaaaacgttacagaagtgaagggatacaccaagggcgggcctggacacgaggagcccatccctatggccacgtatggctggaatctggtcaaactgcacagcggcgtggatgtgttctacaagcccaccgaacaggtcgacacactcctgtgtgatattggggagtctagctccaacccgaccatcgaagagggaagaacacttcgcgttctgaaaatggtggaaccttggctctctagcaagcccgagttttgcattaaagtgctgaatccctatatgcctaccgtcatcgaggaactggagaagctccagcggagatacggcgggtcccttgtgcgctgtcccctgagcagaaactccacacatgaaatgtattgggtttctggagtgagcggcaatattgtctcctctgtgaacaccacgagcaaaatgctgctcaatcggttcacaacccgccacagaaagcctacctacgagcgggacgctgatctgggggccggaacaagatccgtttctacggagaccgaaaagccggacatgacaatcattggccggcgccttcagagactgcaagaggaacataaagagacctggcactacgatcacgaaaacccctatcggacatgggcttaccatggcagctatgaggccccttccaccgggagcgcgtcttccatggtgaatggagtcgtgaagctcctgacaaaaccctgggacgttgtgcctatggtcacccagctggccatgacggataccacaccctttggccagcagcgcgtgttcaaggagaaagtcgacaccagaacaccgcaacctaagcccgggacccgggtggttatgacgacaaccgctaactggctctggacactgcttggacgcaagaaaaatcctagactgtgcacccgggaagagtttatcagcaaggtgcgcctcaacgccgctatcggcgccgtcttccaggaagaacaggggtggacgtctgcttccgaagccgtgaatgacagcagattttgggagctggtggataaagagcgggcgcttcaccaggaaggcaagtgtgagtcttgcgtttacaacatgatgggaaaacgcgaaaagaagctgggcgagttcgggagagccaaaggatcccgggctatttggtatatgtggctcggcgcccgctttctggagttcgaggctctggggttcctcaacgaggaccattggtttggaagagaaaatagctggtccggcgtggagggggaaggcctgcaccggcttggatacatcctggaggatattgacaagaaagatggcgacctcatctatgccgatgacaccgccgggtgggatacaagaattaccgaggacgatctgcttaacgaagaactgatcacagaacaaatggcgccccatcacaagatcctcgctaaagccattttcaagctgacctaccagaataaggtcgtgaaagttctgcgccctacacccaagggagccgtgatggacatcattagccggaaagatcagagaggctctgggcaagtcggaacctacggcctcaacacgtttacaaatatggaggtgcagctgatccgccagatggaagctgagggggtcattacccgggacgacatgcacaacccgaagggccttaaagagagagtggaaaagtggctgaaagagtgcggagttgatcgcctcaagcggatggccatcagcggcgacgattgtgtggtcaagcctctggacgaaagattctccacctctcttctgtttctcaatgatatggggaaagtgcgcaaggacatcccccagtgggagcccagcaaaggatggaagaactggcaagaagttcctttctgctcccatcactttcataaaattttcatgaaggatggccggtctctggtggtcccgtgtagaaatcaggacgagctgatcgggcgcgctcggattagccagggagccggctggtccctcagagagacagcgtgcctggggaaggcctatgctcagatgtggtctcttatgtactttcaccggagagatctgcgcctcgccagcatggctatctgttccgccgtgcccaccgaatggttccctacaagccggacgacctggtctattcacgcgcatcaccaatggatgacaaccgaggacatgctgaaagtgtggaacagagtttggatcgaagataatcccaacatgatcgacaagacacctgtccattcctgggaggacattccctatcttggcaaacgcgaagatctgtggtgcggaagcctcatcggcctgtcttccagagccacctgggctaagaatattcacacggccatcacccaggtgcggaacctgattgggaaagaggagtacgtggactatatgcctgctatgcgcagatacagcgcccattttgaatccgagggagtcctctga

SEQ ID NO: 21017 - RNA, 9867 nt, synthetic construct
  misc_feature 1..9867: note = derived and/or modified CDS sequence (opt5) from DENV-4__JN638572__SS-prME
  source 1..9867: mol_type = other RNA
agcaccatcaccctgctgtgcctgattcccacggtgatggccttccacctttccaccagagacggagagcctctgatgatcgtcgctaagcatgaacgggggagaccgctcctgtttaaaacaaccgagggaattaacaagtgtacacttatcgccatggatctgggcgaaatgtgcgaggacaccgttacatacaaatgtcccctcctggtgaataccgaacctgaggatattgactgctggtgtaacctgacgtctgcctgggtgatgtatgggacctgcacacagagcggagagagacggagagaaaagagatccgtcgctctcacaccccactctggcatggggctggagacacgggccgaaacctggatgagctccgagggagcctggaaacatgctcaacgcgtggagtcttggatccttagaaatcctggcttcgccctgctcgctggctttatggcctacatgatcgggcagacgggcattcagcggacagttttctttatcctgatgatgcttgtggcccccagctatggcatgcgctgtgtcggggtgggaaacagagatttcgttgaaggcgtgtccgggggagcctgggtcgacctggtgctcgagcacggcggctgcgtgaccacaatggctcaggggaagcctaccctggattttgaactgattaagaccacagccaaagaggtcgctctcctgcggacgtactgtatcgaagccagcatttctaatatcaccacagcgacccgctgcccgacacaaggagagccctatcttaaggaggaacaggaccagcagtacatttgtagacgggatatggttgaccgcggctgggggaacggatgcggcctgttcgggaaaggaggcgtggtgacctgcgccaagttttcctgtctcggcaaaatcacggggaatctggtccaaatcgagaaccttgaatatacagtggttgtgaccgtccataatggagatacccacgctgtgggcaacgacacaagcaatcacggggttaccgccacaattacgcctagatctccctccgtggaggtcaagctgcctgaatacggagagctcaccctggattgcgagccccggagcggcatcgacttcaacgaaatgattctgatgaagatgaaaacaaagacctggctcgtgcataaacagtggtttctggaccttccgctgccttggacaaccggggctgatacgctcgaggtccactggaatcataaggaaagaatggtgaccttcaaagttccccacgccaagcgccaggacgtgacagtcctgggctctcaggagggagccatgcactccgctcttgcgggcgccaccgaagtggatagcggggacggaaaccatatgtttgctggccacctgaaatgtaaggttcggatggagaagctcagaatcaaagggatgtcctacacaatgtgctctggaaagttcagcattgataaagagatggccgaaacccaacatggcacgacagtggtcaaggtgaaatatgaggggaccggcgccccttgtaaggtgcccatcgaaatccgcgacgttaataaggagaaagtcgtgggacggattatctccagcacacccttcgctgagaacaccaactctgtgaccaatattgaactggagcctccgtttggcgattcctacatcgtcattggggtgggagacggcgccctgacactccactggttcagaaaggggagctctatcggaaaaatgtttgaaagcacgtatcgcggcgcgaagcggatggctatcctgggggagaccgcctgggatttcggctccgttggaggccttctgacatctctcgggaaagccgtgcatcaggtctttggaagcgtgtacaccacaatgttcggcggggtttcctggatggtgcgcattctgatcggactgcttgtcctctggattggcaccaacagccgcaatacgtctatggctatgtcctgcatcgccgttgggggaattacactgtttctgggattcaccgtgcacgctgacatgggctgtgtggtcagctggtctgggaaggaactcaagtgcggatccggcgtgtttgtgatcgataacgtccacacctggacagagcagtataaattccaacccgagagccctgcccggctggcgtccgccattcttaatgctcataaggaaggggtttgtggaatcagatctaccacacgcctggagaacgtgatgtggaaacagatcacgaatgaactcaactacgtgctgtgggagggcggccacgacctgaccgtcgtggccggggacgttaagggagtgcttagcaaaggcaagcgggctctcgcgccccctgtcaatgatctgaagtattcctggaaaacatgggggaaggcgaaaatttttacccccgaaacaagaaactctaccttcctggtggacggaccggatacgagcgagtgccctaatgagcggcgcgcctggaactttctcgaagttgaggactacggcttcgggatgttcaccacaaatatctggatgaagtttagagaaggatccagcgaggtgtgtgatcatcggctgatgtctgctgccattaaagaccagaaggctgtccacgccgatatgggctactggatcgaatccagcaaaaaccagacctggcaaattgagaaggcctctcttatcgaggtgaagacatgcctgtggcccaaaacccacacactctggtccaatggcgttctggaaagccagatgctgatccctaaggcttatgcggggcccatttctcagcataactacagacagggatatgccacccaaacggctggcccttggcaccttgggaaactcgagatcgacttcggagaatgccccggcacaaccgtgaccgtccaggaggattgtgaccatcgcgggccgagcctgcggacaaccacggcctccggaaagctggtgacacagtggtgctgtagaagctgcaccatgcctcccctccgctttctgggcgaggatggctgttggtacgggatggaaattagaccccttaacgagaaagaagagaatatggtgaagtctcaggtctccgccggacaaggcacaagcgaaaccttctccatggggctgctctgcctgacactgtttgttgaggagtgtcttcggcgcagagtgacccggaagcacatgatcctcgtggtcgtgacgaccctgtgcgctattatcctgggaggcctcacatggatggacctgcttcgcgccctgatcatgctcggggataccatgtctggaagaatgggcggccagattcatctggcgatcatggctgttttcaaaatgagccctgggtatgtgctgggaatttttcttcggaagctgacatcccgcgaaaccgccctcatggtcatcggcatggccatgacgacagtgctggctattccgcacgacctcatggagttcatcgacgggatctctctgggacttattctgctcaaaatggttacccactttgataacacacaggtgggcaccctggccctggcgcttaccttcatcaagagcacaatgcccctggtcatggcttggagaacgattatggccgtgctctttgtcgtgaccctgatccctctctgtcggacatcctgcctgcagaaacaatctcattgggttgaaattaccgcccttatcctgggggctcaggccctccccgtgtacctgatgacactgatgaagggagctagcaagcgctcctggcctcttaatgagggcattatggccgtcggcctggtgagcctcctggggtctgcgctcctgaaaaacgacgttccccttgccggacctatggtggctggcgggctgctgctcgccgcttatgtcatgtccggaagctctgccgatctgtcccttgaaaaggccgctaatgtgagatgggacgagatggcggatatcaccggcagctctcccatcattgaggtgaaacaggacgaagatgggtccttcagcatccgggacgttgaggaaacgaacatgattacactgctcgtcaagctggccctcatcaccgtgtccggactgtacccgcttgctattcctgtgaccatgacactgtggtacatgtggcaagtcaaaacccagagaagcggcgccctgtgggatgtgccctctcctgccgctgcccagaaggcgacactcacggagggcgtttatcgcatcatgcagcgggggctgtttggaaagacccaagtgggcgtcgggatccacacagaaggagtgttccataccatgtggcacgttacaagaggcagcgtgatttgtcatgagtccgggcgccttgagccctcttgggctgacgtccggaatgatatgatcagctacggaggcggctggagactgggggacaaatgggataaggaagaggacgtgcaggttctcgccattgaaccgggcaaaaaccctaagcacgtgcagaccaaacccggcctgttcaagacgctcaccggggagatcggagccgtcacactggactttaaacctggcacctccgggtctcccattatcaatcgcaagggcaaggtgatcggactttatggcaacggggtggtcacaaaaagcggagattacgtttccgctattacccaggccgagcggatcggcgaacccgactatgaggtggatgaagacattttcagaaagaaacgcctgacaatcatggatctgcaccctggggcgggaaagacgaaacggattctcccgtctatcgtgagagaggctctgaagcggcgccttagaaccctgattctcgcccccacacgggtcgtggccgctgaaatggaggaggccctgcgcggcctccctatcagataccaaacccccgctgttaagagcgaacataccgggcgggagatcgtggacctgatgtgccacgccacatttacgaccagacttctgtccagcacacgcgtccctaattataacctgattgtgatggatgaagcgcatttcaccgacccctcttccgttgccgctcggggctacatcagcacaagagtggagatgggagaagccgctgccatttttatgaccgccacgcctccgggcacaaccgatcccttccctcagtctaattcccccatcgaggacattgagcgcgaaatccctgagcggagctggaacaccgggtttgattggatcacagactaccagggaaaaaccgtctggttcgtgccctccattaaggctggcaatgacatcgcgaactgcctcagaaaatctgggaagaaagtcattcagctgagccgcaagacatttgataccgaatatccgaagacgaaacttacagactgggatttcgtggttaccacagacatctccgagatgggagccaactttcgggctggcagagtgattgatcctcgcagatgtctgaagcccgtgatcctcaccgacgggcccgaacgggtcatcctggccggccctattcccgttacgcctgccagcgctgcccaacgcagaggacggatcggccgcaatccggcgcaggaggatgaccagtacgtgttctctggggatcccctgagaaacgacgaggatcacgctcactggaccgaagccaaaatgctccttgacaatatttatacacctgagggaatcattcccaccctgttcggccctgaacgggagaagacacaagccatcgatggggagtttagactgcgcggagaacagcggaaaaccttcgtggagctcatgagacgcggcgacctgcccgtctggctttcctacaaggtggctagcgccggcatttcttataaggaccgggaatggtgctttacaggggagagaaacaatcagatcctggaagagaacatggaggttgaaatctggacccgggagggagagaaaaagaaactccgcccgaagtggctggatgcgagagtgtacgccgaccctatggctctgaaagatttcaaggagtttgccagcggccggaagtccattacgctcgacatccttacagaaattgcttctctgcccacctatctgagctcccgcgccaaactcgctctggataatatcgtcatgcttcataccacagagagagggggaaaggcctaccagcacgcgctgaacgagctccctgaatctctggagaccctgatgctcgtggcccttctgggcgctatgacagccgggattttcctgtttttcatgcaaggaaaaggcatcggcaagctcagcatggggctgatcgctattgccgtcgcctccggacttctgtgggtggctgaaatccagccccagtggattgcggccagcatcattctcgagtttttcctgatggttctgctcgtgcctgaacccgagaaacagcggacgccgcaagacaatcagcttatctacgtcatcctgaccattctgacaatcattgctctcgtggccgccaacgagatgggcctgatcgaaaagaccaaaacagattttgggttctatcaggttaaggctgagaccacgattcttgacgtggatctgcgccctgcctctgcgtggaccctctacgccgtcgctacaaccatcctgacacccatgctgagacataccattgaaaatacgtccgccaacctcagccttgctgccatcgcgaatcaggccgctgtgctgatgggactgggcaaggggtggcccctccaccggatggacctgggagtgcctcttctggccatgggctgttattcccaagttaacccgacaaccctcacagcttctctggtcatgctgctcgtgcattacgccatcattggccccgggcttcaggctaaagccacccgcgaggcgcagaagagaaccgccgctggaatcatgaaaaatcctacagtggatggcattacggtcatcgacctggagcccattagctatgatcctaagtttgaaaaacagctggggcaagttatgctcctggtgctttgcgtgggacagctgctcctgatgcggaccacatgggccctgtgtgaggtcctcacccttgctacaggccccatcatgaccctgtgggaagggaaccctggaagattctggaacacgacaatcgccgtgtccaccgccaatattttccgcggctcttacctggcgggcgctgggctcgcctttagcctgatcaagaacgctcagaccccgcggagaggaacaggcaccacaggggagacgcttggagaaaagtggaaacgccaactcaattccctcgaccggaaggagttcgaggaatataaaagaagcggcattctggaggttgaccgcaccgaagccaagtctgccctgcgggatgggtccaaaacaaagcacgctgtgagcagaggatcttccaagatccgctggattgtcgagcggggcatgatcaaacccaagggcaaagtggttgacctcgggtgcggaagaggcgggtggagctactacatggccacccttcagaacgtgacagaagtcaagggatataccaaaggcgggcctggacacgaggagcccatccctatggcgacgtacggctggaatctggtgaagctgcattctggcgtggatgtcttttataagcccaccgaacaggttgacacactcctgtgtgatattggggagagctcctctaacccgaccatcgaagagggacgcacacttcgggtgctgaaaatggtggaaccttggctcagctccaagcccgagttctgcattaaagtcctgaatccctacatgcctaccgtgatcgaggaactggagaagctccagagacgctatggcgggagccttgttagatgtcccctgtcccggaactctacacacgaaatgtactgggtgagcggagtctccggcaatattgtgtctagcgttaacaccacgtccaaaatgctgctcaatcgctttacaaccagacatcggaagcctacctatgagagagacgccgatctgggggctggaacacggtctgtgagcacggagaccgaaaaaccggacatgacaatcattggccgcagacttcaacggctgcaggaggaacacaaggagacctggcactacgatcatgaaaacccctaccgcacatgggcctatcacggctcctacgaggctcctagcaccgggtctgcctccagcatggtcaatggagtggttaagctcctgacaaaaccctgggacgtggtccctatggtgacccagctggcgatgacggataccacacccttcggccagcaaagagtctttaaggagaaagtggacacccggacaccgcagcctaagcccgggacccgcgttgtgatgacgacaaccgccaactggctctggacactgcttggacgcaaaaagaatcctcggctgtgcacccgcgaagagttcatctctaaggtcagatccaacgctgccatcggcgctgtgtttcaggaggaacaggggtggacgagcgcctctgaagctgtgaatgactcccggttctgggagctcgttgataaagagcgcgccctgcatcaagaaggcaagtgtgagagctgcgtgtataacatgatgggaaaaagagaaaagaaacttggcgagtttgggcgggcgaagggatcccgcgccatttggtacatgtggctgggcgctagattcctcgaatttgaggccctggggttcctgaacgaggaccactggttcggacgggaaaatagctggtctggcgtcgagggggaaggcctccatagactgggatatatccttgaggatattgacaagaaagatggcgacctgatctacgctgatgacaccgccgggtgggatacacgcattaccgaggacgatctcctgaacgaagaacttatcacagaacagatggcgccccaccacaaggtgctggcgaaagctatctttaagctcacctatcagaataaagttgtgaaggtcctgcggcctacacccaagggagccgtgatggacattatcagcagaaaagatcaacgcggctccgggcaggtcggaacctacggcctgaacacgttcacaaatatggaggtgcagctcattcggcagatggaagccgagggggttatcaccagagacgacatgcataacccgaagggcctgaaagagcgcgtggaaaagtggcttaaagagtgcggagtcgatcggctgaagagaatggctatttctggcgacgattgtgtggttaaacctctcgacgaacgctttagcacctccctgcttttcctgaatgatatggggaaggtgcggaaggacatcccccaatgggagccctctaaaggatggaagaactggcaggaagtccctttttgcagccaccatttccacaaaatctttatgaaggatggcagatccctcgtggtgccgtgtcgcaatcaggacgagctgattgggcgggccagaatctctcagggagctggctggagcctgcgggagacagcctgcctcgggaaagcgtacgcccaaatgtggtccctgatgtatttccacagacgcgatcttcggctggctagcatggccatttgttctgctgttcccaccgaatggtttcctacatccagaacgacctggagcatccatgcccaccatcagtggatgacaaccgaggacatgctcaaggtctggaaccgcgtgtggattgaagataatcccaacatgacagacaagacccctgtgcactcttgggaggacatcccctacctgggcaaaagagaagatctttggtgcggatccctgatcggcctcagctcccgggcgacgtgggccaagaatattcataccgctatcacacaggtccgcaacctgattgggaaagaggagtatatggactacatgcctgtgatgaagagatattctgcccccagcgaatccgagggagttctgtga

SEQ ID NO: 21018 - RNA, 9867 nt, synthetic construct
  misc_feature 1..9867: note = derived and/or modified CDS sequence (opt5) from DENV-4__JX024757__SS-prME
  source 1..9867: mol_type = other RNA
agcacaatgacactgctgtgcctgatccccacggtgatggccttccatctttccaccagagacggcgaacctctgatgattgtggctaagcatgaacgggggcgcccgctcctgtttaagacaaccgaaggaatcaacaagtgtacacttattgccatggatctgggcgaaatgtgcgaggacaccgttacatacaaatgtcccctcctggtgaataccgaacctgaggatatcgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggattcttagaaatcctggcttcgctctgctcgccggctttatggcttacatgatcgggcagacaggaatccagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtattgaagctagcatctctaatattaccacagccacccgctgcccgacgcaaggagagccctatcttaaggaggaacaggaccagcagtacatctgtagacgggatgtggtggaccgcggctgggggaacggatgcggcctgttcgggaaaggaggcgtcgtgacatgcgcgaagtttctctgttccggcaaaattaccgggaatctggttcaaatcgagaaccttgaatataccgtggtcgtgacagttcataatggagatacccacgccgtgggcaacgacacaagcaatcacggggtcacggctaccattacacctagatctccctccgtggaggtcaagctgcctgattacggagaactcaccctggactgcgagccccggagcggcatcgacttcaacgagatgatcctgatgaagatgaaaaagaaaacatggctcgtgcataagcagtggtttctggatcttccgctgccttggtctgccggggctgacacctccgaagttcactggaattacaaagagagaatggtgacgttcaaggtcccccatgccaaacgccaggatgtgaccgttctcggcagccaggaaggagccatgcactccgctctggcgggcgccacagaggtggactctggggatggaaaccacatgtttgctggccatcttaagtgtaaggtccggatggaaaaactgagaattaaggggatgagctataccatgtgctccggaaaattcagcatcgacaaggagatggccgagacacaacacggcaccacggtggtgaaagttaagtacgaaggggccggcgctccttgtaaggtccccattgagatccgcgatgtgaataaagaaaaggtggtcggacggattatctcttccacacccttcgccgagaacaccaacagcgtgacaaatatcgagctcgaacctccgtttggcgactcttatattgttatcggggtgggagatagcgcgctgaccctgcattggttcagaaaaggctcctctattgggaagatgtttgagagcacctaccgcggagctaaacggatggccatcctcggcgaaacagcctgggacttcgggtccgtcggcggactgtttacgagccttggcaaggctgtgcaccaggttttcgggtctgtgtataccacaatgtttggaggcgtctcctggatgattagaatcctgatcgggttcctcgtgctgtggattggaaccaacagccgcaatacatctatggccatgacctgcatcgctgttggcgggattacgctgtttcttggcttcacagtgcaggccgatatgggatgtgtcgtgtcctggaacggcaaggagctcaaatgcgggagcggaatctttgtggtcgacaatgttcatacctggaccgaacaatacaagttccagcccgagtcccctgcgcggctggcctctgctattctgaacgcccacaaagacggcgtgtgtgggatcagaagcacaacccgcctcgagaatgtgatgtggaagcagattacaaacgaactgaattatgtcctttgggagggaggccacgatctgacggtggttgctggcgacgtgaaaggggtcctcaccaagggaaagcgggccctgacaccccctgtgaacgatctgaaatactcctggaagacctggggcaaagcgaagatctttacacccgaagccagaaattctaccttccttatcgacgggccggatacgagcgagtgccctaacggacggcgcgcttggaatttcctcgaagttgaggactacggctttgggatgttcaccacaaacatttggatgaaatttagagagggatccagcgaagtgtgtgatcatcggctgatgtctgccgctatcaaggaccagaaagccgtccacgccgatatgggctattggattgagtccagcaagaatcaaacctggcagatcgaaaaggcttctctgattgaggtgaaaacatgcctctggcccaagacccatacactgtggtccaacggcgttcttgaaagccagatgctgatccctagatcttacgcggggcccttcagccagcacaactatcgccaaggatacgccacccagacggctggcccttggcacctcgggaaactggagatcgactttggagagtgccccggcacaaccgtgaccattcaggaagattgtgaccatcgggggccgtccctgagaacaaccacggccagcggaaaacttgtcacacagtggtgctgtcgctcttgcaccatgcctcccctcagattcctgggcgaggatggctgttggtatgggatggaaatccggcccctgtccgagaaagaggaaaatatggtcaagagccaagtgacagccggacagggcacctccgagacattttctatggggctcctgtgccttaccctgttcgtcgaagagtgtctccgcagacgggttacgcgcaagtacatgatgctggtggtggtcattaccttttgcgctatcattctgggaggccttacatggatggacctcctgagagccctgatcatgctcggggacaccatgagcggacggatcggcggccagattcacctggcgatcatggctgtgttcaaaatgtcccctgggtatgttcttggagtgtttctgcgcaagctcacatctagagaaaccgccctgatggtcattggcatggccatgacgacagtgttcagcatcccgcatgatctgatggagcttattgacgggatctccctgggactcatcctgctccggattgttacccactttgataacacacaggtgggcaccctggctctttctctgaccttcatccgcagcacaacgcccctcgtcatggcctggagaaccattatggcggtgttctttgtcgtgacactgatccctctgtgtcggacctcctgccttcaaaaacagagccattgggttgagattacagctctgatcctcggggcccaggccctgcccgtgtacctcatgaccctgatgaagggagcttctagacgctcctggcctcttaatgaaggcattatggccgtcggcctggtgagcctcctggggtctgctctgcttaaaaacgacgttcccctggccggacctatggtggcgggcgggctcctgctcgccgcttacgtcatgtccggaagctctgccgatctgtcccttgagaaggctgccaatgtgcaatgggacgaaatggccgatatcacgggcagctcccccatcattgaggtgaagcaggacgaagatgggagcttctctatccgggacgttgaggagacaaacatgattaccctgctggtcaaactcgctctgatcaccgtgagcggactttatccgctggcgattcctgtgacaatggccctctggtacatctggcaggtcaagacccagagatccggcgctctgtgggatgtgccctctcctgccgccacacaaaaagctacgctcagcgaaggcgtttatcgcatcatgcagcgggggctgtttggaaagacccaggtgggcgtcgggattcacatggagggagtgttccacacaatgtggcatgttaccagaggctccgtgatctgtcacgaaacagggcgccttgagccctcttgggccgacgtccggaatgatatgattagctacggaggcggctggagactgggggacaaatgggacaaggaagaggatgtgcaggttctggcgatcgagccgggaaagaaccctaaacatgtgcaaaccaagcccggcctctttaaaacgctgaccggggaaattggagctgtcacacttgacttcaagcctggcacctccgggtctcccatcatcaataaaaagggcaaagtgattggactgtatggcaacggggtggtcacaaagagcggagattacgtttccgccatcacccaggccgagcgcattggcgaacccgactatgaggtggatgaggacatctttcggaagaaaagactcacaattatggatctgcaccctggggctggaaagacgaaacggatcctcccgagcattgtgcgcgaagccctgaagagacggcttcgcaccctgatcctggcgcccacaagagtcgtggctgccgagatggaagaggccctccggggcctgcctatcagataccagacccccgctgttaaatctgaacataccgggcgcgagattgtggaccttatgtgccacgccacattcacgacccggctgctctccagcacaagagtccctaattacaacctgatcgtgatggatgaggctcactttaccgacccctgctctgttgccgcgcgcggctatatttccacacgggtggaaatgggagaggccgctgccatcttcatgaccgctacgcctccgggcagcattgatccctttcctcagtccaattctcccatcgaagacatcgagagagaaattcctgagcgcagctggaacacagggttcgactggatcaccgattaccaaggaaagaccgtctggttcgtgccctccattaaggccggcaatgacatcgccaactgtctccggaaaagcgggaagagagtcattcagctgtctcgcaaaacatttgataccgagtatccgaagacaaaacttaccgactgggatttcgtggttacgacagacatctccgaaatgggagctaactttagagcgggccgggtgatcgatcctcgcagatgcctgaagcccgtgattctgaccgacgggcccgagcgggtcatcctcgccggccctattcccgttacccctgctagcgccgcccagcgcagaggacggatcggcagaaatccggctcaagaagatgaccagtacgtgttctctggggatcccctgaagaacgacgaggatcatgcccactggaccgaagcgaaaatgcttctggacaatatttatacgcctgagggaatcattcccaccctctttggccctgagcgcgaaaagacacaggctatcgacggggagttccggctgagaggagaacagcgcaaaacctttgtggagctgatgcggagaggcgatctccccgtctggcttagctacaaggtggcctccgccggcatctcttataaagaccgggagtggtgtttcacaggggaacgcaacaatcaaattctggaggaaaacatggaggttgaaatctggaccagagagggagagaagaagaaactgcggccgaagtggctcgatgctcgcgtgtacgccgaccctatggcgctgaaagattttaaggagttcgccagcggcagaaaatccattacacttgacatcctgaccgagattgctacgctccccacatacctgtctagcaaggccaagctggctctcgataatatcgtcatgcttcataccaccgaaaaagggggacgggcctatcagcacgctctgaacgagctgcctgaatccctcgagacactgatgcttgtggccctgctcggcgcgctgaccgccgggatctttctgttctttatgcagggaaagggcattggcaaactcagcatggggcttatcgctattgccgtcgcttctggactgctgtgggtggccgagatccagccccaatggattgccgcttccatcatcctcgagttcttcctgatggttcttctgattcctgagcccgaaaagcagcgcacaccgcaggacaatcagctcatctacgtgattctgacgatcctgaccattatcggcctcattgcggccaacgagatggggcttatcgagaagacaaagaccgattttggattctatcaagtcaaaacagagaccacgatcctggacgtggatctgagacctgctagcgcctggaccctctacgccgttgctacaaccattctgacacccatgcttcggcacaccatcgagaatacgtccgccaacctgtctctcgcggccattgctaatcaggccgctgtgctgatgggcctggggaagggatggcccctccatcgcatggaccttggcgtccctctgctggccatgggctgctatagccaggtgaacccgacaaccctcacagcgtccctggtgatgcttctggttcactacgccatcattgggcccggactccaggctaaggccaccagagaagctcaaaaacggaccgccgctggcatcatgaagaatcctacagtcgatgggatcacggtgattgacctggagcccatctcttatgaccctaaatttgaaaagcagctgggacaggtgatgctccttgtcctgtgtgttggccaactgctcctgatgagaaccacatgggccctttgcgaggtgctgaccctcgcgacagggcccattatgaccctgtgggagggaaaccctggccgcttctggaacacgacaatcgccgtgagcaccgctaatatttttcggggctcctacctggccggggctggactcgccttcagccttatcaaaaacgcccagaccccgagacgcggcacagggaccacaggagaaacgctgggcgagaagtggaagcggcagctcaattctctcgatagaaaagaatttgaggaatacaagcgctccgggatcctggaggtcgaccggaccgaggcgaaaagcgctcttagagatggatctaagattaaacatgccgtgtcccgcggcagctctaagatccggtggattgttgaaagaggcatgatcaagcccaaagggaaggtggtcgacctgggatgtggccgcgggggatggagctattacatggctacactcaaaaacgtgaccgaggttaagggctatacaaaagggggacctggccacgaagaacccattcctatggccacctacggctggaatctggtgaagctgcattccggggtcgatgtgttctataagcccacggaacaggtggacaccctcctttgcgatatcggagagtctagctccaacccgacaattgaggaaggccggaccctgagagtcctgaaaatggttgagccttggctcagctccaagcccgaattttgtatcaaagtgctgaatccctacatgcctacagtgatcgaggaacttgagaagctgcaacgcagacacgggggatctctcgtccggtgccccctgagccgcaactccacccacgagatgtattgggtgtctggcgccagcgggaatattgtttcctctgtgaacacaatcagcaaaatgctgctcaatagattcaccacgcggcatagaaagcctacatacgaaaaagacgtcgatcttggagctggcacccggtccgtgagcaccgagacagaaaagccggacatgacgattatcggccgcagactgcagcggctgcgcgaggagcacaaggaaacctggcattacgatcaggagaacccctatagaacatgggcctaccacgggtcttatgaagcgccttccaccggaagcgcctcttccatggttaatggcgtggtcaaactcctgacaaagccctgggacgtgattcctatggttacccagcttgctatgacagacaccacgccctttgggcaacagcgggtgttcaaagagaaggtcgatacccgcacaccgcagcctaaacccggaaccagaatgatcatgacaatgaccgccaactggctgtgggctctcctgggcaagaagaaaagccctcggctgtgtacgcgcgaagagtttatctctaaggtgagatccaatgccgcgattggggccgtcttccaggaggaacaaggctggacaagcgcttccgaggccgtgaacgacagccggttctgggaactcgttgataaagagcgcgctctgcaccaggaaggaaagtgcgagtcttgcgtgtacaatatgatgggcaaaagagagaagaaacttggggaatttggacgggccaaaggcagccgcgctatctggtatatgtggctgggggccagattcctcgagtttgaagcgctgggattccttaacgaggaccattggttttcccgggaaaactcttggagcggcgtcgagggggagggcctgcacagactcggatacattctggaagatatcgacaagaaagatggcgacctgatttatgccgatgacaccgctgggtgggatacacgcatcaccgaggacgatctcctgaatgaggaacttatcacggagcagatggctccccaccacaagaccctggccaaagccattttcaagctcacataccaaaacaaggtggtgaaagttctgcggcctacccccaagggagccgtgatggacatcatttccagaaaagaccagcgcggctctgggcaggtcggaacatacggccttaatacctttacaaacatggaagtgcagctgatccggcaaatggaggcggaaggggttattacccaggatgacatgcagaatccgagaggcctcaaggagcgcgtggaaaaatggctgaaggagtgtggagtcgatcggctgaaaagaatggctatcagcggcgacgattgcgtggtcaagcctatcgacgagcgcttctccacgtctctcctgtttcttaacgatatggggaaggtgcggaaagacattccccagtgggaacccagcaagggatggaaaaattggcaagaggttcctttctgttcccatcactttcacaagatcttcatgaaagatggcagaagcctggtggtcccgtgccgcaaccaggacgaactcattgggcgggccagaatctctcagggagccggctggtccctgcgggagacagcttgtcttgggaaggcctatgctcagatgtggagcctgatgtactttcatagacgcgatctccggctggcctctatggcgatttgctccgccgtgcccaccgaatggttccctaccagcagaacaacctggtccatccacgctcatcaccaatggatgacaacggaggacatgctgaaggtttggaatcgcgtgtggattgaggacaaccccaatatgaccgataaaacacctgtccactcttgggaagacatcccctatctcggcaagagagaggatctgtggtgtggaagccttatcggcctgtccagccgggccacctgggctaaaaacattcatacagccatcacccaggtgcgcaatctcattgggaaggaagagtacgtggactatatgcctgcgatgaaaagatactctgcccccttcgaatccgagggagttctgtga

SEQ ID NO: 21019 - RNA, 9867 nt, synthetic construct
  misc_feature 1..9867: note = derived and/or modified CDS sequence (opt5) from DENV-4__JF741967__SS-prME
  source 1..9867: mol_type = other RNA
agcaccatgacactgctctgcctgatccccacggtgatggccttccacctttccaccagagacggcgagcctctgatgattgtcgctaagcatgaacgggggcgcccgctcctgtttaaaacaaccgagggaatcaacaagtgtacacttattgccatggatctgggcgaaatgtgcgaggacaccgttacatacaaatgtcccctcctggtgaataccgaacctgaggatatcgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggattcttagaaatcctggcttcgctctgctcgccggctttatggcttacatgatcgggcagacaggaatccagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtattgaagctagcatctctaatattaccacagccacccgctgcccgacgcaaggagagccctatcttaaggaggaacaggaccagcagtacatctgtagacgggatgtggtggaccgcggctgggggaacggatgcggcctgttcgggaaaggaggcgtcgtgacatgcgcgaagtttctctgttccggcaaaattaccgggaatctggttcaaatcgagaaccttgaatataccgtggtcgtgacagttcataatggaaacacccacgccgtgggcaatgatacaagcaaccacggggtcacggctaccattacacctagatctccctccgtggaggtcaagctgcctgactacggagaactcaccctggattgcgagccccggagcggcatcgacttcaatgagatgatcctgatgaagatgaaaaagaaaacatggctcgtgcataagcagtggtttctggaccttccgctgccttggaccgccggggctgatacgtctgaagttcactggaactacaaagagagaatggtgaccttcaaggtcccccatgccaaacgccaggacgtgacagttctcggctcccaggaaggagccatgcacagcgctctggcgggcgccaccgaggtggattccggggacggaaatcacatgtttgctggccatcttaagtgtaaggtccggatggaaaaactgagaattaaggggatgtcttatacaatgtgcagcggaaaattctccatcgataaggagatggccgagacccaacacggcacgacagtggtgaaagttaagtacgaaggggccggcgctccttgtaaggtccccattgagatccgcgacgtgaacaaagaaaaggtggtcggacggattatcagctctacccccttcgccgagaacacaaattccgtgaccaacatcgagctcgaacctccgtttggcgatagctatattgttatcggggtgggagactctgcgctgaccctgcattggttcagaaaaggcagctccattgggaagatgtttgagtctacataccgcggagctaaacggatggccatcctcggcgaaacggcctgggatttcgggagcgtcggcggactgtttacctcccttggcaaggctgtgcaccaggttttcgggagcgtgtatacaaccatgtttggaggcgtctcttggatgattagaatcctgatcgggttcctcgtgctgtggattggaacaaattcccgcaacaccagcatggccatgacgtgcatcgctgttggcgggattacactgtttcttggcttcaccgtgcaggccgacatgggatgtgtcgtgtcttggaatggcaaggagctcaaatgcgggtccggaatctttgtggtcgataacgttcatacctggacagaacaatacaagttccagcccgagagccctgcgcggctggcctccgctattctgaatgcccacaaagacggcgtgtgtgggatcagatctaccacacgcctcgagaacgtgatgtggaagcagattacgaatgaactgaactatgtcctttgggagggaggccacgacctgaccgtggttgctggcgatgtgaaaggggtcctcacaaagggaaagcgggccctgaccccccctgtgaatgacctgaaatacagctggaagacatggggcaaagcgaagatctttacccccgaagccagaaactccacgttccttatcgatgggccggacacctctgagtgccctaatgaacggcgcgcttggaacttctttgaggttgaggattacggattcggcatgtttacaaccaatatttggatgaaattcagagaagggagctccgaggtgtgtgaccatcggctcatgagcgccgctatcaaggatcagaaagccgtccacgccgacatgggatattggattgaatcttccaagaaccaaacatggcagatcgagaaggctagcctgattgaagtgaaaacctgcctgtggcccaagacacataccctctggtctaacggcgttctggagtcccagatgcttatccctagaagctacgcgggccccttttctcagcacaattatcgccaagggtacgccacgcagacagctggaccttggcacctgggcaaactcgagatcgatttcggggaatgccccggaaccaccgtgacaattcaggaggactgtgatcatcggggcccgagcctgagaaccacgacagcctccgggaagctggtcacccagtggtgctgtcgcagctgcacaatgcctccccttagatttctcggagaagacggctgttggtatggcatggagatccggcccctgtctgagaaagaagagaacatggtgaagtcccaagtgaccgccgggcagggaacaagcgaaaccttctccatgggcctgctctgcctgacgctttttgtcgaggaatgtctgcgcagacgggttacccgcaagcacatgattctcgctgtggtgatcacattctgcgccattatcctggggggactgacctggatggatcttctcagagtcctgatcatgctgggcgacacaatgtctgggcggattggaggccagatccatctcgcgattatggctgtgtttaaaatgagccctggctacgttctgggggtgttccttcgcaagctgacctccagagagacggccctcatggtcatcggaatggccatgacaaccgtgttttctattccgcacgacctgatggagctgatcgatggcatcagccttgggctgattctcctgaaaatcgttacacatttcgacaatacccaggtgggaaccctcgctctgtcccttacattcattcggtctacgacccccctggtcatggcctggcgcacaatcatggcggtgtttttcgtcgtgaccctcattcctctgtgtagaacaagctgcctgcaaaagcagtcccactgggttgaaatcaccgctcttattctgggcgcccaggccctccccgtgtatctgatgacgctcatgaaaggggctagccggagatcttggcctctgaacgagggaatcatggccgtcggccttgtgtccctgctcggcagcgctctgctgaagaatgatgttccccttgccgggcctatggtggcgggaggcctgctcctggccgcttacgtcatgtctgggtccagcgccgacctctctctggaaaaggctgccaacgtgcaatgggatgagatggccgacatcacaggatccagccccattatcgaagtgaaacaggatgaggacggctcctttagcattcgcgaggttgaagagaccaatatgatcacccttctggtcaagctggctctcattacagtgtctgggctgtacccgcttgcgatccctgtgaccatggccctgtggtatgtctggcaggtgaaaacacagcggagcggagctctctgggatgttccctcccctgccgccacgcacaaggctaccctgtctgaaggcgtgtacagaatcatgcaacgcggcctcttcgggaaaacacaggtcggagtgggcattcatatggagggggtttttcacaccgtgggacatgtcacacggggcagcgtgatctgtcacgaaaccgggagactggagccctcctggggagacgttcgcaacgatatgatttcttatggcggcgggtggcggcttggagacaagtgggataaggaggaagacgtgcaggtcctggccatcgagccgggcaaaaatcctaagcatgtgcagacgaaacccgggctgttcaagaccctcacaggagaaattggcgcggtgaccctggactttaaacctgggacaagcggctcccccatcatcaacaagaaaggaaaggtcattggcctttacgggaatggagttgtgaccaagtctggcgattatgtgagcgctatcacacaagccgagagaattggggagcccgactacgaagtcgatgaggacatcttccgcaaaaagcggctgacgattatggatctccaccctggagccggcaaaaccaagagaatcctgccgtccattgtgcgggaagctctcaaacgcagactgcggacacttatcctggcccccacccgcgttgtggcggctgagatggaagaggccctgagagggctccctatccggtatcagacccccgccgtcaagagcgagcacacaggcagagaaattgtggacctgatgtgccatgctacgtttaccacacgccttctgtcttccacccgggttcctaactacaatctcatcgtgatggatgaggcccacttcacagacccctgcagcgtcgctgccagaggatacatttctacccgcgtggaaatgggcgaggcggccgctatctttatgacggccacacctccggggtccattgatcccttccctcagagcaactcccccatcgaagacatcgagcgggagattcctgaaagatcttggaataccggattcgattggatcaccgactatcagggcaagacagtctggtttgtgcccagcattaaagctgggaacgacatcgccaactgtctgcgcaagtccggaaaacgggttattcaactcagcagaaagaccttcgatacagagtacccgaaaaccaagctgacggactgggattttgtggtgacaaccgacatctctgaaatgggcgccaatttccgcgctgggagagtcatcgatcctcggcgctgccttaagcccgttattctgacagacggccccgagagagtgatcctggcgggacctattcccgtgacccctgcctccgctgcccagcggcgcggcagaatcgggcggaacccggcccaggaagatgaccaatatgtctttagcggagatcccctcaaaaatgacgaggatcatgctcactggacggaggccaagatgctgcttgacaacatttacacccctgaaggcatcattcccacactgttcgggcctgagagagaaaaaacccaggcgatcgatggagagtttcgcctccggggcgagcagagaaagacattcgtggaactgatgcgccggggcgacctgcccgtttggctctcttataaagtggctagcgccgggatctcctacaaggacagagagtggtgttttaccggagaacggaataaccagattcttgaggaaaatatggaggtcgagatctggacacgcgaaggcgagaagaaaaagctgagaccgaaatggctggatgcccgggtgtatgctgaccctatggccctcaaggatttcaaagaatttgcgtctgggcgcaagagcattaccctggacatccttacggagattgccacactgcccacctacctctcctctaaggctaaactggccctggataacatcgtcatgctccacaccacagaaaagggaggcagagcttaccaacatgcccttaatgagctgcctgagagcctggaaaccctcatgctggtggctcttctgggggccatgacagcgggaatcttcctctttttcatgcagggcaaaggcattgggaagctgtccatgggactgatcgccattgctgttgccagcggcctcctttgggtggctgagatccagccccagtggattgccgcctctatcatcctggaattctttctgatggtcctcctgattcctgagcccgaaaaacaacggacgccgcaggacaaccagcttatctatgtgattctgaccatcctcacaattatcgggctgattgctgcgaatgagatgggactgatcgagaagaccaaaacagatttcggcttttaccaggttaagcctgaaaccacgatcctcgacgtggatcttcgccccgcctccgcttggaccctgtatgccgtcgccacaaccattctgacacccatgctcagacacaccatcgagaacacgagcgctaatctgtcccttgccgcgattgccaaccaagctgccgtgctgatggggctcggaaagggctggcctctgcatcggatggacctgggcgtgccgctccttgctatggggtgctactctcaggttaatcccacaaccctgacagccagcctggtcatgctcctggtgcactatgcgatcattggacctggccttcaggccaaagctacccgcgaagcccagaagagaaccgctgccgggatcatgaaaaaccccacagtggatggaatcacggtcattgacctggagcctatctcctacgatcccaagttcgagaaacaactcggccaggttatgctgctggtgctctgtgtggggcagcttctgctgatgcggaccacatgggctctctgcgaagtcctgacccttgccacaggacctgtgatgaccctgtgggagggcaacccgggcagattttggaatacgacaattgcggtttctaccgccaacatcttccgcgggagctatctcgctggagccggcctggctttttccctgattaagaatgcccaaaccccccggagagggacaggaaccacaggcgaaacgctcggggagaagtggaaacgccagcttaacagcctggaccggaaggaattcgaggagtacaaaagatctggaatcctggaagtggaccgcaccgaggccaagtccgcgctccgggatggcacaaaaatcaagtacgctgtcagcagaggctcttccaagattcgctggatcgtggaacgggggatgattaaacctaagggaaaagttgtggacctgggctgtgggagaggaggctggagctattacatggccacccttaagaatgtcacagaggtgaaagggtataccaagggaggccccggccatgaagagcctatccccatggctacgtacgggtggaacctggtgaagctccactctggagtcgatgttttttataaaccgaccgagcaggtggacacactgctgtgcgatattggcgaaagctcctctaatcctaccatcgaggaagggcgcacactccgggtgcttaagatggtcgagccctggctgagctccaaacccgaattctgtattaaggtgctgaacccttacatgcccaccgttatcgaggagctcgaaaaactgcagagacgccacggaggcagccttgtgagatgccctctgtcccggaattctacacatgagatgtattgggtcagcggggcctccggaaacatcgtgtctagcgttaataccatttccaagatgctcctgaaccgctttacgacaagacaccggaaaccgacctacgaaaaggacgtggatctgggcgccggcaccagatctgtcagcacagagacggagaagcccgacatgaccgtgatcgggcggcgcctccaaagacttcgggaagagcataaagaaacatggcactacgatcaggagaatccttatcgcacctgggcttaccacggatcctatgaagcccccagcacaggctctgcgtccagcatggttaacggggtggtcaagctgctgaccaaaccttgggacgtgattcccatggtcacacagctcgccatgaccgatacgaccccgttcggacagcaaagagtgtttaaggagaaagttgacacacggacccctcagcccaagcctggcacacgcatgatcatgaccacgacagctaattggctgtgggcccttctggggaagaaaaagtctcccagactctgtacccgggaggaattcatttccaaagtgcgcagcaacgctgccatcggcgcggtcttccaggaggaacagggatggacatctgcctccgaggctgtgaatgacagcagattttgggaactggtggataaggagcgggccctgcatcaagagggcaaatgcgaatcctgcgtttacaacatgatggggaagcgcgagaagaaactcggagaattcggcagagctaaggggagccgggccatctggtatatgtggctgggagctcgctttcttgagttcgaagccctgggctttctcaacgaggaccactggttctctagagagaatagctggtccggggtggaaggcgagggactgcatcggcttggctacattctggaagatatcgacaaaaaggatggggacctcatttatgcggatgacaccgccggatgggatacgagaatcaccgaggacgatctgctgaacgaggaactcattacagagcagatggctcctcaccataaaaccctggccaaggctatctttaagcttacataccagaataaagtcgtgaaggttctgcgccccaccccgaaaggcgccgtgatggacatcatttctcggaaggatcaaagagggagcggacaggtcggcacatacgggctcaacaccttcacgaatatggaagtgcagctgatccgccagatggaggccgaaggcgtcattacacaagacgacatgcagaaccctaaaggacttaaggagcgggtggagaaatggctgaaggaatgtggcgttgatagactcaagcgcatggcgatctccggggacgattgcgtggtcaaacccctggacgagcggttttctaccagcctgctcttcctgaatgatatgggaaaggtgagaaaagacattccccagtgggaaccttccaagggctggaaaaactggcaggaggttccgttttgttctcaccacttccataagatctttatgaaggatgggcgcagccttgtggtcccctgccggaatcaagacgaactgatcggaagagctcgcatttcccagggcgccgggtggagcctccgggagaccgcctgtctgggcaaagcttatgcccagatgtggtctcttatgtacttccacagacgggatctgagactcgcttccatggccatctgcagcgcggtgcctacagagtggttccccacctctcgcacaacgtggtccattcatgcccaccaccagtggatgaccacagaagacatgctgaaggtgtggaaccgggtttggatcgaggataatcctaacatgaccgacaaaacacccgtccatagctgggaagacattccttatctgggaaagagagaggatctctggtgtggctccctgatcgggctttctagccgcgctacctgggccaaaaatattcacacggctatcacccaagtgagaaacctgatcggaaaggaagagtacgtggactatatgcccgccatgaagcggtactccgcgccgtttgagagcgaaggcgtcctctga

SEQ ID NO: 21020 - RNA, 9867 nt, synthetic construct
  misc_feature 1..9867: note = derived and/or modified CDS sequence (opt5) from DENV-4__JQ822247__SS-prME
  source 1..9867: mol_type = other RNA
agcaccatgacactgctctgcctgatccccacggtgatggccttccacctttccaccagagacggcgagcctctgatgattgtcgctaagcatgaacgggggcgcccgctcctgtttaaaacaaccgagggaatcaacaagtgtacacttattgccatggatctgggcgaaatgtgcgaggacaccgttacatacaaatgtcccctcctggtgaataccgaacctgaggatatcgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggattcttagaaatcctggcttcgctctgctcgccggctttatggcttacatgatcgggcagacaggaatccagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtattgaagctagcatctctaatattaccacagccacccgctgcccgacgcaaggagagccctatcttaaggaggaacaggaccagcagtacatctgtagacgggatgtggtggaccgcggctgggggaacggatgcggcctgttcgggaaaggaggcgtcgtgacatgcgcgaagtttctctgttccggcaaaattaccgggaatctggttcaaatcgagaaccttgaatataccgtggtcgtgacagttcataatggaaacacccacgccgtgggcaatgatacaagcaaccacggggtcacggctaccattacacctagatctccctccgtggaggtcaagctgcctgactacggagaactcaccctggattgcgagccccggagcggcatcgacttcaatgagatgatcctgatgaagatgaaaaagaaaacatggctcgtgcataagcagtggtttctggaccttccgctgccttggaccgccggggctgatacgtctgaagttcactggaactacaaagagagaatggtgaccttcaaggtcccccatgccaaacgccaggacgtgacagttctcggctcccaggaaggagccatgcacagcgctctggcgggcgccaccgaggtggattccggggacggaaatcacatgtttgctggccatcttaagtgtaaggtccggatggaaaaactgagaattaaggggatgtcttatacaatgtgcagcggaaaattctccatcgataaggagatggccgagacccaacacggcacgacagtggtgaaagttaagtacgaaggggccggcgctccttgtaaggtccccattgagatccgcgacgtgaacaaagaaaaggtggtcggacggattatcagctctacccccttcgccgagaacacaaattccgtgaccaacatcgagctcgaacctccgtttggcgatagctatattgttatcggggtgggagactctgcgctgaccctgcattggttcagaaaaggcagctccattgggaagatgtttgagtctacataccgcggagctaaacggatggccatcctcggcgaaacggcctgggatttcgggagcgtcggcggactgtttacctcccttggcaaggctgtgcaccaggttttcgggagcgtgtatacaaccatgtttggaggcgtctcttggatgattagaatcctgatcgggttcctcgtgctgtggattggaacaaattcccgcaacaccagcatggccatgacgtgcatcgctgttggcgggattacactgtttcttggcttcaccgtgcaggccgacatgggatgtgtcgtgtcttggaatggcaaggagctcaaatgcgggtccggaatctttgtggtcgataacgttcatacctggacagaacaatacaagttccagcccgagagccctgcgcggctggcctccgctattctgaatgcccacaaagacggcgtgtgtgggatcagatctaccacacgcctcgagaacgtgatgtggaagcagattacgaatgaactgaactatgtcctttgggagggaggccacgacctgaccgtggttgctggcgatgtgaaaggggtcctcacaaagggaaagcgggccctgaccccccctgtgaatgacctgaaatacagctggaagacatggggcaaagcgaagatctttacccccgaagccagaaactccacgttccttatcgatgggccggacacctctgagtgccctaatgaacggcgcgcttggaacttctttgaggttgaggattacggattcggcatgtttacaaccaatatttggatgaaattcagagaagggagctccgaggtgtgtgaccatcggctcatgagcgccgctatcaaggatcagaaagccgtccacgccgacatgggatattggattgaatcttccaagaaccaaacatggcagatcgagaaggctagcctgattgaagtgaaaacctgcctgtggcccaagacacataccctctggtctaacggcgttctggagtcccagatgcttatccctagaagctacgcgggccccttttctcagcacaattatcgccaagggtacgccacgcagacagctggaccttggcacctgggcaaactcgagatcgatttcggggaatgccccggaaccaccgtgacaattcaggaggactgtgatcatcggggcccgagcctgagaaccacgacagcctccgggaagctggtcacccagtggtgctgtcgcagctgcacaatgcctccccttagatttctcggagaagacggctgttggtatggcatggagatccggcccctgtctgagaaagaagagaacatggtgaagtcccaagtgaccgccgggcagggaacaagcgaaaccttctccatgggcctgctctgcctgacgctttttgtcgaggaatgtctgcgcagacgggttacccgcaagcacatgattctcgctgtggtgatcacattctgcgccattatcctggggggactgacctggatggatcttctcagagtcctgatcatgctgggcgacacaatgtctgggcggattggaggccagatccatctcgcgattatggctgtgtttaaaatgagccctggctacgttctgggggtgttccttcgcaagctgacctccagagagacggccctcatggtcatcggaatggccatgacaaccgtgttttctattccgcacgacctgatggagctgatcgatggcatcagccttgggctgattctcctgaaaatcgttacacatttcgacaatacccaggtgggaaccctcgctctgtcccttacattcattcggtctacgacccccctggtcatggcctggcgcacaatcatggcggtgtttttcgtcgtgaccctcattcctctgtgtagaacaagctgcctgcaaaagcagtcccactgggttgaaatcaccgctcttattctgggcgcccaggccctccccgtgtatctgatgacgctcatgaaaggggctagccggagatcttggcctctgaacgagggaatcatggccgtcggccttgtgtccctgctcggcagcgctctgctgaagaatgatgttccccttgccgggcctatggtggcgggaggcctgctcctggccgcttacgtcatgtctgggtccagcgccgacctctctctggaaaaggctgccaacgtgcaatgggatgagatggccgacatcacaggatccagccccattatcgaagtgaaacaggatgaggacggctcctttagcattcgcgatgttgaggaaaccaatatgatcacccttctggtcaagctggctctcattacagtgtctgggctgtacccgcttgcgatccctgtgaccatggccctgtggtatgtctggcaggtgaaaacacagcggagcggagctctctgggacgttccctcccctgccgccacgcaaaaggctaccctgtctgagggcgtgtacagaatcatgcagcgcggcctcttcgggaaaacacaggtcggagtgggcattcacatggaaggggtttttcataccatgtggcacgtgacacggggaagcgtcatctgtcatgagaccggcagactggaaccctcctgggccgatgtgcgcaacgacatgatttcttatgggggaggctggcggcttggcgataagtgggacaaggaggaggacgttcaggtgctggcgatcgaaccggggaaaaatcctaagcacgtccaaacgaaacccggactgttcaagaccctcacaggcgagattggggctgtgaccctggattttaaacctggaacaagcggctcccccatcatcaacaagaaagggaaggtgattggcctttacggaaatggcgtcgttaccaagtctggggactatgtgagcgccatcacacaggccgaaagaattggagagcccgattacgaggtggacgaagatatcttccgcaaaaagcggctgacgattatggacctccatcctggcgctgggaaaaccaagagaatcctgccgtccattgtccgggaggccctcaaacgcagactgcggacacttatcctggcgcccacccgcgtggttgctgccgaaatggaggaagccctgagaggactccctatccggtatcagacccccgctgtgaagagcgagcacacaggcagagagattgtcgatctgatgtgccacgccacgtttaccacacgccttctgtcttccacccgggtgcctaactacaatctcatcgttatggacgaagctcatttcacagatccctgcagcgtggccgcgagagggtacatttctacccgcgtcgagatgggcgaagccgctgccatctttatgacggctacacctccgggatccattgaccccttccctcagagcaactcccccatcgaggatatcgaacgggagattcctgagagatcttggaataccggcttcgactggatcaccgactatcaagggaagacagtgtggtttgtccccagcattaaagccggaaacgatatcgccaactgtctgcgcaagtccggcaaacgggtgattcagctcagcagaaagaccttcgacacagaatacccgaaaaccaagctgacggattgggactttgttgtgacaaccgatatctctgagatgggggctaatttccgcgcgggaagagtgatcgaccctcggcgctgccttaagcccgtcattctgacagatggccccgaaagagttatcctggccgggcctattcccgtgacccctgcttccgccgcccagcggcgcggcagaatcggacggaacccggctcaagaggacgatcagtatgtgtttagcggcgaccccctcaaaaatgatgaagaccacgcccattggacggaggcgaagatgctgcttgataacatttacacccctgaggggatcattcccacactgttcggacctgaaagagagaaaacccaggctatcgacggcgaatttcgcctccggggggagcagagaaagacattcgtcgagctgatgcgccggggagacctgcccgtgtggctctcttataaagttgccagcgccggcatctcctacaaggatagagaatggtgttttaccggcgagcggaataaccaaattcttgaagagaatatggaagtggagatctggacacgcgagggggaaaagaaaaagctgagaccgaaatggctggacgctcgggtctatgccgatcctatggcgctcaaggacttcaaagagtttgcctctggacgcaagagcattaccctggatatccttacggaaattgctacactgcccacctacctctcctctaaggccaaactggctctggacaacatcgtgatgctccacaccacagagaagggcgggagagcctaccagcacgctcttaatgaactgcctgagagcctggagaccctcatgctggtcgcccttctgggagcgatgacagccggcatcttcctctttttcatgcaggggaaaggaattggcaagctgtccatgggcctgatcgctattgccgtggctagcgggctcctttgggttgccgaaatccagccccaatggattgccgcttctatcatcctggagttctttctgatggtgctcctgattcctgaacccgagaaacagcggacgccgcaggataaccagcttatctatgtcattctgaccatcctcacaattatcggactgattgcggccaatgaaatgggcctgatcgagaagaccaaaacagacttcgggttttaccaagtgaagcctgagaccacgatcctcgatgttgaccttcgccccgcttccgcctggaccctgtatgccgtggctacaaccattctgacacccatgctcagacataccatcgaaaacacgagcgccaatctgtcccttgcggccattgctaaccaggccgctgtcctgatgggactcggcaaggggtggcctctgcaccggatggatctgggagtgccgctccttgccatgggctgctactctcaggtgaatcccacaaccctgacagcgagcctggttatgctcctggtccattatgccatcattggccctgggcttcaggctaaagccacccgcgaggctcaaaagagaaccgccgctggaatcatgaaaaaccccacagtggacggcatcacggtgattgatctggaacctatctcctacgaccccaagttcgagaaacagctcgggcaggtcatgctgctggttctctgtgtgggacaacttctgctgatgcggaccacatgggccctctgcgaggtgctgacccttgcgacaggccctgtcatgaccctgtgggaagggaacccgggaagattttggaatacgacaattgccgtgtctaccgctaacatcttccgcggcagctatctcgccggcgctgggctggccttttccctgattaagaatgcccagaccccccggagaggaacaggcaccacaggggagacgctcggagaaaagtggaaacgccagcttaacagcctggaccggaaggagttcgaagagtacaaaagatctggcatcctggaggttgatcgcaccgaagcgaagtccgctctccgggacgggacaaaaatcaagtacgccgtgagcagaggatcttccaagattcgctggatcgtcgagcggggcatgattaaacctaagggcaaagtggttgatctggggtgtggaagaggcgggtggagctattacatggctacccttaagaatgtgacagaagtcaaaggatataccaagggcgggcccggacacgaggaacctatccccatggccacgtacggctggaacctggtgaagctccattctggcgtggacgtcttttataaaccgaccgagcaggttgatacactgctgtgcgacattggggagagctcctctaatcctaccatcgaagagggacgcacactccgggtgcttaagatggtggaaccctggctgagctccaaacccgagttctgtattaaggtcctgaacccttacatgcccaccgtgatcgaagagctcgagaaactgcaaagacgccacggcgggagccttgttagatgccctctgtcccggaattctacacacgaaatgtattgggtgagcggagcctccggcaacatcgtctctagcgtgaataccatttccaagatgctcctgaaccgctttacgacaagacatcggaaaccgacctacgagaaggatgttgacctgggggctggaaccagatctgtgagcacagaaacggagaagcccgatatgaccgtcatcggccggcgcctccagagacttcgggaggaacacaaagagacatggcattacgaccaggaaaatccttatcgcacctgggcctaccacggctcctatgaggcgcccagcacagggtctgcctccagcatggtgaacggagttgtgaagctgctgaccaaaccttgggatgtcattcccatggtgacacagctcgctatgaccgacacgaccccgttcggccaacagagagtctttaaggaaaaagtggacacacggacccctcagcccaagcctgggacacgcatgatcatgaccacgacagccaattggctgtgggctcttctgggaaagaaaaagtctcccagactctgtacccgggaggagttcatttccaaagttcgcagcaacgccgcgatcggcgccgtgttccaggaagagcaagggtggacatctgcttccgaagccgtcaatgatagcagattttgggagctggtggacaaggaacgggctctgcaccaggagggcaaatgcgagtcctgcgtgtacaacatgatgggaaagcgcgaaaagaaactcggcgagttcgggagagccaagggaagccgggctatctggtatatgtggctgggcgcccgctttcttgaattcgaggcgctggggtttctcaacgaagatcattggttctctagagagaatagctggtccggagttgagggcgaagggctgcaccggcttggctacattctggaggacatcgataaaaaggacggagatctcatttatgccgacgataccgctggctgggacacgagaatcaccgaagatgacctgctgaacgaggagctcattacagaacagatggcccctcatcacaaaaccctggctaaggccatctttaagcttacataccaaaataaagtggtcaaggtgctgcgccccaccccgaaaggggccgttatggatatcatttctcggaaggaccagagaggaagcggccaggtggggacatacggactcaacaccttcacgaatatggaggtccagctgatccgccaaatggaagcggagggcgtgattacacaggacgatatgcagaaccctaaagggcttaaggaacgggtcgagaaatggctgaaggagtgtggcgtggacagactcaagcgcatggctatctccggagatgactgcgttgtgaaacccctggatgaacggttttctaccagcctgctcttcctgaatgacatgggcaaggtcagaaaagatattccccagtgggagccttccaaggggtggaaaaactggcaagaagtgccgttttgttctcatcacttccacaagatctttatgaaggacggacgcagccttgttgtgccctgccggaatcaggatgagctgatcggcagagcccgcatttcccagggggccggatggagcctccgggaaaccgcttgtctgggcaaagcctatgctcagatgtggtctcttatgtacttccatagacgggacctgagactcgcctccatggcgatctgcagcgccgtccctacagagtggttccccacctctcgcacaacgtggtccattcacgctcatcaccaatggatgaccacagaggatatgctgaaggtgtggaaccgggtgtggatcgaagacaatcctaacatgaccgacaaaacacccgttcacagctgggaggatattccttatctggggaagagagaagacctctggtgtggctccctgatcggactttctagccgcgccacctgggctaaaaatattcatacggccatcacccaggtcagaaacctgatcggcaaggaggaatacgtggattatatgcccgcgatgaagcggtactccgccccgtttgagagcgagggggtgctctga

SEQ ID NO: 21021 - RNA, 9867 nt, synthetic construct
  misc_feature 1..9867: note = derived and/or modified CDS sequence (opt5) from DENV-4__JF262783__SS-prME
  source 1..9867: mol_type = other RNA
agcaccgtgacactgctctgcctgatccccacggtcatggccttccacctttccaccagagacggcgagcctctgatgattgttgctaagcatgaacgggggcgcccgctcctgtttaaaacaaccgagggaatcaacaagtgtacacttattgccatggatctgggcgaaatgtgcgaggacaccgtgatgtacaaatgtcccctcctggtgaatacagaacctgaggatatcgactgctggtgtaacctgacctctacgtgggtcatgtatgggacctgcacacagagcggagagagacggcgcgaaaagagatccgtggcgctcaccccccactctggcatggggctggagacacgggctgaaacctggatgagctccgagggagcctggaaacatgcccaacgcgttgagtcttggattcttagaaatcctggcttcgctctgctcgccggctttatggcttacatgatcgggcagacgggaatccagcggacagtgttctttgtcctgatgatgcttgtggcccccagctatggcatgcgctgtgttggggtgggaaacagagatttcgtcgaaggcgtgtccgggggagcgtgggtggacctggtcctcgagcacggcggctgcgttaccacaatggcccaggggaagcctaccctggattttgaactgattaagaccacagctaaagaggtgacgctcctgcggacctactgtatcgaagccagcatttctaatatcacaaccgctacacgctgcccgacccaaggagagccctatcttaaggaggaacaggaccagcagtacatttgtagacgggatgtggtcgaccgcggctgggggaacggatgcggcctgttcgggaaaggaggcgtggttacgtgcgccaagtttctctgttccggcaaaatcacagggaatctggtgcaaattgagaaccttgaatataccgtcgtggttaccgtgcataatggagatacacacgtcgtgggcaaggacaccagcaaccacggggtcacagcgacgatcacccctagatctccctccgtggaggttaagctgcctgattacggagaactcacactggactgcgagccccggagcggcatcgacttcaatgagatgattctgatgaaaatgaagaaaaagacctggctcgtgcataaacagtggtttctggatcttccgctgccttggacagccggggctgacacctctgaagtccagtggaactacaaggagagaatggtgacgttcaaagttccccacgccaagcgccaggatgtgaccgtcctcggctcccaagaaggagctatgcatagcgccctgacaggcgccaccgaggtggactccggggatggaaatcacatgtttgctggccaccttaagtgtaaagtgcggatggaaaagctgagaatcaaagggatgtcttatacaatgtgcagcggaaagttctccattgacaaagagatggcggagacccagcatggcacgacagttgtcaaggtgaagtacgaaggggccggcgctccttgtaaagtgcccatcgagattcgcgatgtcaacaaggaaaaagtggttggacggatcatcagctctacccccttcgccgagaatacaaactccgtgaccaacattgagctcgaacctccgtttggcgacagctatatcgtcattggggtgggagattctgccctgaccctgcactggttcagaaagggcagctccatcgggaaaatgtttgagtctacataccgcggagctaagcggatggccattctcggcgaaacggcgtgggacttcgggagcgttggcggactgtttacctcccttggcaaggctgtgcatcaggtcttcgggagcgtgtatacaaccatgtttggaggcgtttcttggatggtgagaatcctgatcgggctcctggtcctgtggattggaacaaattcccgcaacaccagcatggccatgacgtgcatcgccattggcgggatcacacttttcctcggctttaccgtgcacgctgatatgggatgtgccgtgtcttggtccggcaaagagctgaagtgcgggagcggaattttcgtcatcgacaatgttcatacctggacagaacaatacaaatttcagcccgagtcccctgctcggctggcctctgcgattctcaacgcccacaaggacggcgtgtgtgggatcagaagcaccacacgcctggagaatgtgatgtggaaacagatcacgaacgaacttaattatgtcctgtgggagggaggccacgatctcaccgtggttgctggcgacgtgaagggggtcctgacaaagggaaaacgggccctgaccccccctgtgaacgatcttaagtactcctggaaaacatggggcaaggctaaaattttcacccccgaagccagaaattctacgtttctcatcgacgggccggataccagcgagtgccctaacgaacggcgcgcgtggaatttcctggaggttgaggactacggattcggcatgtttgccacaaacatttggatgaagttcagagaagggtccagcgaggtgtgtgatcatcggctgatgtctgctgccatcaaagaccagaaggctgtccacgccgatatgggatattggattgaatccagcaagaatcaaacctggcagatcgagaaagcctctctcatcgaagtgaagacatgcctgtggcccaaaacccatacactttggtccaacgaggttctggagagccagatgctcattcctaaggcttacgcgggccccttttctcagcacaattatagacaaggctacgccacccagacgatcgggccttggcacctgggaaaactggaaattgacttcggcgagtgccccgggacaaccgtgaccatccaggaagattgtaaccatcgcggaccgagccttcggacaaccacggcttccggcaagctcgtcacacagtggtgctgtagaagctgcaccatgcctcccctgcgctttctgggggaggacggatgttggtatggcatggagattagacccctctctgaaaaggaggaaaacatggtgaaatcccaagtgagcgccggccaggggacatccgagaccttctctatgggactgctttgcctgacactctttgtcgaagagtgtctgcggcgcagagttacccggaagcacatgatcctggtggtggtcacgaccctttgcgccatcattctcggcgggctgacatggatggatctgctccgcgctctgatcatgcttggagacaccatgagcggcagaatggggggacagattcatctgacaatcatggccgtgttcaaaatgtcccctggctacgttctcggcgtgtttctgcggaagctgacctctcgcgagacggcgcttattgtcatcgggatggctatgacaaccgtgctgagcatcccgcacgacctcatggaattcattgatggaatctccctgggcctcattctgcttaaaatggttgcccattttgacaatacacaggtggggaccctggccctctctctgaccttcatcagaagcacaatgcccctggtcatggcttggcggacgattatggccgtgctttttgtcgtgaccctgatccctctctgtcgcacatcctgcctgcaaaagcagagccactgggttgagattaccgcgctcatcctgggagctcaggcccttcccgtgtatctgatgacactcatgaagggcgcctctaaaagatcctggcctctgaacgaagggatcatggctgtcggactggtgagccttctgggctctgccctcctgaagaatgatgttcccctcgctggccctatggtggccgggggactgcttctggcggcctacgtcatgtccggcagctctgctgacctgtccctcgagaaagccgctaacgtgcaatgggatgaaatggccgacattaccgggagctcccccatcattgaggtgaagcaggatgaggacggaagcttctctatccgggatgttgaagagacgaatatgattacactgcttgtcaaactggccctcatcaccgtgagcggcctgtacccgctcgctatccctgtgaccatggcgctgtggtatatgtggcaggtcaagacacagagatccggggccctttgggacgtgccctctcctgctgccgcccaaaaggctaccctgacagaaggagtttaccgcattatgcagcggggcctgttcggcaaaacgcaggtgggggtcggaatccacatggagggcgtgtttcataccatgtggcacgttacaagagggagcgtgatttgtcatgaaaccggacgcctcgagccctcctgggccgatgtccggaacgacatgatctcttatggcgggggatggagactgggcgataagtgggacaaagaggaagacgtgcaggttcttgcgattgagccgggcaagaatcctaaacacgtgcaaacaaagcccgggctgttcaaaaccctcacgggagaaatcggcgctgtcaccctggattttaagcctgggacaagcggatcccccatcattaacaagaaaggccgcgtgatcgggctctacggcaatggaattgtgaccaagtctggcgactatgtcagcgccatcacacaggccgagcggattggggagcccgattacgaagttgacgaggatatcttcagaaaaaagcgcctgaccgtgatggaccttcatcctggagctggcaaaacaaagcggattctgccgtccatcgtgagagaagccctgaagcggcgcctcagaacgctgatccttgcgcccacccgggtcgtggctgccgagatggaagaggccctgcgcgggctccctattagatatcagacacccgctgttaaaagcgagcacaccggacgggaaatcgtggatctgatgtgccacgccacctttacaacgagactcctgtcttccacccgcgtccctaactacaatcttattgtgatggacgaggctcatttcacagatcccagctctgttgccgcgcggggctacatctccaccagagtggaaatgggggaggccgctgccatttttatgacagctacccctccgggcgccacggaccccttccctcagagcaactcccccatcgaagatatcgagcgcgagattcctgaacggtcttggaatacaggatttgactggatcaccgactatcaaggcaagaccgtctggttcgtgcccagcattaaagccgggaacgatatcgctaattgcctgagaaagtccggaaaaaaggtcattcagctgagccgcaagacatttgacaccgagtacccgaaaacaaagctcaccgattgggacttcgtggttacgacagatatctctgaaatgggcgcgaacttccgggccagacgcgtgatcgaccctagacggtgtctgaaacccgtgattcttaccgatgggcccgagcgcgtcatcctggctggacctattcccgttacacctgcctccgccgctcagagacggggccgcatcgggagaaacccggcccaagaagacgatcagtatgtgtttagcggcgaccccctcaagaatgatgaggaccacgcgcattggaccgaggctaaaatgctgctggataacatttacacgcctgaaggaatcattcccaccctcttcggccctgagcgggaaaagatccaggccatcgacggggagtttagacttcgcggagagcagcggaagacattcgtggaactgatgagacgcggcgacctgcccgtctggctctcttataaagtggccagcgctgggatttcctacaaggatcgggagtggtgctttaccggagaaagaaataaccaaatcctggaggaaaatatggaggttgagatttggacacgggaaggcgagaaaaagaaacttcgcccgaagtggctggacgccagagtgtatgcggatcctatggccctcaaggacttcaaagaatttgcttctggccggaagagcatcaccctggatattctgacagagatcgcctccctccccacctacctttctagccgcgctaaactggccctggacaacatcgtcatgctccacacgacagaaagagggggacgggcttaccagcacgccctgaatgagcttcctgagtccctggaaaccctcatgctggtggcgctgctcggcgccatgaccgctgggattttcctttttttcatgcagggaaagggcatcgggaaactgagcatgggactgatggccattgctgtcgcctctggcctcctgtgggtggccgagatccagccccaatggattgctgcgtccatcatccttgaatttttcctgatggccctcctgattcctgagcccgaaaagcagcgcacaccgcaggataaccagctgatctatgttattctcaccatccttacaattatcggcctgattgctgccaatgagatggggctgatcgagaaaacgaagaccgactttggattctaccaagtgaagacagaaaccacaatcctcgatgtcgacctgagacctgccagcgcttggaccctttatgccgtggcgacgaccattctgacacccatgctccggcataccatcgagaacacatccgccaatctgtctctggctgccattgctaaccaggccgcggttctcatgggccttgggaaaggatggcccctgcaccgcatggatctgggcgtgcctctcctggccatggggtgttacagccaggtcaatccgaccacgcttacagcttccctggtgatgctctctgtgcattatgccatcattggacccggcctgcaggctaaggccaccagagaagctcaaaaacggacagccgcgggcatcatgaagaaccctaccgttgacgggatcaccgtcattgatctggagcccatcagctacgaccctaaattcgagaagcagctcggacaggtgatgcttctggccctgtgcgctggccaactcctgcttatgagaacaacgtgggccttttgtgaagtgctgaccctcgctacagggcccattctgaccctgtgggagggaaatcctggccgcttctggaacacaaccatcgccgtctccacggccaacatttttcgggggagctatctcgcgggagctggccttgccttctctctgatcaagaatgctcagacaccgagacgcggcaccgggaccacaggagaaaccctgggcgagaaatggaagcggcagctcaactccctggacagaaaagaatttgaggagtacaagcgcagcgggatccttgaagttgatcggacagaggccaaatctgccctgaaggacggatccaagattaaacacgctgtgagcagaggctctagcaagatccgctggattgtggaacgggggatggtcaaacccaagggaaaagtggttgatctcggctgcggcagagggggatggtcctactatatggccacgctgaagaatgtgaccgaggtcaagggctacacaaaagggggacctggccatgaagagcccatccctatggcgacctatgggtggaacctggtgaagctccactctggagttgacgtgttctacaaacccacagagcaggtcgatacccttctgtgtgacattggcgaaagctccagcaatccgacgatcgaggaaggccgcaccctgcgggtgctcaagatggtggagccttggctgtcctctaaacccgaattttgcattaaggtccttaacccctatatgcctacagttatcgaggagctggaaaaactccaaagaaagcacgggggaagcctggtgcgctgtcccctgtccagaaattctacccatgagatgtactgggtgagcggcgcctccgggaacatcgtctctagcgtgaatacaacctccaagatgctccttaaccggttcacaacccgccacagaaaacctacgtatgaaaaggatgttaatctgggagctggcacacggagcgtgtctaccgagaccgagaaaccggacatgacaattatcgggagacggctgcagcgcctcagagaagagcataaggaaacgtggcactacgatcaggagaacccctaccggacctgggcctatcacggatcctacgaagctcctagcacaggctctgcctccagcatggtcaatggcgtggttaaactgcttaccaagccctgggacgtgattcctatggtcacacagctggcgatgaccgatacaaccccctttgggcaacagcgcgtgttcaaggagaaagttgacacgagaaccccgcagcctaagcccggaacacggatggtgatgaccacaaccgccaactggctctgggctctgctgggcaaaaagaaatctcctcgcctctgcacgagagaggaatttatctccaaggtccggagcaatgccgctattggggccgtgttccaggaggaacaaggatggacatccgctagcgaggccgtcaacgactctcgcttttgggaactggtggataaggagagagcgcttcatcaggagggcaaatgtgaaagctgcgtttataatatgatggggaagcgggagaaaaagctgggcgaattcggacgcgccaaaggctccagagctatctggtacatgtggctcggggcccggttcctggagtttgaagctcttggattcctgaacgaggaccactggtttggccgcgagaactcttggagcggggtggaaggagagggcctccatagactggggtatatcctggaagatattgacaagaaggatggcgacctcatctacgccgatgacaccgccggatgggatacacggattaccgaggacgatctgcttaatgaggaactgatcacggagcagatggcgccccaccatagaattctcgctaaagccatcttcaagctgacctatcaaaacaaagtcgtgaaggtgcttcgccctacacccaaaggcgccgttatggacatcatttcccggaaggatcagagagggtctggacaggtgggcacctacgggctgaatacatttaccaacatggaagtccagctcatccgccaaatggaggctgaaggagtgattacacaggacgacatgcagaatccgaaaggcctgaaggagcgggttgagaagtggctgaaagaatgcggggtggatagactcaagcgcatggccatcagcggcgacgattgtgtcgtgaaacctctggacgagcggttctccacctctcttctgtttctcaacgatatgggaaaggtcagaaaagacattccccagtgggaacccagcaagggctggaagaattggcaagaggtgcctttctgctcccaccactttcataaaatcttcatgaaggatgggcgcagcctggttgtgccgtgtcggaaccaggacgaacttatcggaagagctcgcatttctcagggcgccgggtggtccctgcgggagacggcgtgcctcggaaaagcctacgctcagatgtggagcctgatgtattttcacagacgggatctgagactcgcctctatggctatctgttccgccgtccccacagagtggttccctaccagccgcaccacatggtccattcatgcgcaccaccaatggatgaccacagaagacatgctgaaggtgtggaatcgggtttggatcgaggataaccccaatatgacggacaaaacccctgtgcattcttgggaagacattccctaccttggcaagagagaggatctgtggtgcgggagcctcatcggcctgtccagccgcgccacatgggctaagaacattcacaccgccatcacacaggtcagaaatcttatcggaaaagaagagtatgtggactacatgcctgtgatgaagcggtattctgctccctttgagtccgaaggcgttctgtga

SEQ ID NO: 21022 - RNA, 9867 nt, synthetic construct
  misc_feature 1..9867: note = derived and/or modified CDS sequence (opt5) from DENV-4__KU513441__SS-prME
  source 1..9867: mol_type = other RNA
agcaccatcacactgctctgcctgattcccacggtgatggccttccacctttccaccagagacggcgagcctctgatgatcgtcgctaagcatgaacgggggcgcccgctcctgtttaaaacaaccgagggaattaacaagtgtacacttatcgccatggatctgggcgaaatgtgcgaggacaccgttacatacaaatgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggatccttagaaatcctggcttcgctctgctcgccggctttatggcttacatgatcgggcagacaggaattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctcttattagcaatatcaccacagccacccgctgcccgacgcaaggagagccctatctgaaggaggaacaggaccagcagtacatttgtagacgggatgtggtggaccgcggctgggggaacggatgcggcctcttcgggaaaggaggcgtcgtgacatgcgcgaagttttcttgttccggcaaaatcaccgggaatctggttcaaattgagaaccttgaatataccgtggtcgtgacagttcataatggagatacccacgccgtgggcaacgacacaagcaatcacggggtcacggctaccatcacacctagatctccctccgtggaggtcaagctgcctgattacggagaactcaccctggactgcgagccccggagcggcatcgacttcaacgagatgattctgatgaagatgaaaaagaaaacatggctcgtgcataagcagtggtttctggatcttccgctgccttggaccacgggggccgacacctctgaagttcactggaattacaaagagagaatggtgacattcaaggtcccccatgctaaacgccaggatgtgaccgttctcggctcccaggaaggagccatgcacagcgccctggctggcgcgacagaggtggactccggggatggaaaccacatgtttgccggccatcttaagtgtaaggtccggatggaaaaactgagaatcaaggggatgtcttataccatgtgcagcggaaaattctccattgacaaggagatggctgagacgcaacacggcacaaccgtggtgaaagttaagtacgaaggggccggcgccccttgtaaggtccccatcgagattcgcgatgtgaataaagaacgggtggtcggaagagtgatcagcgctacacccctcgccgagaacaccaactctgttaccaatatcgagctggaacctccgttcggcgactcctatattgtgatcggggtcggaaacagcgcgctgacactccattggtttcgcaagggctctagcattgggaaaatgttcgagtccacgtaccggggagctaagagaatggccatcctgggcgaaaccgcctgggattttgggtctgtgggcggacttttcacaagcctgggcaaagctgttcaccaggtgtttgggtccgtctataccacaatgttcggaggcgtgagctggatgattcgcatcctcatcgggtttctggttctgtggattggaaccaattctcggaacacgtccatggccatgacatgcatcgctgtgggcgggattacccttttcctcggctttaccgtccaggccgacatgggatgtgtggtgagctggtctggcagagagctgaagtgcgggtccggaatcttcgtcgttgataatgtgcatacatggaccgaacaatacaagtttcagcccgagagccctgcgcgcctggcctccgctattctcaacgcccacaaagacggcgtgtgtgggatccggtctacaacgagactggagaatgtcatgtggaagcagattaccaacgaacttaattatgtgctgtgggagggaggccacgacctcacagttgtggctggcgatgtcaaaggggtgctgaccaagggaaaacgggccctgacaccccctgcgagcgaccttaagtactcctggaagacctggggcaaagccaagatcttcacgcccgaagctcgcaactctacctttctcatcgatgggccggacacaagcgagtgccctaatgaaagacgggcctggaactccttcgaggttgaggattacggattcggcatgtttaccacaaatatttggatgaaattcagagaagggagctctgaggtgtgtgaccatcgcctgatgtccgctgccatcaaggatcagaaagccgtccacgctgacatgggatattggattgaaagctctaagaaccaaacctggcagatcgagcgggcgtccctgattgaagtgaaaacatgcctctggcccaagacccatacgctgtggagcaatggcgttcttgagtctcagatgctgatccctaagagctacgccggccccttttcccagcacaactatagacaagggtacgctacacagaccgtgggaccttggcacctcggcaaactggagatcgatttcggggaatgccccggaaccacagtcaccattcaggagaactgtgaccatcgcggcccgagcctgagaacgacaaccgcctctgggaagcttgtgacacagtggtgctgtcggtcctgcaccatgcctcccctccgctttctgggagaagatggctgttggtatggcatggagatcagacccctgagcgagaaagaagagaatatggtgaagtcccaagtcacagccgggcagggaacctctgaaacgttcagcatgggcctcctgtgccttaccctgtttgttgaggaatgtctccggcgcagagtgacacggaaacacatgattctggctgtggtcatcaccctgtgcgccattatccttgggggactcacatggatggacctgctgcgcgcgctcatcatgctgggcgataccatgtccgggagaattggaggccagacgcatcttgctatcattgccgtgttcaagatgtctcctggctacgttctgggggtgtttctccggaagctgacaagccgcgagaccgccctgatggtcatcggaatggctatgacaaccaccctttccattccgcacgacctgatggagctcatcgacggcatctctctggggctcattctgcttaaaatcgtgacacagttcgataacacgcaagttggaaccctggccctcagcctgacatttattagatccaccatgagcctggtgatggcgtggcggacaatcatggctgtccttttcgtggtcaccctgattcccctctgtagaacgtcttgcctgcagaagcagtcccattgggtggaaatcacagccctcattctgggcgcccaagctcttcctgtttatctgatgaccctcatgaaaggggccagccgccggtcttggcccctgaatgagggaatcatggctgtgggcctggtctcccttctgggcagcgccctcctgaagaacgacgtgcctctcgcggggcccatggttgccggaggcctgcttctggctgcctacgtgatgtctgggtccagcgctgatctgtccctcgaaaaagccgccaatgtccagtgggacgagatggctgatatcaccggaagctctcctattatcgaagtgaagcaggacgaggatggcagcttttccattagagacgtggaggaaacaaacatgatcaccctgcttgttaagctggcgctcattacagtctctgggctgtaccccctcgccatcccgatcacgatgaccctgtggtatatgtggcaggtgaaaacacaacgcagcggagctctttgggatgtgccttcccccgccgccacccagaaggctgccctgtctgagggcgtctaccggattatgcagagaggcctgttcgggaaaacacaggtgggagttggcatccacatggaaggggtgttccacaccatgtggcatgtcacgcgcggaagcgtgatttgtcacgagaccggccggctcgaaccttcctgggcggacgttagaaatgatatgatctcttatgggggaggctggcgcctgggcgacaagtgggataaagaggaggacgtgcaagtccttgctattgaacccgggaagaacccgaagcatgtgcagacaaaacctggactgtttaagaccctcacaggcgagatcggggccgttaccctggacttcaaacccggaacaagcggctcccctatcattaatcggaaggggaaagtgatcggcctctacggaaacggcgtcgtgacgaagagcggggattatgtgtctgccattacccaggctgaaagaatcggagagcccgactacgaggtcgatgaagacatttttcggaaaaagcgcctgacaatcatggatcttcaccccggcgccgggaagaccaaaagaattctgccttccatcgttcgggaggcgctgaagcgcagactccggaccctgatccttgctccgacaagagtggtggccgccgaaatggaggaagctctgcgcggactccccattcggtatcagacgcctgccgtcaaaagcgagcataccggcagagagatcgtggacctgatgtgccacgctacattcaccacacgcctcctgtcttccacccgggttcccaattacaaccttattgtgatggatgaagcccactttacggaccctagctccgtcgcggccagagggtacatctctacacgcgtggagatgggcgaagctgccgctattttcatgaccgccaccccccctggagccacagatccgtttccccaaagcaattcccctatcgaggacatcgaacgggagattcccgagagaagctggaacaccggcttcgattggatcacagactatcaggggaagaccgtttggtttgtgccttctattaaagctggaaatgacatcgcgaactgcctgcgcaagtccggcaagaaagtcattcagctgagcagaaagacgttcgatacagaataccccaaaaccaagctcacagactgggattttgtggtcaccacggacatctctgagatgggggccaacttccgggctggacgcgtgatcgatccgagacggtgtctgaaacctgttattcttaccgacggccccgaacgcgtgatcctggccgggcccattcctgtgacacccgccagcgctgcccaaagacggggcagaatcggacgcaatcctgcgcaggaggatgaccagtatgtcttctccggcgatccgctcaagaacgacgaagatcatgctcactggaccgaggccaagatgctgctggacaatatttacacacccgaggggatcattcctaccctctttggacccgaacgggagaaaacacaggccatcgatggcgaattcagacttcgcggggagcaacggaagacctttgttgagctgatgagacggggagacctgcctgtgtggctctcttataaagtggctagcgccggcatctcctacaaggaccgcgaatggtgcttcacgggcgagagaaacaatcagattctggaagagaacatggaagtcgagatctggacacgggagggggaaaaaaagaagcttcgccccaaatggctggatgcgagagtgtatgccgacccgatggctctcaaggattttaaagagttcgcctctggacggaagagcattaccctggacatcctgaccgaaattgcttccctccctacataccttagctctcgcgccaaactggctctggataatatcgttatgctccataccacagagagaggcgggcgggcctaccagcacgcgctgaacgaacttcccgagtccctggagacgctcatgctggtggccctgctcggagctatgaccgccggcatctttcttttctttatgcaggggaagggaattggcaagctgagcatgggcctgatcacaattgctgtcgcctccgggctcctgtgggtggccgaaatccaacctcagtggattgctgcgtctatcatccttgagttctttctgatggtcctcctgattcccgaacctgagaaacagcgcaccccccaggacaatcaactgatctatgtgattctcacaatccttaccattatcggactgattgccgctaacgaaatgggcctgatcgagaagacgaaaaccgatttcgggttttaccaggttaagacagagaccacaatcctcgacgtggatctgagaccggccagcgcctggaccctttatgctgtcgccacgacaattctgacccctatgctccggcacacaatcgaaaatacctccgcgaacctgtctctggccgctattgccaatcaggctgccgtgctcatgggacttggcaaagggtggcccctgcatagaatggacctgggagttcccctcctggcgatgggctgttacagccaggtgaaccctaccacacttacggcctccctggtcatgctcctggtgcactatgctatcattggcccggggctgcaagccaaggctacccgcgaggcccagaaacggacagctgccggaatcatgaagaatcccaccgtggatggcatcacagttattgacctcgaacctatcagctacgatcccaagttcgagaaacagcttgggcaagtcatgctgctggtgctctgcgcgggacagctgcttctgatgagaaccacgtgggccttctgtgaggtgctcacactggctaccggccctattctgaccctctgggaagggaaccccggacgcttttggaacacaaccatcgccgtctctacagctaatattttccggggctcctatcttgccggcgccgggctggcgtttagcctgatcaagaacgctcagacgcctagacgcggaaccggcacagccggggagaccctcggagaaaaatggaagcggcagctgaattctcttgacagaaaagagttcgaagagtacaagcgctccggcatcctggaggttgaccggacagaagctaagagcgccctcaaagatgggtctaagattaaacatgccgtgagcagaggatcctctaagatccgctggattgtggagcggggcatggtcaaaccgaagggcaaggtggttgacctggggtgcggaagaggcgggtggagctactatatggctaccctgaaaaacgtgacggaagtcaagggatacaccaaaggcgggcccggacacgaggaacctatccccatggccacatatggctggaatctcgtgaagcttcattccggcgttgatgtgttttacaaacctaccgagcaagtcgacacactgctgtgtgatattggggagagctcctctaaccccaccatcgaagagggacgcacactcagagtgctgaagatggtggaaccgtggcttagctccaagcctgagttctgcattaaagtcctgaatccctatatgcccaccgttatcgaagagctcgagaagctgcagcggaaacacggcgggaacctggtgcgctgtcctctctctagaaatagcacgcacgaaatgtactgggtgtccggagcgtctggcaacatcgtcagctccgtgaatacaaccagcaagatgcttctgaaccggtttaccacaagacatcggaaacccacgtatgagaaggacgttgatctgggggccggaacccgctctgtgtccacagaaattgagaaacctgacatgaccatcattggcagacggctccagcgcctgcaggaggaacacaaggagacatggcattacgatcaagaaaatccgtacagaacctgggcttatcacggcagctacgaggccccctctacagggtccgctagctctatggtcaacggagtggttaagcttctgaccaaaccttgggacgtgatccccatggtcacgcagctcgccatgaccgatacaacccctttcggccagcagcgggtgtttaaggaaaaagttgacacacgcaccccccaaccgaagcctgggacgagaatggtgatgacaaccacagcgaattggctgtgggccctgctcggaaaaaagaagaacccccggctgtgcacccgcgaggagttcatttccaaagtcagaagcaatgctgccatcggcgctgtgtttcaggaagagcaggggtggacgtccgccagcgaagctgtcaacgactctcggttctgggagcttgtggataaggaacgcgccctgcaccaagagggcaaatgtgagagctgcgtttataacatgatgggaaagagagaaaaaaagctcggcgagtttgggcgggcgaagggatcccgcgccatctggtacatgtggctgggcgctagattccttgaattcgaggccctggggtttctcaatgaagaccattggttcggacgggagaactcttggagcggcgtggagggggaaggcctgcacagactgggatatattctcgaggaaatcgataaaaaggacggcgatctgatgtacgctgacgataccgccgggtgggacacacgcattaccgaggatgaccttcagaatgaggaactgatcacagagcagatggcccctcatcacaaaattctcgcgaaggctatctttaaactgacctatcagaacaaggtcgtgaaggtgcttcggcccacacctagaggagccgttatggatatcatttcccgcaaagaccaacggggctctgggcaggtgggaacctacggcctgaatacgttcacaaacatggaagtccagctcatcagacagatggaggccgaaggggtgattacccaagatgacatgcagaatcccaagggcctgaaagagcgcgttgagaagtggctgcgggaatgcggagtggacagactcaaacgcatggctatcagcggcgatgactgtgtcgtgaagccgctggatgagcggtttgggacctcccttctgttcctcaacgacatgggaaaagtcagaaaggatattcctcagtgggaaccctctaagggctggaaaaattggcaggaggtgcccttttgcagccatcacttccacaagatctttatgaaagacgggcgctccctggttgtgccttgtcggaaccaagatgaacttatcggaagagcccggattagccagggcgctgggtggtctctgagagagacagcctgcctcggcaaggcgtacgcccagatgtggtccctgatgtatttccatcgccgggacctgagactcgctagcatggccatctgttctgctgtcccgaccgagtggtttcccacatcccgcacgacctggagcattcacgcccatcaccagtggatgacaaccgaagatatgctgaaagtgtggaatagagtttggatcgaggacaaccctaatatgattgataagacacccgtgcactcctgggaagacatcccttaccttggaaagcgggaggacctgtggtgcggctctctcattgggctgagctcccgcgcgacctgggccaaaaacatccatacggctatcacccaagtcagaaatcttattggaaaggaagagtatgtggattacatgagcgtgatgaaacggtattctgccccctccgagagcgaaggcgttctgtga

SEQ ID NO: 21023 - RNA, 9867 nt, synthetic construct
  misc_feature 1..9867: note = derived and/or modified CDS sequence (opt5) from DENV-4__KC762694__SS-prME
  source 1..9867: mol_type = other RNA
agcacaatgacactgctctgcctgatccccacggtgatggctttccacctttccacccgggacggcgagcctctgatgattgtggctaagcatgaacgggggcgcccgctcctgtttaagacaaccgagggaatcaacaagtgtacacttattgccatggatctgggcgaaatgtgcgaggacaccgttacatacaaatgtcccctcctggtgaataccgaacctgaggatatcgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggattcttagaaatcctggcttcgctctgctcgccggctttatggcttacatgatcgggcagacaggaatccagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtattgaagctagcatctctaatattaccacagccacccgctgcccgacgcaaggagagccctatcttaaggaggaacaggaccagcagtacatctgtagacgggatgtggtggaccgcggctgggggaacggatgcggcctgttcgggaaaggaggcgtcgtgacatgcgcgaagtttctctgttccggcaaaattaccgggaatctggttcaaatcgagaaccttgaatataccgtggtcgtgacagttcataatggagatacccacgccgtgggcaacgacacaagcaatcacggggtcacggctaccattacacctagatctccctccgtggaggtcaagctgcctgattacggagaactcaccctggactgcgagccccggagcggcatcgacttcaacgagatgatcctgatgaagatgaaaaagaaaacatggctcgtgcataagcagtggtttctggatcttccgctgccttggaccgccggggctgacacgtctgaagttcactggaattacaaagagagaatggtgaccttcaaggtcccccatgccaaacgccaggatgtgacagttctcggctcccaggaaggagccatgcacagcgctctggcgggcgccaccgaggtggactccggggatggaaaccacatgtttgctggccatcttaagtgtaaggtccggatggaaaaactgagaattaaggggatgtcttatacaatgtgcagcggaaaattctccatcgacaaggagatggccgagacccaacacggcacgacagtggtgaaagttaagtacgaaggggccggcgctccttgtaaggtccccattgagatccgcgatgtgaataaagaaaaggtggtcggacggattatcagctctacccccttcgccgagaacacaaactccgtgaccaatatcgagctcgaacctccgtttggcgacagctatattgttatcggggtgggagattctgcgctgaccctgcattggttcagaaaaggcagctccattgggaagatgtttgagtctacataccgcggagctaaacggatggccatcctcggcgaaacggcctgggacttcgggagcgtcggcggactgtttacctcccttggcaaggctgtgcaccaggttttcgggagcgtgtatacaaccatgtttggaggcgtctcttggatgattagaatcctgatcgggttcctcgtgctgtggattggaacaaactcccgcaataccagcatggccatgacgtgcatcgctgttggcgggattacactgtttcttggcttcaccgtgcaggccgatatgggatgtgtcgtgtcttggaacggcaaggagctcaaatgcgggtccggaatctttgtggtcgacaatgttcatacctggacagaacaatacaagttccagcccgagagccctgcgcggctggcctccgctattctgaacgcccacaaagacggcgtgtgtgggatcagatctaccagccgcctcgagaatgtgatgtggaagcagattacaaacgaactgaattatgtcctttgggagggaggccacgatctgacggtggttgctggcgacgtgaaaggggtcctcaccaagggaaagcgggccctgacaccccctgtgaacgatctgaaatactcctggaagacctggggcaaagcgaagatctttacacccgaagccagaaattctaccttccttatcgacgggccggatacgagcgagtgccctaacgaacggcgcgcttggaatttctttgaggttgaggactacggattcggcatgtttaccacaaacatttggatgaaattcagagaagggtccagcgaggtgtgtgatcatcggctcatgtctgccgctatcaaggaccagaaagccgtccacgccgatatgggatattggattgaatccagcaagaatcaaacctggcagatcgagaaggcttctctgattgaagtgaaaacatgcctgtggcccaagacccatacactctggtccaacggcgttctggagagccagatgcttatccctagatcttacgcgggcccctttagccagcacaactatcgccaagggtacgccacccagacggctggaccttggcacctgggcaaactcgagatcgacttcggggaatgccccggaacaaccgtgaccattcaggaggattgtgaccatcggggcccgtccctgagaacaaccacggccagcgggaagctggtcacacagtggtgctgtcgctcttgcaccatgcctccccttagatttctcggagaagatggctgttggtatggcatggagatccggcccctgtccgagaaagaagagaatatggtcaagagccaagtgacagccgggcagggaacctccgaaacattctctatgggcctgctctgcctgaccctttttgtcgaggaatgtctgcgcagacgggttacgcgcaagcacatgattctcgtggtggtcatcaccttctgcgctattatcctcgggggactgacatggatggaccttctcagagccctgatcatgctgggcgacaccatgagcgggcggattggaggccagatccatctcgcgattatggctgtgtttaaaatgtcccctggctacgttctgggggtgttccttcgcaagctgacatctagagagaccgccctcatggtcatcggaatggccatgacgacagtgtttagcattccgcacgatctgatggagctgatcgacggcatctcccttgggctgattctcctgaaaatcgttacccatttcgataacacacaggtgggaaccctcgctctgtctcttaccttcattcggagcacaacgcccctggtcatggcctggcgcaccatcatggcggtgtttttcgtcgtgacactcattcctctgtgtagaacctcctgcctgcaaaagcagagccactgggttgaaatcacagctcttattctgggcgcccaggccctccccgtgtatctgatgaccctcatgaaaggggcttctcggagatcctggcctctgaatgagggaatcatggccgtcggccttgtgagcctgctcggctctgctctgctgaagaacgacgttccccttgccgggcctatggtggcgggaggcctgctcctggccgcttacgtcatgtccgggagctctgccgatctctccctggaaaaggctgccaatgtgcaatgggacgagatggccgatatcacgggaagctcccccattatcgaagtgaaacaggacgaggatggcagcttttctattcgcgacgttgaggaaacaaacatgatcacccttctggtcaagctggctctcattaccgtgagcgggctgtacccgcttgcgatccctgtgacaatggccctgtggtatgtctggcaagtgaaaacccagcggtccggagctctctgggatgttccctctcctgccgccacacaaaaggctacgctgagcgagggcgtgtacagaatcatgcagcgcggcctcttcgggaaaacccaggtcggagtgggcattcacatggaaggggtttttcatacaatgtggcacgtgacccggggatccgtcatctgtcatgagacaggcagactggaaccctcttgggccgacgtgcgcaatgatatgattagctatgggggaggctggcggcttggcgacaagtgggacaaggaggaggatgttcaggtgctggcgatcgaaccggggaaaaaccctaagcacgtccaaaccaaacccggactgttcaagacgctcaccggcgagattggggctgtgacactggactttaaacctggaacctccggctctcccatcatcaataagaaagggaaggtgattggcctttacggaaacggcgtcgttacaaagagcggggattatgtgtccgccatcacccaggccgaaagaattggagagcccgactacgaggtggatgaagacatcttccgcaaaaagcggctgacaattatggatctccatcctggcgctgggaaaacgaagagaatcctgccgagcattgtccgggaggccctcaaacgcagactgcggacccttatcctggcgcccacacgcgtggttgctgccgaaatggaggaagccctgagaggactccctatccggtatcagacccccgctgtgaagtctgagcacaccggcagagagattgtcgacctgatgtgccacgccacatttacgacccgccttctgtccagcacacgggtgcctaattacaacctcatcgttatggatgaagctcatttcaccgacccctgctctgtggccgcgagagggtacatttccacacgcgtcgagatgggcgaagccgctgccatctttatgaccgctacgcctccgggaagcattgatcccttccctcagtccaattctcccatcgaggacatcgaacgggagattcctgagagaagctggaacacaggcttcgactggatcaccgattatcaagggaagaccgtgtggtttgtcccctccattaaagccggaaatgacatcgccaactgtctgcgcaagagcggcaaacgggtgattcagctctctagaaagacattcgataccgaatacccgaaaacaaagctgaccgactgggattttgttgtgacgacagacatctccgagatgggggctaacttccgcgcgggaagagtgatcgatcctcggcgctgccttaagcccgtcattctgaccgacggccccgaaagagttatcctggccgggcctattcccgtgacccctgctagcgccgcccagcggcgcggcagaatcggacggaatccggctcaagaggatgaccagtatgtgttttctggcgatcccctcaaaaacgacgaagatcacgcccattggaccgaggcgaagatgctgcttgacaatatttacacgcctgaggggatcattcccaccctgttcggacctgaaagagagaaaacacaggctatcgacggcgaatttcgcctcagaggggaacagagaaagaccttcgtcgagctgatgcgccggggagatctgcccgtgtggctcagctataaagttgcctccgccggcatctcttacaaggacagagaatggtgttttacaggcgagcggaacaatcaaattcttgaagagaacatggaagtggagatctggacccgcgagggggaaaagaaaaagctgagaccgaaatggctggatgctcgggtctatgccgaccctatggcgctcaaggatttcaaagagtttgccagcggacgcaagtccattacactggacatccttaccgaaattgctacgctgcccacatacctctctagcaaggccaaactggctctggataatatcgtgatgctccacaccaccgagaagggcgggagagcctaccagcacgctcttaacgaactgcctgagtccctggagacactcatgctggtcgcccttctgggagcgatgaccgccggcatcttcctctttttcatgcaggggaaaggaattggcaagctgagcatgggcctgatcgctattgccgtggcttctgggctcctttgggttgccgaaatccagccccaatggattgccgcttccatcatcctggagttctttctgatggtgctcctgattcctgaacccgagaaacagcggacaccgcaggacaatcagcttatctatgtcattctgacgatcctcaccattatcggactgattgcggccaacgaaatgggcctgatcgagaagacaaaaaccgatttcgggttttaccaagtgaagacagagaccacgatcctcgacgttgatcttcgccctgctagcgcctggaccctgtatgccgtggctacaaccattctgacacccatgctcagacataccatcgaaaatacgtccgccaacctgtctcttgcggccattgctaatcaggccgctgtcctgatgggactcggcaaggggtggcccctgcaccggatggacctgggagtgcctctccttgccatgggctgctacagccaggtgaacccgacaaccctgacagcgtccctggttatgctcctggtccattatgccatcattggccccgggcttcaggctaaagccacccgcgaggctcaaaagagaaccgccgctggaatcatgaaaaatcctacagtggatggcatcacggtgattgacctggaacccatctcttacgaccctaagttcgagaaacagctcgggcaggtcatgctgctggttctctgtgtgggacaacttctgctgatgcggaccacatgggccctctgcgaggtgctgacccttgcgacaggccccgtcatgaccctgtgggaagggaaccctggaagattttggaacacgacaattgccgtgagcaccgctaatatcttccgcggctcctatctcgccggcgctgggctggcctttagcctgattaagaacgcccagaccccgcggagaggaacaggcaccacaggggagacgctcggagaaaagtggaaacgccagcttaattctctggatcggaaggagttcgaagagtacaaaagatccggcatcctggaggttgaccgcaccgaagccaagagcgctctccgggatgggtctaaaatcaagtacgccgtgtccagaggaagctctaagattcgctggatcgtcgagcggggcatgattaaacccaagggcaaagtggttgacctggggtgtggaagaggcgggtggagctattacatggctacacttaagaacgtgaccgaagtcaaaggatatacaaagggcgggcctggacacgaggaacccatccctatggccacctacggctggaatctggtgaagctccattccggcgtggatgtcttttataaacccacggagcaggttgacaccctgctgtgcgatattggggagtctagctccaacccgacaatcgaagagggacgcaccctccgggtgcttaagatggtggaaccttggctgagctccaaacccgagttctgtattaaggtcctgaatccctacatgcctacagtgatcgaagaactggagaaactgcaaagacgccacggcgggtctcttgttagatgccccctgagccggaactccacccacgaaatgtattgggtgtctggagccagcggcaatatcgtctcctctgtgaacacaattagcaagatgctcctgaatcgctttaccacgagacatcggaaacctacatacgagaaggacgttgatctgggggctggaaccagatccgtgagcaccgaaacagagaagccggacatgacgatcattggccggcgcctccagagacttcgggaggaacacaaagagacctggcattacgatcaggaaaacccctatcgcacatgggcctaccacggctcttatgaggcgccttccaccgggagcgcctcttccatggtcaatggagtggttaagctgctgacaaaaccctgggacgtgatccctatggtcacccagctcgctatgacagacaccacgcccttcggccaacagagagtgtttaaggaaaaagtcgatacccggacaccgcagcctaagcccgggacccgcatgattatgacaaccacggccaactggctgtgggcccttctgggaaagaaaaagagccctagactctgtacacgggaggagttcatctctaaagtgcgctccaatgccgcgatcggcgccgttttccaggaggagcaggggtggaccagcgcttccgaagccgtgaacgacagcagattttgggagctggtcgataaggaacgggctctgcaccaggagggcaaatgcgagtcttgcgtgtacaatatgatgggaaagcgcgaaaagaaactcggcgagttcgggagagccaagggaagccgggctatttggtatatgtggctgggcgcccgctttcttgagttcgaggcgctggggtttctcaacgaagaccattggttctccagagagaactcttggagcggagtggagggcgaagggctgcaccggcttggctacatcctggaggatattgacaaaaaggatggagacctcatctatgccgatgacacagctggctgggataccagaattacggaagacgatctgctgaatgaggagctcatcaccgaacagatggcgccccatcacaaaacactggctaaggccatctttaaacttacctaccaaaacaaagttgtgaaggtcctgcgccctacacccaaaggggccgtgatggacattatctcccggaaggaccagagaggatctggccaggttgggacctacggactcaatacattcaccaacatggaggtgcagctgattcgccaaatggaagcggagggcgtcatcacgcaggatgacatgcagaatccgaaagggcttaaggaacgggtggagaaatggctgaaggagtgtggcgtcgatagactcaagcgcatggctattagcggagacgattgcgtggttaaacctctggacgaacggttttccacatctctcctgttcctgaacgatatgggcaaggtgagaaaagacatcccccagtgggagcccagcaaggggtggaaaaattggcaagaagtccctttttgttcccatcacttccacaagatctttatgaaggatggacgcagccttgtggttccgtgccggaaccaggacgagctgattggcagagcccgcatctctcagggggccggatggtccctccgggaaaccgcttgtctgggcaaagcctatgctcagatgtggagccttatgtacttccatagacgggatctgagactcgcctctatggcgatttgctccgccgtgcccaccgagtggttccctacaagccgcaccacatggtccatccacgctcatcaccaatggatgacgaccgaggacatgctgaaggtctggaatcgggtgtggattgaagacaaccccaatatgacagataaaacccctgtgcactcttgggaggacatcccctatctggggaagagagaagatctctggtgtggcagcctgattggactttccagccgcgccacatgggctaaaaacatccataccgccatcacgcaggttagaaatctgattggcaaggaggaatacgtcgactatatgcctgcgatgaagcggtactctgccccctttgagtccgagggggtgctctga

SEQ ID NO: 21024 - RNA, 9867 nt, synthetic construct
  misc_feature 1..9867: note = derived and/or modified CDS sequence (opt5) from DENV-4__KC762695__SS-prME
  source 1..9867: mol_type = other RNA
agcaccatgacactgctctgcctgatccccacggccatggctttccacctttccaccagagacggcgagcctctgatgattgtggccaagcatgaacgggggcgcccgctcctgtttaaaacaaccgagggaatcaacaagtgtacacttattgcgatggatctgggcgaaatgtgcgaggacaccgtcacatacaaatgtcccctcctggttaataccgaacctgaggatatcgactcttggtgcaacctgacgagcacctgggtgatgtatgggacatgtacccagtccggagagagacggcgcgaaaagagatctgtggctctcacaccccacagcggcatggggctggagacccgggccgaaacgtggatgtcctctgagggagcctggaaacatgctcaacgcgtcgagagctggattcttagaaatcctggcttcgccctgctcgctggctttatggcctacatgatcgggcagacaggaatccagcggaccgtgttctttgttctgatgatgcttgtggcgccctcctatggcatgcgctgcgtcggggtgggaaacagagatttcgttgaaggcgtgagcgggggagcctgggtcgacctggtgctcgagcacggcggctgtgtgacaaccatggctcaggggaagcctaccctggattttgaactgacaaagacgaccgccaaagaggtcgctctcctgcggacatactgcattgaagcctctatctccaatattaccacagcgacccgctgtccgacgcaaggagagccctatcttaaggaggaacaggaccagcagtacatctgcagacgggatgttgtggaccgcggctgggggaacggatgtggcctgttcgggaaaggaggcgtggtcacatgcgccaagtttctctgcagcggcaaaattaccgggaatctggtgcaaatcgagaaccttgaatataccgttgtggtcacagtgcataatggagatacccacgctgttggcaacgacacatctaatcacggggtgacggccaccattacacctagatcccccagcgtcgaggtgaagctgcctgattacggagaactcaccctggactgtgagccccggtctggcatcgacttcaacgagatgatcctgatgaagatgaaaaagaaaacatggctcgtccataagcagtggtttctggatcttccgctgccttggaccgctggggccgacacgtccgaagtgcactggaattacaaagagagaatggttaccttcaaggtgccccatgccaaacgccaggatgtcacagtgctcggcagccaggaaggagctatgcactccgcgctggccggcgctaccgaggttgactctgggaacggaaatcacatgtttgccggccatcttaagtgcaaggtgcggatggaaaaactgagaattaaggggatgagctatacaatgtgttccggaaaattcagcatcgataaggagatggccgagacccaacacggcacgacagtcgtgaaagtgaagtacgaaggggctggcgccccttgcaaggttcccattgagatccgcgacgtcaacaaagaaaaggtggtgggacggattatctcttccacccccttcgcggagaacacaaatagcgtcaccaacatcgagctcgaacctccgtttggcgattcttatattgtgatcggggttggagacagcgctctgaccctgcattggttcagaaaaggctcctctattgggaagatgtttgagagcacataccgcggagccaaacggatggccatcctcggcgaaacggcttgggatttcgggtccgtgggcggactgtttaccagccttggcaaggccattcaccaggtcttcgggtctgtgtatacaaccatgtttggaggcgtttcctggatgatcagaatcctgattgggctcctggtgctgtggatcggaacaaatagccgcaacacctctatggctatgacgtgtattgccgtcggcgggatcacacttttcctcggctttaccgtgcaggcggacatgggatgcgttgtgtcctggaatggcaaggagctgaaatgtgggagcggaattttcgtcgtggataacgtgcatacctggacagaacaatacaagtttcagcccgagtcccctgcccggctggcttctgccatcctcaatgctcacaaagacggcgtctgcgggattagaagcaccacacgcctggagaacgttatgtggaagcagatcacgaatgaacttaactatgtgctgtgggagggaggccacgacctcaccgtggtcgccggcgatgtgaaaggggttctgacaaagggaaagcgggcgctgaccccccctgtgaatgaccttaaatactcctggaagacatggggcaaagccaagatcttcacccccgaagctagaaactctacgtttctcattgatgggccggacaccagcgagtgtcctaatgaacggcgcgcctggaacttcctggaggtcgaggattacggattcggcatgttttccacaaatatctggatgaaattcagagaagggagctctgaggtgtgcgaccatcggctgatgtccgctgccattaaggatcagaaagccgttcacgctgacatgggatattggatcgaaagctctaagaaccaaacctggcagattgagaaggcgtccctcatcgaagtgaaaacatgtctgtggcccaagacccatacactttggagcaacggcgtcctggagtctcagatgctcatccctagaagctacgccggccccttttcccagcacaattatcgccaagggtacgctacccagattgccggaccttggcacctgggcaaactggagatcgatttcggggaatgccccggaacgacagtgaccattcaggaggactgcgatcatcggggcccgagccttagaaccacaaccgcctctgggaagctcgttacgcagtggtgttgccgctcctgtacaatgcctcccctgagatttctgggagaagacggctgctggtatggcatggagatccggcccctcagcgagaaagaagagaacatggtgaagtcccaagtcaccgctgggcagggaacatctgaaaccttcagcatgggcctgctttgtctgacactctttgtggaggaatgcctgcgcagacgggtgacccgcaagcacatgattctggtcgttacgatcaccttctgtgccatcattcttgggggactcacatggatggatctgctgagagcgctcatcatgctgggcgacaccatgtccgggcggattggaggccagatccatcttgctattatggccgtgtttaaaatgtctcctggctacgtgctgggggtcttcctccgcaagctgacaagcagagagaccgccctgatggtgatcggaatggctatgacgacagttttttccatcccgcacgaccttatggagctgattgatggcatctctctcgggctgattctcctgaaaatcgtgacccatttcgacgatacacaggtcggaacccttgccctgagcctcacctttattcggtccacaacgcccctggtgatggcgtggcgcaccatcatggctgttttcttcgtggtcacactgattcctctttgcagaaccagctgtctgcaaaagcagtctcactgggtggaaatcacagccctcatcctgggcgcccaggctctccccgtctatctgatgacccttatgaaaggggcctcccggagaagctggcctctgaatgagggaattatggctgtgggcctcgtttctctgctgggctccgcccttctgaagaacgacgtgcccctcgcggggcctatggtcgccggaggcctgctcctggctgcctacgtgatgagcgggtcttccgctgatcttagcctggaaaaggccgccaatgttcaatgggacgagatggctgatatcacgggatccagccccattatcgaagtgaaacaggacgaggatggctcttttagcattcgcgacgtcgaggaaacaaacatgatcaccctgctcgtgaagctggcgcttatcaccgtgtccgggctgtacccgctcgccattcctgttacaatggctctgtggtatatctggcaggtcaaaacccagcggtctggagccctctgggatgtgcccagccctgtggccacacaaaaggctacgctgtccgagggcgtctacagaattatgcagcgcggccttttcgggaaaacccaggtgggagttggcatccacatggaaggggtgtttcatacaatgtggcacgtcacccggggatctgtgatttgccatgagacaggcagactggaacccagctgggccgacgttcgcaatgatatgatctcctatgggggaggctggcggctgggcgacaagtgggacaaggaggaggatgtgcaggtcctcgcgatcgaaccggggaaaaaccctaagcacgtgcaaaccaaacccggactgttcaagacgcttaccggcgagattggggctgttacactggactttaaacctggaacctctggcagccccatcattaataagaaagggaaggtgatcggcctctacggaaacggcgtcgtgacaaagtccggggattatgtgagcgccattacccaggccgaaagaatcggagagcccgactacgaggtcgatgaagacattttccgcaaaaagcggctgacaatcatggatctccatcctggcgctgggaaaacgaagagaatcctgccgtctattgttcgggaggcccttaaacgcagactgcggaccctgatcctcgcgcccacacgcgtggtggctgccgaaatggaggaagccctgagaggacttcctattcggtatcagacccccgctgtcaagtccgagcacaccggcagagagatcgtggacctgatgtgtcacgccacatttacgacccgcctcctgagctctacacgggttcctaattacaacctcattgtgatggatgaagctcatttcaccgacccctgctccgtcgccgcgagagggtacatcagcacacgcgtggagatgggcgaagccgctgccatctttatgaccgctacgcctccgggatccacagatcccttccctcagtctaatagccccattgaggacatcgaacgggagattcctgagagatcctggaacaccggctttgactggatcaccgattatcaagggaagacagtttggttcgtgcccagcattaaagccggaaatgacatcgccaactgcctgcgcaagtctggcaaacgggtcatccagctttccagaaagaccttcgatacagaatacccgaaaaccaagctgacggactgggattttgtggtcacaaccgacattagcgagatgggggctaacttccgcgcgggaagagtgatcgatcctcggcgctgtctgaagcccgttattctcacagacggccccgaaagagtgatcctggccgggcctattcccgtgacccctgcttctgccgcccagcggcgcggcagaatcggacggaatccggctcaagaggatgaccagtatgtctttagcggcgatccccttaaaaacgacgaagatcacgcccattggacggaggcgaagatgctgctcgacaatatttacacccctgaggggatcatccccacactgttcggacctgaaagagagaaaacccaggctattgacggcgaatttcgcctgcggggggagcagagaaagacattcgttgagctcatgcgccggggagatcttcccgtgtggctgtcctataaagtggcctctgccggcatcagctacaaggacagagaatggtgctttaccggcgagcggaacaatcaaattctggaagagaacatggaagtcgagatctggacacgcgagggggaaaagaaaaagctcagaccgaaatggctggatgctcgggtgtatgccgaccctatggcgcttaaggatttcaaagagtttgcctccggacgcaagtctattaccctggacatcctcacggaaatcgctacactgcccacctacctgagctccaaggccaaactcgctcttgataatattgttatgctgcacaccacagagaagggcgggagagcctaccagcacgctctgaacgaactccctgagagcctggagacccttatgctggtggccctcctgggagcgatgacagccggcatcttcctgtttttcatgcaggggaaaggaattggcaagctctctatcggccttattgctatcgccgtcgcttccgggctgctgtgggtggccgaaatccagccccaatggattgccgctagcatcattctcgagtttttcctgatggtccttctgatccctgaacccgagaaacagcggacgccgcaggacaatcagctcatttatgtgatcctgaccattctgacaatcatcggactcattgcggccaacgaaatgggccttatcgagaagaccaaaacagatttcgggttttaccaagttaagaccgagacgaccattctggacgtggatctgcgccctgcttccgcctggacactctatgccgtcgctaccacaatcctgacccccatgcttagacatacgattgaaaatacatctgccaacctgagcctcgcggccatcgctaatcaggccgctgtgctgatgggactgggcaaggggtggcccctccaccggatggaccttggagttcctctgctggccatgggctgttactcccaggtgaacccgaccacactcaccgcgtctctggtcatgcttctggtgcattatgccatcattggccccgggctccaggctaaagccacccgcgaggctcaaaagagaacagccgctggaatcatgaaaaatcctacggtggatggcattaccgttatcgacctggaacccattagctacgaccctaagttcgagaaacagctggggcaggtcatgctccttgtgctgtgcgtgggacaactgctcctgatgcggacaacctgggccctttgtgaggtcctgacactcgcgaccggccccatcatgacgctgtgggaagggaaccctggaagattttggaacacaaccatcgccgtttccaccgctaatattttccgcggcagctatctggccggcgctgggctcgccttttctcttatcaagaacgcccagacaccgcggagaggaaccggcacaacgggggagaccctgggagaaaagtggaaacgccagctgaattccctcgatcggaaggagttcgaagagtacaaaagaagcggcattctggaggtggaccgcacagaagcgaagtctgctcttcgggatgggtccaaaatcaagcacgccgtgagcagaggatctagcaagattcgctggatcgtcgagcggggcatgattaaacccaagggcaaagtggttgacctggggtgcggaagaggcgggtggtcctactatatggctaccctcaagaacgtgacagaagtcaaaggatacaccaagggcgggcctggacatgaggaacccatccctatggccacgtatggctggaatctggtgaagctgcactctggcgttgatgtgttttacaaacccaccgagcaggtcgacacactcctttgtgatatcggggagagctccagcaacccgaccattgaagagggacgcacactgcgggtgctgaagatggtggaaccttggctctcctctaaacccgagttctgcatcaaggtcctgaatccctatatgcctaccgttattgaagagcttgagaaactgcaaagacgccacggcgggagcctcgtgagatgtcccctgtcccggaactctacacatgaaatgtactgggtgagcggagcctccggcaatatcgtctctagcgtgaacaccatttccaagatgctgctcaatcgctttacgacaagacaccggaaacctacctatgagaaggacgttgatcttggggctggaaccagaagcgtgtctacagaaacggagaagccggacatgaccatcatcggccggcgcctgcagagactgcgggaggaacataaagagacatggcactacgatcaggaaaacccctaccgcacctgggcctatcacggctcctacgaggcgcctagcacagggtctgcctccagcatggtcaatggagtggttaagctcctgaccaaaccctgggacgtgattcctatggtcacacagcttgctatgaccgacacgacccccttcggccaacagagagtgtttaaggaaaaagttgatacacggaccccgcagcctaagcccgggacacgcatgatcatgaccacgacagccaactggctgtgggctctcctgggaaagaaaaagtctcctagactgtgcacccgggaggagttcatttccaaagtgcgcagcaatgccgcgatcggcgccgtctttcaggaagagcaagggtggacatccgctagcgaagccgtgaacgactctagattctgggagctcgtcgataaggaacgggctctgcatcaggagggcaaatgtgagagctgcgtgtataatatgatgggaaagcgcgaaaagaaacttggcgagttcgggagagccaagggatcccgggctatttggtacatgtggctgggcgcccgctttctcgaattcgaggcgctggggtttcttaacgaagaccactggttctctagagagaacagctggtccggagttgagggcgaagggctgcatcggctcggctatatcctggaggatatcgacaaaaaggatggagacctgatttacgccgatgacaccgctggctgggatacgagaatcaccgaagacgatctcctgaatgaggagcttattacagaacagatggccccccaccataaaaccctggctaaggccatctttaagctcacatatcaaaacaaagtggtcaaggtgctgcgccctacccccaaaggggccgtgatggacattatctctcggaaggaccagagaggaagcggccaggttgggacatacggacttaataccttcacgaacatggaggtgcagctgatccgccaaatggaagcggagggcgtcattacacaggatgacatgcagaatccgaaagggctcgaagagcgggtggagaagtggctgaaagaatgcggcgttgatagactgaagcgcatggctatctccggagacgattgtgtggtcaagcctctcgacgagcggttttctaccagcctgcttttcctgaacgatatgggcaaagtgagaaaggacattccccagtgggaaccctccaaagggtggaagaattggcaagaggtccctttttgcagccaccacttccataaaatctttatgaaggatggacgctctctcgtggttccgtgtcggaaccaggacgaactgattggcagagcccgcatctcccagggggccggatggagccttcgggagaccgcttgcctgggcaaggcctacgctcagatgtggtctctcatgtatttccacagacgggatctgagactggcctccatggcgatttgtagcgccgtgcccacagagtggtttcctatctcccgcaccacatggtctatccatgctcaccaccaatggatgacgaccgaagacatgctcaaagtctggaatcgggtgtggattgaggacaaccccaatatgacagataagacccctatccatagctgggaagacattccctacctggggaaaagagaggatctttggtgcggctccctgatcggactcagctctcgcgccacatgggctaagaacattcacaccgccatctcccaggttagaaatctgatcggcaaagaagagtatgtggactacatgcctgtcatgaagcggtatagcgcgccctctgagagcgaaggggtgctttga

SEQ ID NO: 21025 - RNA, 9867 nt, synthetic construct
  misc_feature 1..9867: note = derived and/or modified CDS sequence (opt5) from DENV-4__KC762696__SS-prME
  source 1..9867: mol_type = other RNA
agcaccatgaccctgctctgcctgatccccacggtgatggccttccacctttccaccagagacggcgagcctctgatgattgtggctaagcatgaacgggggcgcccgctcctgtttaagaccaccgagggaatcaacaagtgtacacttattgccatggatctgggcgaaatgtgcgaggacaccgttacatacaagtgtcccctcctggtgaataccgaacctgaggatatcgactgctggtgtaacctgacgtctacctgggtgatgtatgggacatgcacccagagcggagagagacggcgcgaaaagagatccgtcgccctcacaccccactctggcatggggctggagacccgggctgaaacgtggatgagctccgagggagcctggaaacatgcccaacgcgtggagtcttggattcttagaaatcctggcttcgctctgctcgccggctttatggcttacatgatcgggcagacaggaatccagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtattgaagctagcatctctaatattaccacagccacccgctgcccgacgcaaggagagccctatcttaaggaggaacaggaccagcagtacatctgtagacgggatgtggtggaccgcggctgggggaacggatgcggcctgttcgggaaaggaggcgtcgtgacatgcgcgaagtttctctgttccggcaaaattaccgggaatctggttcaaatcgagaaccttgaatataccgtggtcgtgacagttcataatggagatacccacgccgtgggcaacgacacaagcaatcacggggtcacggctaccattacacctagatctccctccgtggaggtcaagctgcctgattacggagaactcaccctggactgcgagccccggagcggcatcgacttcaacgagatgatcctgatgaagatgaaaaagaaaacatggctcgtgcataagcagtggtttctggatcttccgctgccttggaccgccggggctgacacgtctgaagttcactggaattacaaagagagaatggtgaccttcaaggtcccccatgccaaacgccaggatgtgacagttctcggctcccaggaaggagccatgcacagcgctctggcgggcgccaccgaggtggactccggggatggaaaccacatgtttgctggccatcttaagtgtaaggtccggatggaaaaactgagaattaaggggatgtcttatacaatgtgcagcggaaaattctccatcgacaaggagatggccgagacccaacacggcacgacagtggtgaaagttaagtacgaaggggccggcgctccttgtaaggtccccattgagatccgcgatgtgaataaagaaaaggtggtcggacggattatcagctctacccccttcgccgagaacacaaactccgtgaccaatatcgagctcgaacctccgtttggcgacagctatattgttatcggggtgggagattctgcgctgaccctgcattggttcagaaaaggcagctccattgggaagatgtttgagtctacataccgcggagctaaacggatggccatcctcggcgaaacggcctgggacttcgggagcgtcggcggactgtttacctcccttggcaaggctgtgcaccaggttttcgggagcgtgtatacaaccatgtttggaggcgtctcttggatgattagaatcctgatcgggttcctcgtgctgtggattggaacaaactcccgcaataccagcatggccatgacgtgcatcgctgttggcgggattacactgtttcttggcttcaccgtgcaggccgatatgggatgtgtcgtgtcttggaacggcaaggagctcaaatgcgggtccggaatctttgtggtcgacaatgttcatacctggacagaacaatacaagttccagcccgagagccctgcgcggctggcctccgctattctgaacgcccacaaagacggcgtgtgtgggatcagatctaccacacgcctcgagaatgtgatgtggaagcagattacgaacgaactgaattatgtcctttgggagggaggccacgatctgaccgtggttgctggcgacgtgaaaggggtcctcacaaagggaaagcgggccctgacaccccctgtgaacgatctgaaatacagctggaagacatggggcaaagcgaagatctttacccccgaagccagaaattccacgttccttatcgacgggccggatacctctgagtgccctaacgaacggcgcgcttggaatttctttgaggttgaggactacggattcggcatgtttacaaccaacatttggatgaaattcagagaagggagctccgaggtgtgtgatcatcggctcatgagcgccgctatcaaggaccagaaagccgtccacgccgatatgggatattggattgaatcttccaagaatcaaacatggcagatcgagaaggctagcctgattgaagtgaaaacctgcctgtggcccaagacacataccctctggtctaacggcgttctggagtcccagatgcttatccctagaagctacgcgggccccttttctcagcacaactatcgccaagggtacgccacgcagacagctggaccttggcacctgggcaaactcgagatcgacttcggggaatgccccggaaccaccgtgacaattcaggaggattgtgaccatcggggcccgagcctgagaaccacgacagcctccgggaagctggtcacccagtggtgctgtcgcagctgcacaatgcctccccttagatttctcggagaagatggctgttggtatggcatggagatccggcccctgtctgagaaagaagagaatatggtgaagtcccaagtgaccgccgggcagggaacaagcgaaaccttctccatgggcctgctctgcctgacgctttttgtcgaggaatgtctgcgcagacgggttacccgcaagcacatgattctcgtggtggtcatcacattctgcgctattatcctcgggggactgacctggatggaccttctcagagccctgatcatgctgggcgacacaatgtctgggcggattggaggccagatccatctcgcgattatggctgtgtttaaaatgagccctggctacgttctgggggtgttccttcgcaagctgacctccagagagacggccctcatggtcatcggaatggccatgacaaccgtgttttctattccgcacgatctgatggagctgatcgacggcatcagccttgggctgattatcctcaaaattgttacacatttcgataacacccaggtgggaaccctggctctctccctgacattcatccggtctacgacaccccttgtcatggcctggcgcacaattatggcggtgtttttcgtcgtgaccctgatccctctctgtagaacaagctgcctgcaaaagcagtcccactgggttgaaattaccgctctgatccttggcgcccaggccctgcccgtgtatctcatgacgctgatgaaaggggctagccggagatcttggcctctcaatgagggaatcatggccgtcggcctggtgtcccttctgggcagcgctctcctgaagaacgacgttcccctggccgggcctatggtggcgggaggccttctgctcgccgcttacgtcatgtctgggtccagcgccgatctgtctctcgaaaaggctgccaatgtgcaatgggacgagatggccgatattacaggatccagccccatcattgaagtgaaacaggacgaggatggctcctttagcatccgcgacgttgaggaaaccaacatgattaccctgcttgtcaagctggctctgatcacagtgtctgggctctacccgctggcgatccctgtgaccatggccctttggtatgtctggcaagtgaaaacacagcggagcggagctctgtgggatgttccctcccctgccgccacgcaaaaggctaccctctctgagggcgtgtacagaattatgcagcgcggcctgttcgggaaaacacaggtcggagtgggcatccacatggaaggggtttttcataccatgtggcacgtgacacggggaagcgtcatttgtcatgagaccggcagactcgaaccctcctgggccgacgtgcgcaatgatatgatctcttatgggggaggctggcggctgggcgacaagtgggacaaggaggaggatgttcaggtgcttgcgattgaaccggggaaaaaccctaagcacgtccaaacgaaacccggactgttcaagaccctgacaggcgagatcggggctgtgaccctcgactttaaacctggaacaagcggctcccccatcattaataagaaagggaaggtgatcggcctgtacggaaacggcgtcgttaccaagtctggggattatgtgagcgccattacacaggccgaaagaatcggagagcccgactacgaggtggatgaagacattttccgcaaaaagcggcttacgatcatggatctgcatcctggcgctgggaaaaccaagcggattctgccgtccatcgtccgggaggccctgaaacgcagactccggacactgatccttgcgcccacccgcgtggttgctgccgaaatggaggaagccctgagaggactgcctattcggtatcagacccccgctgtcaagagcgagcacacaggcagagagatcgtcgacctcatgtgccacgccacgtttaccacacgcctgctttcttccacccgggtgcctaattacaacctgattgttatggatgaagctcatttcacagacccctgcagcgtggccgcgagagggtacatctctacccgcgtcgagatgggcgaagccgctgccatttttatgacggctacacctccgggatccatcgatcccttccctcagagcaattcccccatcgaggacattgaacgggagatccctgagagatcttggaacaccggcttcgactggattaccgattatcaagggaagacagtgtggtttgtccccagcatcaaagccggaaatgacattgccaactgtctccgcaagtccggcaaacgggtgatccagctgagcagaaagaccttcgatacagaatacccgaaaaccaagctcacggactgggattttgttgtgacaaccgacatctctgagatgggggctaacttccgcgcgggaagagtgattgatcctcggcgctgcctgaagcccgtcatccttacagacggccccgaaagagttattctggccgggcctatccccgtgacccctgcttccgccgcccagcggcgcggcagaattggacggaatccggctcaagaggatgaccagtatgtgtttagcggcgatcccctgaaaaacgacgaagatcacgcccattggacggaggcgaagatgctcctggacaatatctacacccctgaggggattatccccacacttttcggacctgaaagagagaaaacccaggctatcgacggcgaatttcgcctgagaggggaacagagaaagacattcgtcgagctcatgcgccggggagatctgcccgtgtggctgtcttataaagttgccagcgccggcatttcctacaaggacagagaatggtgttttaccggcgagcggaacaatcaaatcctcgaagagaacatggaagtggagatttggacacgcgagggggaaaagaagaaacttagaccgaaatggctggatgctcgggtctatgccgaccctatggcgctgaaagatttcaaagagtttgcctctggacgcaagagcatcaccctcgacattctgacggaaatcgctacacttcccacctacctgtcctctaaggccaaactcgctctggataatatcgtgatgctgcacaccacagagaagggcgggagagcctaccagcacgctctcaacgaacttcctgagagcctggagaccctgatgctcgtcgccctgcttggagcgatgacagccggcattttcctgtttttcatgcaggggaaaggaatcggcaagctctccatgggcctgattgctatcgccgtggctagcgggctgctctgggttgccgaaattcagccccaatggatcgccgcttctatcattcttgagttctttctgatggtgctgctcatccctgaacccgagaaacagcggacgccgcaggacaatcagctgatttatgtcatccttaccattctgacaatcattggactcatcgcggccaacgaaatgggcctgatcgagaagaccaaaacagatttcgggttttaccaagtgaagaccgagacgaccattctggacgttgatctccgccctgcttccgcctggacactttatgccgtggctaccacaatcctgacccccatgctgagacatacgattgaaaatacaagcgccaacctctccctggcggccatcgctaatcaggccgctgtccttatgggactgggcaaggggtggcccctccaccggatggacctgggagtgcctctgctcgccatgggctgctactctcaggtgaacccgaccacacttaccgcgagcctggttatgctgctcgtccattatgccattatcggccccgggctgcaggctaaagccacccgcgaggctcaaaagagaacagccgctggaatcatgaaaaatcctacggtggatggcattaccgtgatcgaccttgaacccatttcctacgaccctaagttcgagaaacagctggggcaggtcatgctcctggttctgtgtgtgggacaactccttctgatgcggacaacctgggccctgtgcgaggtgctcacactggcgaccggccccgtcatgacgctttgggaagggaaccctggaagattttggaacacaaccatcgccgtgtctaccgctaatattttccgcggcagctatctggccggcgctgggctcgccttttccctgatcaagaacgcccagacaccgcggagaggaaccggcacaacgggggagaccctgggagaaaagtggaaacgccagctcaatagccttgatcggaaggagttcgaagagtacaaaagatctggcatcctggaggttgaccgcacagaagcgaagtccgctctgcgggatgggagcaaaattaagtacgccgtgtctagaggatccagcaagatccgctggattgtcgagcggggcatgatcaaacccaagggcaaagtggttgacctcgggtgtggaagaggcgggtggtcttattacatggctaccctgaagaacgtgacagaagtcaaaggatataccaagggcgggcctggacacgaggaacccattcctatggccacgtacggctggaatcttgtgaagctgcatagcggcgtggatgtcttttataaacccaccgagcaggttgacacactcctgtgcgatatcggggagtcctctagcaacccgaccattgaagagggacgcacactgcgggtgctcaagatggtggaaccttggctttccagcaaacccgagttctgtatcaaggtcctgaatccctacatgcctaccgtgatcgaggaactggagaaactccaaagacgccacggcgggtccctggttagatgccccctttctcggaacagcacacacgaaatgtattgggtgtccggagcctctggcaatattgtcagctccgtgaacaccatctctaagatgctgctcaatcgctttacgacaagacatcggaaacctacctacgagaaggacgttgatctgggggctggaaccagaagcgtgtccacagaaacggagaagccggacatgaccattatcggccggcgcctgcagagactccgggaggaacacaaagagacatggcattacgatcaggaaaacccctatcgcacctgggcctaccacggcagctatgaggcgccttctacagggtccgccagctctatggtcaatggagtggttaaacttctgaccaaaccctgggacgtgattcctatggtcacacagctggctatgaccgacacgacccccttcggccaacagagagtgtttaaggaaaaagtcgatacacggaccccgcagcctaagcccgggacacgcatgatcatgaccacgacagccaactggctctgggctctgcttggaaagaaaaagtcccctagactgtgtacccgggaggagttcatcagcaaagtgcgctctaatgccgcgattggcgccgttttccaggaggaacaggggtggacatccgctagcgaagccgtgaacgactccagattttgggagctcgtcgataaggaacgggctctgcaccaggagggcaaatgcgagagctgcgtgtacaatatgatgggaaagcgcgaaaagaaactgggcgagttcgggagagccaagggatctcgggctatctggtatatgtggctcggcgcccgctttctggagttcgaggcgcttgggtttctgaacgaagaccattggttcagcagagagaactcctggtctggagtggagggcgaagggctccaccggctgggctacattcttgaggatatcgacaaaaaggatggagacctgatttatgccgatgacaccgctggctgggatacgagaatcaccgaagacgatctcctgaatgaggagctgatcacagaacagatggcgccccatcacaaaaccctcgctaaggccatttttaagctgacataccaaaacaaagttgtgaaggtccttcgccctacccccaaaggggccgtgatggacatcattagccggaaggaccagagaggatccggccaggttgggacatacggactgaataccttcacgaacatggaggtgcagctcatccgccaaatggaagcggagggcgtcattacacaggatgacatgcagaatccgaaagggctgaaggaacgggtggagaaatggcttaaggagtgtggcgtcgatagactgaagcgcatggctatctctggagacgattgcgtggttaaacctctcgacgaacggtttagcacctccctgctgttcctcaacgatatgggcaaggtgagaaaagacatcccccagtgggagccctctaaggggtggaaaaattggcaagaagtccctttttgtagccatcacttccacaagatttttatgaaggatggacgctccctggtggttccgtgccggaaccccgacgagcttatcggcagagcccgcattagccagggggccggatggtctctgcgggaaaccgcttgtctcggcaaagcctatgctcagatgtggtccctgatgtacttccatagacgggatcttagactggccagcatggcgatctgctctgccgtgcctacagagtggttccccacctcccgcacaacgtggagcattcacgctcatcaccagtggatgaccacagaggacatgctcaaggtctggaatcgggtgtggatcgaagacaaccctaatatgaccgataaaacacccgtgcactcctgggaggacattccttatctggggaagagagaagatctgtggtgtggctctctcatcggactgagctcccgcgccacctgggctaaaaacatccatacggccattacccaagttagaaatcttatcggcaaggaggaatacgtcgactatatgcccgcgatgaagcggtacagcgccccgtttgagtctgagggggtgctgtga

SEQ ID NO: 21026 - RNA, 9867 nt, synthetic construct
  misc_feature 1..9867: note = derived and/or modified CDS sequence (opt5) from DENV-4__KC762697__SS-prME
  source 1..9867: mol_type = other RNA
agcaccatgaccctgctgtgcctgatccccacggccatggctttccatctttccacccgggacggcgagcctctgatgattgtggccaagcatgaacgggggcgcccgctcctgtttaagacaaccgagggaatcaacaagtgtacacttattgcgatggatctgggcgaaatgtgcgaggacaccgtgacatacaagtgtcccctcctggttaataccgaacctgaggatatcgactgctggtgtaacctgacgtctacctgggtgatgtatgggacatgcacccagagcggagagagacggcgcgaaaagagatccgtggctctcacaccccactctggcatggggctggagacccgggccgaaacgtggatgagctccgagggagcctggaaacatgctcaacgcgtcgagtcttggattcttagaaatcctggcttcgccctgctcgctggctttatggcctacatgatcgggcagacaggaatccagcggaccgtgttctttgttctgatgatgcttgtggcgcccagctatggcatgcgctgtgtcggggtgggaaacagagatttcgttgaaggcgtgtccgggggagcctgggtcgacctggtgctcgagcacggcggctgcgtgacaaccatggctcaggggaagcctaccctggattttgaactgacaaagacgaccgccaaagaggtcgctctcctgcggacatactgtattgaagccagcatctctaatattaccacagcgacccgctgcccgacgcaaggagagccctatcttaaggaggaacaggaccagcagtacatctgtagacgggatgttgtggaccgcggctgggggaacggatgcggcctgttcgggaaaggaggcgtggtcacatgcgccaagtttctctgttccggcaaaattaccgggaatctggtgcaaatcgagaaccttgaatataccgttgtggtcacagtgcataatggagatacccacgctgttggcaacgacacaagcaatcacggggtgacggccaccattacacctagatctccctccgtcgaggtgaagctgcctgattacggagaactcaccctggactgcgagccccggagcggcatcgacttcaacgagatgatcctgatgaagatgaaaaagaaaacatggctcgtccataagcagtggtttctggatcttccgctgccttggaccgctggggccgacacgtctgaagtgcactggaattacaaagagagaatggttaccttcaaggtgccccatgccaaacgccaggatgtcacagtgctcggctcccaggaaggagctatgcacagcgcgctggccggcgctaccgaggttgactccggggatggaaaccacatgtttgccggccatcttaagtgtaaggtgcggatggaaaaactgagaattaaggggatgtcttatacaatgtgcagcggaaaattctccatcgacaaggagatggccgagacccaacacggcacgacagtcgtgaaagtgaagtacgaaggggctggcgccccttgtaaggttcccattgagatccgcgatgtcaataaagaaaaggtggtgggacggattatcagctctacccccttcgcggagaacacaaactccgtcaccaatatcgagctcgaacctccgtttggcgacagctatattgtgatcggggttggagattctgctctgaccctgcattggttcagaaaaggcagctccattgggaagatgtttgagtctacataccgcggagccaaacggatggccatcctcggcgaaacggcttgggacttcgggagcgtgggcggactgtttacctcccttggcaaggccgtccaccaggtgttcgggagcgtttatacaaccatgtttggaggcgtgtcttggatgattagaatcctgatcgggctcctggtcctgtggattggaacaaactcccgcaataccagcatggctatgacgtgcatcgccgtgggcgggattacacttttcctcggctttaccgttcaggcggatatgggatgtgtggtctcttggaacggcaaggagctgaaatgcgggtccggaatcttcgtggtggacaatgtccatacctggacagaacaatacaagtttcagcccgagagccctgcccggctggcttccgccattctcaacgctcacaaagacggcgtttgtgggatcagatctaccacacgcctggagaatgtgatgtggaagcagattacgaacgaacttaattatgtgctgtgggagggaggccacgatctcaccgtcgtggccggcgacgttaaaggggtgctgacaaagggaaagcgggtcctgacaccccctgtgaacgatcttaaatacagctggaagacatggggcaaagcgaagatcttcacccccgaagccagaaattccacgtttctcatcgacgggccggatacctctgagtgccctaacgaacggcgcgcttggaatttcttcgaggttgaggactacggatttggcatgttcagcacaaacatttggatgaaatttagagaagggtccagcgaggtgtgtgatcatcggctgatgtctgccgctatcaaggaccagaaagccgtccacgccgatatgggatattggattgaatccagcaagaatcaaacctggcagatcgagaaggcttctctgattgaagtgaaaacatgcctctggcccaagacccatacactgtggtccaacggcgttcttgagagccagatgctgatccctagatcttacgcgggccccttcagccagcacaactatcgccaagggtacgccacccagatcgctggaccttggcacctcggcaaactggagattgactttggggaatgccccggaacgacagtgaccatccaggaggattgtgaccatcggggcccgtccctgagaaccacaaccgccagcgggaaacttgtcacgcagtggtgctgtcgctcttgcacaatgcctcccctcagattcctgggagaagatggctgttggtatggcatggagattcggcccctgtccgagaaagaagagaatatggtcaagagccaagtgaccgccgggcagggaacatccgaaaccttttctatgggcctcctgtgccttacactgttcgtcgaggaatgtctccgcagacgggttacccgcaagcacatgatcctggtggtggctattacgttttgcgccatcatcctcgggggacttacctggatggacctcctgagagcgctgattatgctcggcgacacaatgagcgggcggatcggaggccagattcatctggctatcatggccgtcttcaaaatgtcccctggctacgtgcttggggtttttctgcgcaagctcacctctagagagacagccctgatggtgattggaatggctatgaccacggtcttcagcatcccgcacgatctgatggagcttatcgacggcatttccctggggctcatcctgctcaaaattgtgacacattttgatgacacccaggttggaacactggccctttctctgaccttcatccggagcaccacacccctcgtgatggcgtggcgcacgattatggctgtcttctttatggtgaccctgatccctctgtgtagaacatcctgccttcaaaagcagagccactgggtcgaaattaccgccctgatcctcggcgcccaggctctgcccgtgtatctcatgacactgatgaaaggggcctctcggagatcctggcctcttaacgagggaatcatggctgttggcctggtgagcctcctgggctctgccctgcttaagaatgatgtccccctggcggggcctatggtggccggaggcctcctgctcgctgcctacgttatgtccgggagctctgctgacctgtcccttgaaaaggccgccaacgtgcaatgggatgagatggctgacattaccggaagctcccccatcattgaagtcaaacaggatgaggacggcagcttctctatccgcgatgtggaggaaacgaatatgattacactgctggtgaagctcgcgctgatcaccgttagcgggctttacccgctggccatccctgtcaccatggctctctggtatatttggcaagtgaaaacacagcggtccggagccctgtgggacgtgccctctcctgccgctacccaaaaggccacactcagcgagggcgtctacagaatcatgcagcgcggcctgtttgggaaaacacaggtgggagttggcattcacatggaaggggtgttccataccatgtggcacgtcacacggggatccgtgatctgtcatgagaccggcagacttgaaccctcttgggcggatgttcgcaacgacatgattagctatgggggaggctggcggctgggcgacaagtgggataaggaggaggacgtgcaggtcctggctatcgaaccggggaaaaatcctaagcacgtgcaaacaaaacccggactctttaagaccctgacgggcgagatcggggccgttacccttgatttcaaacctggaacatccggctctcccattatcaacaagaaagggaaggtgattggcctgtacggaaatggcgtcgtgaccaagagcggggactatgtgtccgccatcacacaggctgaaagaattggagagcccgattacgaggtcgacgaagatatctttcgcaaaaagcggctcaccattatggacctgcatcctggcgccgggaaaacaaagagaatcctcccgagcatcgttcgggaggcgctgaaacgcagacttcggacgctgattctggctcccacccgcgtggtggccgccgaaatggaggaagctctcagaggactgcctatccggtatcagacacccgccgtcaaggctgagcacaccggcagagagattgtggatcttatgtgccacgccaccttcacaacgcgcctgctctcttccacccgggttcctaactacaatctgatcgtgatggacgaagcgcattttacagatccctgcagcgtcgccgctagagggtacatttctacccgcgtggagatgggcgaagccgctgccatcttcatgacagccacccctccgggatccacggacccctttcctcagagcaactcccccatcgaggacattgaacgggagatccctgagagatcttggaatacaggcttcgattggattaccgactatcaagggaagaccgtttggttcgtgcccagcatcaaagctggaaacgatattgcgaattgtctccgcaagtccggcaaacgggtcatccagctgagcagaaagacatttgacaccgaatacccgaaaacaaaacttaccgattgggacttcgtggtcacgacagatatctctgagatgggggccaactttcgcgctggaagagtgattgaccctcggcgctgcctgaagcccgttatcctgaccgatggccccgaaagagtgattctcgccgggcctatccccgtgacgcctgcctccgctgcccagcggcgcggcagaattggacggaacccggcgcaagaggacgatcagtatgtcttcagcggcgaccccctgaaaaatgatgaagaccacgctcattggaccgaggccaagatgcttctggacaacatctacacgcctgaggggattatccccaccctctttggacctgaaagagagaaaacacaggccatcgatggcgagttccgcctgagaggggaacagagaaagacctttgttgagctgatgcgccggggagacctccccgtgtggctttcttataaagtggctagcgccggcatttcctacaaggatagagaatggtgtttcacaggcgagcggaataaccaaatcctggaagagaatatggaagtcgagatttggacccgcgagggggaaaagaaaaagctgagaccgaaatggctcgacgcgcgggtgtatgccgatcctatggctctgaaggactttaaagagttcgcctctggacgcaagagcatcacacttgatattctgaccgaaatcgctacgctccccacatacctgtcctctaaggccaaactggctctcgacaacatcgttatgcttcacaccaccgagaagggcgggagagcctaccagcacgcgctgaatgaactgcctgagagcctcgagacactgatgcttgtggccctgctcggagctatgaccgccggcatttttctgttctttatgcaggggaaaggaatcggcaagctgtccatgggcctcattgctatcgccgtcgccagcgggcttctgtgggtggctgaaattcagccccaatggatcgcggcctctatcattctggagttcttcctcatggtcctgcttatccctgaacccgagaaacagcggacaccgcaggataaccagctgatttatgtgatcctcacgattctgaccatcattggactgatcgctgccaatgaaatgggcctcatcgagaagacaaaaaccgactttgggttctaccaagccaagacagagaccacgattcttgatgttgacctgcgccctgcttccgcctggaccctgtatgcggtggccacaaccatcctcacacccatgctgagacataccattgaaaacacgagcgctaatctttccctggccgctatcgccaaccaggcggccgtcctcatgggactgggcaaggggtggcccctgcaccggatggatctcggagtgcctcttctggctatgggctgctactctcaggttaatccgacaaccctgacagccagcctcgtgatgctgcttgtccattatgctattatcggccccgggctgcaggccaaagctacccgcgaggcccaaaagagaaccgcggccggaatcatgaaaaaccctacagtggacggcattacggtgatcgacctcgaacccatttcctacgatcctaagtttgagaaacagctggggcaggttatgctgctcgtcctttgtgtgggacaactgctgctcatgcggaccacatgggctctgtgcgaggtgcttaccctggccacaggccccatcatgaccctctgggaagggaatcctggaagattctggaacacgacaattgctgtctctaccgccaacatctttcgcggcagctatctggccggcgcggggctggctttctccctcatcaagaatgcccagaccccgcggagaggaacaggcaccacaggggagacgcttggagaaaagtggaaacgccagctgaacagcctggaccggaaggagtttgaagagtacaaaagatctggcattctcgaggttgatcgcaccgaagctaagtccgccctgcgggacgggagcaaaatcaagtacgccgtgtctagaggatccagcaagattcgctggatcgtggagcggggcatggtcaaacccaagggcaaagtggttgatcttgggtgtggaagaggcgggtggtcttattacatggctacactgaagaatgtgaccgaagtcaaaggatatacaaagggcgggcctggacacgaggaacccattcctatggccacctacggctggaacctcgtgaagctgcatagcggcgttgacgtgttctataaacccacggagcaggtcgataccctgctctgcgacatcggggagtcctctagcaatccgacaattgaagagggacgcacccttcgggtgctgaagatggtggaaccttggctgtccagcaaacccgagttttgtatcaaggtcctcaacccctacatgcctacagttatcgaggaactggagaaacttcaaagacgccacggcgggtccctggtgagatgccccctctctcggaatagcacccacgaaatgtattgggtgtccggagcgtctggcaacattgtcagctccgtgaatacaatctctaagatgctgctgaaccgcttcaccacgagacatcggaaacctacatacgagaaggatgttgacctcggggccggaaccagaagcgtgtccaccgaaacagagaagccggatatgacgattatcggccggcgccttcagagactgcgggaggaacacaaagagacctggcattacgaccaggaaaatccctatcgcacatgggcttaccacggcagctatgaggccccttctaccgggtccgctagctctatggtcaacggagtggttaagctgctcacaaaaccctgggacgtgattcctatggtcacccagctggccatgacagataccacgccctttggccaacagagagtgttcaaggaaaaagttgacacccggacaccgcagcctaagcccgggacccgcatgatcatgacaaccacggcgaattggctttgggccctgctcggaaagaaaaagtcccctagactgtgtacacgggaggagtttatcagcaaagtgcgctctaacgctgccattggcgctgtcttccaggaggaacaggggtggacctccgccagcgaagctgtgaatgattccagattctgggagctggtcgacaaggaacgggccctccaccaggagggcaaatgcgagagctgcgtgtacaacatgatgggaaagcgcgaaaagaaactgggcgagtttgggagagcgaagggatctcgggccatctggtatatgtggcttggcgctcgcttcctggaatttgaggccctcgggttcctgaatgaagatcattggtttagcagagagaactcctggtctggagttgagggcgaagggcttcaccggctgggctacattctcgaggacatcgataaaaaggacggagatctgatttatgctgacgatacagccggctgggacaccagaatcacggaagatgacctgctcaacgaggagctgatcaccgaacagatggcgccccaccacaaaacacttgccaaggctattttcaagctgacctaccaaaataaagtggtcaaggtgctccgccctacacccaaaggggccgtgatggacatcattagccggaaggatcagagaggatccggccaggttgggacctacggactgaacacatttaccaatatggaggtgcagcttatccgccaaatggaagccgagggcgtcattacgcaggacgatatgcagaacccgaaagggctggaggaacgggtggagaagtggctcaaagaatgtggcgttgacagactgaagcgcatggctatctctggagatgactgcgtggtcaagcctctggatgagcggttcagcacatccctcctgtttcttaatgacatgggcaaagtgagaaaggatatcccccagtgggaaccctctaaagggtggaagaactggcaagaggtccctttctgtagccatcactttcacaaaattttcatgaaggacggacgctccctggtggttccgtgccggaatcaggatgaactcatcggcagagcccgcattagccagggggctggatggtctctgcgggagaccgcctgtcttggcaaggcgtatgcccagatgtggtccctgatgtactttcatagacgggacctcagactggctagcatggccatctgctctgctgtgcccaccgagtggttccctacatcccgcaccacatggagcattcacgcccatcaccaatggatgacgaccgaagacatgctgaaagtctggaaccgggtgtggatcgaggataatcccaacatgacagacaagacccctattcactcctgggaagatatcccctatctcgggaaaagagaggacctgtggtgtggctctcttatcggactgagctcccgcgcgacatgggccaagaatattcataccgctatcacgcaggttagaaacctcattggcaaagaagagtacgtggattatatgcctgtcatgaagcggtacagcgccccctctgagtccgaaggggtgctgtga

SEQ ID NO: 21027 - RNA, 9867 nt, synthetic construct
  misc_feature 1..9867: note = derived and/or modified CDS sequence (opt5) from DENV-4__KC762698__SS-prME
  source 1..9867: mol_type = other RNA
agcaccatgacactgctctgcctgatccccacggtgatggccttccacctttccaccagagacggcgagcctctgatgattgtcgctaagcatgaacgggggcgcccgctcctgtttaaaacaaccgagggaatcaacaagtgtacacttattgccatggatctgggcgaaatgtgcgaggacaccgttacatacaaatgtcccctcctggtgaataccgaacctgaggatatcgtgtgctggtgtaacctgacgtctacctgggtcatgtatgggacatgcacccagagcggagagagacggcgcgaaaagagatccgtggcgctcacaccccactctggcatggggctggagacccgggctgaaacgtggatgagctccgagggagcctggaaacatgcccaacgcgttgagtcttggattcttagaaatcctggcttcgctctgctcgccggctttatggcttacatgatcgggcagacaggaatccagcggaccgtgttctttgtcctgatgatgcttgtggcccccagctatggcatgcgctgtgttggggtgggaaacagagacttcgtcgaaggcgtgtccgggggagcgtgggtggatctggtcctcgagcacggcggctgcgttacaaccatggcccaggggaagcctaccctggactttgaactgacaaagacgaccgctaaagaggtggccctcctgcggacatactgtattgaagctagcatctctaatattaccacagccacccgctgcccgacgcaaggagagccctatcttaaggaggaacaggatcagcagtacatctgtagacgggacgtggtcgatcgcggctgggggaacggatgcggcctgttcgggaaaggaggcgtggttacatgcgcgaagtttctctgttccggcaaaattaccgggaatctggtgcaaatcgagaaccttgaatataccgtcgtggttacagtgcataatggagacacccacgccgtcggcaacgatacaagcaatcacggggtgacggctaccattacacctagatctccctccgtcgaggtgaagctgcctgactacggagaactcaccctggattgcgagccccggagcggcatcgacttcaacgagatgatcctgatgaagatgaaaaagaaaacatggctcgttcataagcagtggtttctggaccttccgctgccttggaccgccggggctgatacgtctgaagtgcactggaattacaaagagagaatggtcaccttcaaggtgccccatgccaaacgccaggacgttacagtgctcggctcccaggaaggagccatgcacagcgctctggcgggcgccaccgaggtcgattccggggacggaaaccacatgtttgctggccatcttaagtgtaaggtgcggatggaaaaactgagaattaaggggatgtcttatacaatgtgcagcggaaaattctccatcgataaggagatggccgagacccaacacggcacgacagtggttaaagtcaagtacgaaggggccggcgctccttgtaaggtgcccattgagatccgcgacgtgaataaagaaaaggtcgtgggacggattatcagctctacccccttcgccgagaacacaaactccgttaccaatatcgagctcgaacctccgtttggcgatagctatattgtgatcggggcgggagactctgctctgaccctgcattggttcagaaaaggcagctccattgggaagatgtttgagtctacataccgcggagccaaacggatggccatcctcggcgaaacggcttgggatttcgggagcgtcggcggactgtttacctcccttggcaaggccgtgcaccaggttttcgggagcgtgtatacaaccatgtttggaggcgtctcttggatgattagaatcctgatcgggttcctcgtgctgtggattggaacaaactcccgcaataccagcatggctatgacgtgcatcgccgttggcgggattacactgtttcttggcttcaccgtgcaggcggacatgggatgtgtcgtgtcttggaacggcaaggagctcaaatgcgggtccggaatctttgtggtcgataatgttcatacctggacagaacaatacaagttccagcccgagagccctgcccggctggcttccgccattctgaacgctcacaaagacggcgtgtgtgggatcagatctaccacacgcctcgagaatgtgatgtggaagcagattacgaacgaactgaattatgtcctttgggagggaggccacgacctgaccgtggttgccggcgatgtgaaaggggtcctcacaaagggaaagcgggcgctgaccccccctgtgaacgacctgaaatacagctggaagacatggggcaaagccaagatctttacccccgaagctagaaattccacgttccttatcgatgggccggacacctctgagtgccctaacgaacggcgcgcctggaatttctttgaggttgaggattacggattcggcatgtttacaaccaacatttggatgaaattcagagaagggagctccgaggtgtgtgaccatcggctcatgagcgctgccatcaaggatcagaaagccgtccacgctgacatgggatattggattgaatcttccaagaatcaaacatggcagatcgagaaggcgagcctgattgaagtgaaaacctgcctgtggcccaagacacataccctctggtctaacggcgttctggagtcccagatgcttatccctagaagctacgccggccccttttctcagcacaactatcgccaagggtacgctacgcagacagccggaccttggcacctgggcaaactcgagatcgatttcggggaatgccccggaaccaccgtgacaattcaggaggactgtgatcatcggggcccgagcctgagaaccacgacagcctccgggaagctggtcacccagtggtgctgtcgcagctgcacaatgcctccccttagatttctcggagaagacggctgttggtatggcatggagatccggcccctgtctgagaaagaagagaatatggtgaagtcccaagtgaccgctgggcagggaacaagcgaaaccttctccatgggcctgctctgcctgacgctttttgtcgaggaatgtctgcgcagacgggttacccgcaagcacatgattctcgtggtggtcatcacattctgcgccattatcctggggggactgacctggatggatcttctcagagcgctgatcatgctgggcgacacaatgtctgggcggattggaggccagatccatctcgctattatggccgtgtttaaaatgagccctggctacgttctgggggtgttccttcgcaagctgacctccagagagacggccctcatggtcatcggaatggctatgacaaccgtgttttctattccgcacgacctgatggagctgatcgatggcatcagccttgggctgattctcctgaaaatcgttacacatttcgacaacacccaggtgggaaccctcgccctgtcccttacattcattcggtctacgacccccctggtcatggcgtggcgcacaatcatggctgtgtttttcgtcgtgaccctcattcctctgtgtagaacaagctgcctgcaaaagcagtcccactgggttgaaatcaccgcccttattctgggcgcccaggctctccccgtgtatctgatgacgctcatgaaaggggccagccggagatcttggcctctgaatgagggaatcatggctgtcggccttgtgtccctgctcggcagcgccctgctgaagaacgatgttccccttgcggggcctatggtggccggaggcctgctcctggctgcctacgtcatgtctgggtccagcgctgacctctctctggaaaaggccgccaatgtgcaatgggatgagatggctgacatcacaggatccagccccattatcgaagtgaaacaggatgaggacggctcctttagcattcgcgatgttgaggaaaccaacatgatcacccttctggtcaagctggcgctcattacagtgtctgggctgtacccgcttgccatccctgtgaccatggctctgtggtatgtctggcaggtgaaaacacagcggagcggagccctctgggacgttccctcccctgccgctacgcaaaaggccaccctgtctgagggcgtgtacagaatcatgcagcgcggcctcttcgggaaaacacaggtcggagtgggcattcacatggaaggggtttttcataccatgtggcacgtgacacggggaagcgtcatctgtcatgagaccggcagactggaaccctcctgggcggatgtgcgcaatgacatgatttcttatgggggaggctggcggcttggcgataagtgggacaaggaggaggacgttcaggtgctggctatcgaaccggggaaaaaccctaagcacgtccaaacgaaacccggactgttcaagaccctcacaggcgagattggggccgtgaccctggattttaaacctggaacaagcggctcccccatcatcaataagaaagggaaggtgattggcctttacggaaacggcgtcgttaccaagtctggggactatgtgagcgccatcacacaggctgaaagaattggagagcccgattacgaggtggacgaagatatcttccgcaaaaagcggctgacgattatggacctccatcctggcgccgggaaaaccaagagaatcctgccgtccattgtccgggaggcgctcaaacgcagactgcggacacttatcctggctcccacccgcgtggttgccgccgaaatggaggaagctctgagaggactccctatccggtatcagacccccgccgtgaagagcgagcacacaggcagagagattgtcgatctgatgtgccacgctacgtttaccacacgccttctgtcttccacccgggtgcctaattacaacctcatcgttatggacgaagcccatttcacagatccctgcagcgtggcggccagagggtacatttctacccgcgtcgagatgggcgaagctgccgctatctttatgacggccacacctccgggatccattgaccccttccctcagagcaattcccccatcgaggatatcgaacgggagattcctgagagatcttggaacaccggcttcgactggatcaccgactatcaagggaagacagtgtggtttgtccccagcattaaagccggaaatgatatcgctaactgtctgcgcaagtccggcaaaaaggtgattcagctcagccggaaaaccttcgacacagaatacccgaagaccaagctgacggattgggactttgttgtgacaaccgatatctctgagatgggggcgaacttcagagccggacgcgtgatcgaccctagacggtgccttaaacccgtcattctgacagatggccccgaacgcgttatcctggctgggcctattcccgtgacccctgcctccgccgctcagagacggggccgcatcggaagaaatccggcccaagaggacgatcagtatgtgtttagcggcgaccccctcaagaacgatgaagaccacgcgcattggacggaggctaaaatgctgcttgataatatttacacccctgaggggatcattcccacactgttcggacctgaacgggagaagacccaggccatcgacggcgaatttagactccgcggggagcagcggaaaacattcgtcgagctgatgagacgcggagacctgcccgtgtggctctcttataaggttgccagcgctggcatctcctacaaggatcgggaatggtgttttaccggcgagagaaacaatcaaattcttgaagagaacatggaagtggagatctggacacgggagggggaaaaaaagaaactgcgcccgaagtggctggacgccagagtctatgcggatcctatggccctcaaagacttcaaggagtttgcttctggacggaagagcattaccctggatatccttacggaaattgccacactgcccacctacctctcctctaaagctaagctggccctggacaatatcgtgatgctccacaccacagagaaaggcgggcgcgcttaccagcacgcccttaacgaactgcctgagagcctggagaccctcatgctggtcgcgcttctgggagccatgacagctggcatcttcctctttttcatgcaggggaagggaattggcaaactgtccatgggcctgatcgccattgctgtggccagcgggctcctttgggttgccgaaatccagccccaatggattgctgcgtctatcatcctggagttctttctgatggtgctcctgattcctgaacccgagaagcagagaacgccgcaggataatcagcttatctatgtcattctgaccatcctcacaattatcggactgattgccgctaacgaaatgggcctgatcgagaaaaccaagacagacttcgggttttaccaagtgaagaccgagaatacgatcctcgatgttgaccttcggcctgcctccgcctggaccctgtatgctgtggccacaaccattctgacacccatgctccgccataccatcgaaaacacgagcgcgaatctgtcccttgccgctattgccaaccaggctgccgtcctgatgggactcggcaaagggtggcccctgcacagaatggatctgggagtgcctctccttgcgatgggctgctactctcaggtgaatccgacaaccctgacagccagcctggttatgctcctggtccattatgctatcattggccccgggcttcaggccaaggctacccgggaggcccaaaaacgcaccgctgccggaatcatgaagaaccctacagtggacggcatcacggtgattgatctggaacccatctcctacgaccctaaattcgagaagcagctcgggcaggtcatgctgctggttctctgtgtgggacaacttctgctgatgagaaccacatgggcgctctgcgaggtgctgacccttgccacaggccccgtcatgaccctgtgggaagggaaccctggacggttttggaatacgacaattgctgtgtctaccgccaacatcttcagaggcagctatctcgctggcgccgggctggccttttccctgattaagaatgcgcagaccccgcgccggggaacaggcaccacaggggagacgctcggagaaaaatggaagagacagcttaacagcctggaccgcaaagagttcgaagagtacaagcggtctggcatcctggaggttgatagaaccgaagctaaatccgccctccgcgacgggagcaagatcaagtacgctgtgtctcggggatccagcaaaattagatggatcgtcgagcgcggcatgattaagcccaaaggcaaggtggttgatctggggtgtggacggggcgggtggtcttattacatggccacacttaaaaatgtgaccgaagtcaagggatatacaaagggcgggcctggacacgaggaacccatccctatggccacctacggctggaacctggtgaaactccatagcggcgtggacgtcttttataagcccacggagcaggttgataccctgctgtgcgacattggggagtcctctagcaatccgacaatcgaagagggaagaaccctccgcgtgcttaaaatggtggaaccttggctgtccagcaagcccgagttctgtattaaagtcctgaacccctacatgcctacagtgatcgaagagctcgagaagctgcaacggagacacggcgggtcccttgttcgctgccccctgtctagaaatagcacccacgaaatgtattgggtgtccggagcttctggcaacatcgtcagctccgtgaatacaatttctaaaatgctcctgaaccggtttaccacgcgccatagaaagcctacatacgagaaggatgttgacctgggggccggaacccggagcgtgtccaccgaaatcgagaaaccggatatgacaattatcggcagacggctccagcgccttagagaggaacacaaggagacgtggcattacgaccacgaaaatccctatcggacctgggcgtaccacggcagctatgaggccccttctacagggtccgctagctctatggtcaacggaattgtgaaactgctgaccaagccctgggatgttatccctatggtgacacagctcgccatgaccgacacaacccccttcggccagcaacgcgtctttaaagaaaaggtggacacgagaaccccgcagcctaagcccgggacacggatgatcatgaccacaaccgctaattggctgtgggcccttctgggaaaaaagaaatcccctcgcctctgtacgagagaggagttcattagcaaggtccggtctaacgcggccatcggcgctgtgttccaggaagagcaggggtggacatccgccagcgaagctgttaatgattcccgcttttgggagctggtggacaaagaaagagccctgcatcaagagggcaagtgcgagagctgcgtctacaacatgatgggaaagcgggaaaaaaagctcggcgagttcgggcgcgctaaaggatctagagccatttggtatatgtggctgggcgcgcggtttcttgaattcgaggccctggggtttctcaacgaagatcactggttcagccgcgagaattcctggtctggagtggagggcgaagggctgcatagacttggctacatcctggaggacattgataagaaagacggagatctcatctatgctgacgataccgccggctgggacacacggatcaccgaagatgacctgctgaacgaggagctcattacggaacagatggctccccaccataagaccctggccaaggccatctttaaacttacataccagaataaggtggttaaagtgctgagacctacccccaagggggcggtcatggatattatcagccgcaaagaccaacggggatccggccaggtggggacatacggactcaacaccttcacaaatatggaggttcagctgattagacagatggaagctgagggcgtgatcacccaagacgatatgcagaacccgaaggggcttaaagaacgcgtcgagaagtggctgaaggagtgtggcgtggaccggctcgaaagaatggccatctctggagatgactgcgtcgtgaaacctctggatgagcgctttagcacgtccctgctcttcctgaatgacatgggcaaggttcggaaagatattccccagtgggaaccctctaaggggtggaaaaactggcaggaggtgcctttttgtagccaccacttccataagatctttatgaaggacggaagatcccttgtcgtgccgtgccgcaatcaagatgaactgattggccgggccagaatcagccagggggctggatggtctctccgcgagacagcctgtctgggcaaagcttatgcccagatgtggcttctgatgtacttccaccggagagacctccggctggcgtccatggccatttgcagcgctgttcccaccgagtggttccctacctctagaacaacctggtccatccatgcccaccaccagtggatgacaacggaagatatgctgaaggtgtggaaccgcgtctggattgaggacaatcccaacatgaccgacaaaacacctgtgcatagctgggaagatatcccctatctcgggaagcgggaggacctgtggtgtggctcccttatcggactgtctagcagagctacctgggccaaaaatattcacacagcgatcacccaagtgcgcaacctcattggcaaggaagagtacgttgattatatgcctgccatgaagagatactccgctccctttgagagcgaaggggtcctgtga

SEQ ID NO: 21028 - RNA, 9867 nt, synthetic construct
  misc_feature 1..9867: note = derived and/or modified CDS sequence (opt5) from DENV-4__KC762699__SS-prME
  source 1..9867: mol_type = other RNA
agcaccatgaccctgctctgcctgatccccacggtgatggctttccacctttccaccagagacggcgaacctctgatgattgtggctaagcatgaacgggggcgcccgctcctgtttaaaaccaccgaaggaatcaacaagtgtacacttattgccatggatctgggcgaaatgtgcgaagacaccgttacatacaaatgtcccctcctggtgaataccgaacctgaggatatcgactgctggtgtaacctgacgtctacctgggtgatgtatgggacatgcacccagagcggagagagacggcgcgaaaagagatccgtcgccctcacaccccactctggcatggggctggagacccgggctgaaacgtggatgagctccgagggagcctggaaacatgcccagcgcgtggagtcttggattcttagaaatcctggcttcgctctgctcgccggctttatggcttacatgatcgggcagacaggaatccagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtattgaagctagcatctctaatattaccacagccacccgctgcccgacgcaaggagagccctatcttaaggaggaacaggaccagcagtacatctgtagacgggatgtggtggaccgcggctgggggaacggatgcggcctgttcgggaaaggaggcgtcgtgacatgcgcgaagtttctctgttccggcaaaattaccgggaatctggttcaaatcgagaaccttgaatataccgtggtcgtgacagttcataatggagatacccacgccgtgggcaacgacacaagcaatcacggggtcacggctaccattacacctagatctccctccgtggaggtcaagctgcctgattacggagaactcaccctggactgcgagccccggagcggcatcgacttcaacgagatgatcctgatgaagatgaaaaagaaaacatggctcgtgcataagcagtggtttctggatcttccgctgccttggaccgccggggctgacacgtctgaagttcactggaattacaaagagagaatggtgaccttcaaggtcccccatgccaaacgccaggatgtgacagttctcggctcccaggaaggagccatgcacagcgctctggcgggcgccaccgaggtggactccggggatggaaaccacatgtttgctggccatcttaagtgtaaggtccggatggaaaaactgagaattaaggggatgtcttatacaatgtgcagcggaaaattctccatcgacaaggagatggccgagacccaacacggcacgacagtggtgaaagttaagtacgaaggggccggcgctccttgtaaggtccccattgagatccgcgatgtgaataaagaaaaggtggtcggacggattatcagctctacccccttcgccgagaacacaaactccgtgaccaatatcgagctcgaacctccgtttggcgacagctatattgttatcggggtgggagattctgcgctgaccctgcattggttcagaaaaggcagctccattgggaagatgtttgagtctacataccgcggagctaaacggatggccatcctcggcgaaacggcctgggacttcgggagcgtcggcggactgtttacctcccttggcaaggctgtgcaccaggttttcgggagcgtgtatacaaccatgtttggaggcgtctcttggatgattagaatcctgatcgggttcctcgtgctgtggattggaacaaactcccgcaataccagcatggccatgacgtgcatcgctgttggcgggattacactgtttcttggcttcaccgtgcaggccgatatgggatgtgtcgtgtcttggaacggcaaggagctcaaatgcgggtccggaatctttgtggtcgacaatgttcatacctggacagaacaatacaagttccagcccgagagccctgcgcggctggcctccgctattctgaacgcccacaaagacggcgtgtgtgggatcagatctaccacacgcctcgagaatgtgatgtggaagcagattacgaacgaactgaattatgtcctttgggagggaggccacgatctgaccgtggttgctggcgacgtgaaaggggtcctcacaaagggaaagcgggccctgacaccccctgtgaacgatctgaaatacagctggaagacatggggcaaagcgaagatctttacccccgaagccagaaattccacgttccttatcgacgggccggatacctctgagtgccctaacgaacggcgcgcttggaatttctttgaggttgaggactacggattcggcatgtttacaaccaacatttggatgaaattcagagaagggagctccgaggtgtgtgatcatcggctcatgagcgccgctatcaaggaccagaaagccgtccacgccgatatgggatattggattgaatcttccaagaatcaaacatggcagatcgagaaggctagcctgattgaagtgaaaacctgcctgtggcccaagacacataccctctggtctaacggcgttctggagtcccagatgcttatccctagaagctacgcgggccccttttctcagcacaactatcgccaagggtacgccacgcagacagctggaccttggcacctgggcaaactcgagatcgacttcggggaatgccccggaaccaccgtgacaattcaggaggattgtgaccatcggggcccgagcctgagaaccacgacagcctccgggaagctggtcacccagtggtgctgtcgcagctgcacaatgcctccccttagatttctcggagaagatggctgttggtatggcatggagatccggcccctgtctgagaaagaagagaatatggtgaagtcccaagtgaccgccgggcagggaacaagcgaaaccttctccatgggcctgctctgcctgacgctttttgtcgaggaatgtctgcgcagacgggttacccgcaagcacatgattctcgtggtggtcatcacattctgcgctattatcctcgggggactgacctggatggaccttctcagagccctgatcatgctgggcgacacaatgtctgggcggattggaggccagatccatctcgcgattatggctgtgtttaaaatgagccctggctacgttctgggggtgttccttcgcaagctgacctccagagagacggccctcatggtcatcggaatggccatgacaaccgtgttttctattccgcacgagctgatggaactgatcgatggcatcagccttgggctgattctcctgaaaatcgttacacatttcgacaacacccaggtgggaaccctcgctctgtcccttacattcattcggtctacgacacccctggtcatggcctggcgcacaatcatggcggtgtttttcgtcgtgaccctcattcctctgtgtagaacaagctgcctgcaaaagcagtcccactgggttgagatcaccgctcttattctgggcgcccaggccctccccgtgtatctgatgacgctcatgaaaggggctagccggagatcttggcctctgaatgaaggaatcatggccgtcggccttgtgtccctgctcggcagcgctctgctgaagaacgatgttccccttgccgggcctatggtggcgggaggcctgctcctggccgcttacgtcatgtctgggtccagcgccgacctctctctggagaaggctgccaatgtgcaatgggatgaaatggccgacatcacaggatccagccccattatcgaggtgaaacaggatgaggacggctcctttagcattcgcgatgttgaagagaccaacatgatcacccttctggtcaagctggctctcattacagtgtctgggctgtacccgcttgcgatccctgtgaccatggccctgtggtatgtctggcaagtgaaaacacagcggagcggagctctctgggacgttccctcccctgccgccacgcaaaaggctaccctgtctgaaggcgtgtacagaatcatgcagcgcggcctcttcgggaaaacacaggtcggagtgggcattcacatggagggggtttttcataccatgtggcacgtgacacggggaagcgtcatctgtcatgaaaccggcagactggagccctcctgggccgatgtgcgcaatgacatgatttcttatgggggaggctggcggcttggcgataagtgggacaaggaggaagacgttcaggtgctggcgatcgagccggggaaaaaccctaagcacgtccaaacgaaacccggactgttcaagaccctcacaggcgaaattggggctgtgaccctggattttaaacctggaacaagcggctcccccatcatcaataagaaagggaaggtgattggcctttacggaaacggcgtcgttaccaagtctggggactatgtgagcgccatcacacaggccgagagaattggagagcccgattacgaagtggacgaggatatcttccgcaaaaagcggctgacgattatggacctccatcctggcgctgggaaaaccaagagaatcctgccgtccattgtccgggaagccctcaaacgcagactgcggacacttatcctggcgcccacccgcgtggttgctgccgagatggaagaggccctgagaggactccctatccggtatcagacccccgctgtcaagagcgagcacacaggcagagaaattgtcgatctgatgtgccacgccacgtttaccacacgccttctgtcttccacccgggtgcctaattacaacctcatcgttatggacgaggctcatttcacagatccctgcagcgtggccgcgagagggtacatttctacccgcgtcgaaatgggcgaggccgctgccatctttatgacggctacacctccgggatccattgaccccttccctcagagcaattcccccatcgaagatatcgagcgggagattcctgaaagatcttggaacaccggcttcgactggatcaccgactatcaagggaagacagtgtggtttgtccccagcattaaagccggaaatgatatcgccaactgtctgcgcaagtccggcaaacgggtgattcagctcagcagaaagaccttcgacacagagtacccgaaaaccaagctgacggattgggactttgttgtgacaaccgatatctctgaaatgggggctaacttccgcgcgggaagagtgatcgaccctcggcgctgccttaagcccgtcattctgacagatggccccgagagagttatcctggccgggcctattcccgtgacccctgcttccgccgcccagcggcgcggcagaatcggacggaatccggctcaagaagacgatcagtatgtgtttagcggcgaccccctcaaaaacgatgaggaccacgcccattggacggaggcgaagatgctgcttgataatatttacacccctgaagggatcattcccacactgttcggacctgagagagagaagacccaggctatcgacggcgagtttcgcctcagaggggaacagcggaagacattcgtcgaactgatgcgccggggagacctgcccgtgtggctctcttataaagttgccagcgccggcatctcctacaaggatagagagtggtgttttaccggcgaacggaacaatcaaattcttgaggaaaacatggaggtggagatctggacacgcgaaggggagaagaaaaagctgagaccgaaatggctggacgctcgggtctatgccgatcctatggcgctcaaggacttcaaagaatttgcctctggacgcaagagcattaccctggatatccttacggagattgctacactgcccacctacctctcctctaaggccaaactggctctggacaatatcgtgatgctccacaccacagaaaagggcgggagagcctaccagcacgctcttaacgagctgcctgagagcctggaaaccctcatgctggtcgcccttctgggagcgatgacagccggcatcttcctctttttcatgcaggggaaaggaattggcaagctgtccatgggcctgatcgctattgccgtggctagcgggctcctttgggttgccgagatccagccccaatggattgccgcttctatcatcctggagttctttctgatggtgctcctgattcctgagcccgaaaaacagcggacgccgcaggataatcagcttatctatgtcattctgaccatcctcacaattatcggactgattgcggccaacgagatgggcctgatcgagaagaccaaaacagacttcgggttttaccaagtgaagaccgaaacgaccatcctcgatgttgaccttcgccctgcttccgcctggacactgtatgccgtggctaccacaattctgacccccatgctcagacatacgatcgagaatacaagcgccaacctgtcccttgcggccattgctaatcaggccgctgtcctgatgggactcggcaaggggtggcccctgcaccggatggatctgggagtgcctctccttgccatgggctgctactctcaggtgaacccgaccacactgaccgcgagcctggttatgctcctggtccattatgccatcattggccccgggcttcaggctaaagccacccgcgaagctcaaaagagaacagccgctggaatcatgaaaaatcctacggtggacggcatcaccgtgattgatctggagcccatctcctacgaccctaagttcgagaaacagctcgggcaggtcatgctgctggttctctgtgtgggacaacttctgctgatgcggacaacctgggccctctgcgaagtgctgacacttgcgaccggccccgtcatgacgctgtgggaggggaaccctggaagattttggaacacaaccattgccgtgtctaccgctaatatcttccgcggcagctatctcgccggcgctgggctggccttttccctgattaagaacgcccagacaccgcggagaggaaccggcacaacgggggaaaccctcggagagaagtggaaacgccagcttaatagcctggaccggaaggagttcgaggagtacaaaagatctggcatcctggaagttgatcgcacagaggcgaagtccgctctccgggacgggagcaaaatcaagtacgccgtgtctagaggatccagcaagattcgctggatcgtcgaacggggcatgattaaacccaagggcaaagtggttgatctggggtgtggaagaggcgggtggtcttattacatggctacccttaagaacgtgacagaggtcaaaggatataccaagggcgggcctggacacgaagaacccatccctatggccacgtacggctggaatctggtgaagctccatagcggcgtggacgtcttttataaacccaccgagcaggttgatacactgctgtgcgacattggggaatcctctagcaacccgaccatcgaggaaggacgcacactccgggtgcttaagatggtggagccttggctgtccagcaaacccgagttctgtattaaggtcctgaatccctacatgcctaccgtgatcgaggagctcgaaaaactgcaaagacgccacggcgggtcccttgttagatgccccctgtctcggaacagcacacacgagatgtattgggtgtccggagcctctggcaatatcgtcagctccgtgaacaccatttctaagatgctcctgaatcgctttacgacaagacatcggaaacctacctacgaaaaggatgttgacctgggggctggaaccagaagcgtgtccacagagacggagaagccggatatgaccatcattggccggcgcctccagagacttcgggaagaacacaaagaaacatggcattacgaccaggagaacccctatcgcacctgggcctaccacggcagctatgaagcgccttctacagggtccgccagctctatggtcaatggagtggttaagctgctgaccaaaccctgggatgtgatccctatggtcacacagctcgctatgaccgacacgacccccttcggccaacagagagtgtttaaggagaaagtcgacacacggaccccgcagcctaagcccgggacacgcatgattatgaccacgacagccaactggctgtgggcccttctgggaaagaaaaagtcccctagactctgtacccgggaggagttcatcagcaaagtgcgctctaatgccgcgatcggcgccgttttccaggaggaacaagggtggacatccgctagcgaggccgtgaacgattccagattttgggaactggtcgacaaggagcgggctctgcaccaggagggcaaatgcgaaagctgcgtgtacaatatgatgggaaagcgcgagaagaaactcggcgagttcgggagagccaagggatctcgggctatttggtatatgtggctgggcgcccgctttcttgagttcgaagcgctggggtttctcaacgaggatcattggttcagcagagagaactcctggtctggagtggaaggcgaggggctgcaccggcttggctacatcctggaagacattgataaaaaggacggagatctcatctatgccgacgataccgctggctgggacacgagaattaccgaggatgacctgctgaatgaggaactcatcacagagcagatggcgccccatcacaaaaccctggctaaggccatctttaaacttacataccaaaacaaagttgtgaaggtcctgcgccctacccccaaaggggccgtgatggatattatcagccggaaggaccagagaggatccggccaggttgggacatacggactcaataccttcacgaacatggaagtgcagctgattcgccaaatggaggcggaaggcgtcatcacacaggacgatatgcagaatccgaaagggcttaaggagcgggtggagaaatggctgaaggaatgtggcgtcgacagactcaagcgcatggctatttctggagatgactgcgtggttaaacctctggatgagcggtttagcacctccctgctgttcctgaacgacatgggcaaggtgagaaaagatatcccccagtgggaaccctctaaggggtggaaaaattggcaagaggtccctttttgtagccatcacttccacaagatctttatgaaggacggacgctcccttgtggttccgtgccggaaccaggatgaactgattggcagagcccgcatcagccagggggccggatggtctctccgggagaccgcttgtctgggcaaagcctatgctcagatgtggtcccttatgtacttccatagacgggacctgagactcgccagcatggcgatttgctctgccgtgcccacagagtggttccctacctcccgcacaacgtggagcatccacgctcatcaccaatggatgaccacagaagatatgctgaaggtctggaatcgggtgtggattgaggacaaccccaatatgaccgacaaaacacctgtgcactcctgggaagatatcccctatctggggaagagagaggacctctggtgtggctctctgattggacttagctcccgcgccacctgggctaaaaacatccatacggccatcacccaggttagaaatctgattggcaaggaagagtacgtcgattatatgcctgcgatgaagcggtacagcgccccctttgagtctgaaggggtgctctga

SEQ ID NO: 21029 - RNA, 9867 nt, synthetic construct
  misc_feature 1..9867: note = derived and/or modified CDS sequence (opt5) from DENV-4__JQ915085__SS-prME
  source 1..9867: mol_type = other RNA
agcaccatgaccctgctctgcctgatccccacggtgatggccttccacctttccaccagagacggagagcctctgatgattgttgctaagcatgaacgggggcgcccgctcctgtttaaaacaaccgagggaatcaacaagtgtacacttattgccatggatctgggcgaaatgtgcgaggacaccgttacatacaaatgtcccctcctggtgaataccgaacctgaggatatcgactgctggtgtaacctgacgtctacctgggtgatgtatgggacatgcacccaaagcggagagagacggcgcgaaaagagatccgtcgccctcacaccccactctggcatggggctggagacccgggctgaaacgtggatgagctccgagggagcctggaaacatgcccaacgcgtggagtcttggattcttagaaatcctggcttcgctctgctcgccggctttatggcttacatgatcgggcagacaggaatccagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtattgaagctagcatctctaatattaccacagccacccgctgcccgacgcaaggagagccctatcttaaggaggaacaggaccagcagtacatctgtagacgggatgtggtggaccgcggctgggggaacggatgcggcctgttcgggaaaggaggcgtcgtgacatgcgcgaagtttctctgttccggcaaaattaccgggaatctggttcaaatcgagaaccttgaatataccgtggtcgtgacagttcataatggagatacccacgccgtgggcaacgacacaagcaatcacggggtcacggctaccattacacctagatctccctccgtggaggtcaagctgcctgattacggagaactcaccctggactgcgagccccggagcggcatcgacttcaacgagatgatcctgatgaagatgaaaaagaaaacatggctcgtgcataagcagtggtttctggatcttccgctgccttggaccgccggggctgacacgtctgaagttcactggaattacaaagagagaatggtgaccttcaaggtcccccatgccaaacgccaggatgtgacagttctcggctcccaggaaggagccatgcacagcgctctggcgggcgccaccgaggtggactccggggatggaaaccacatgtttgctggccatcttaagtgtaaggtccggatggaaaaactgagaattaaggggatgtcttatacaatgtgcagcggaaaattctccatcgacaaggagatggccgagacccaacacggcacgacagtggtgaaagttaagtacgaaggggccggcgctccttgtaaggtccccattgagatccgcgatgtgaataaagaaaaggtggtcggacggattatcagctctacccccttcgccgagaacacaaactccgtgaccaatatcgagctcgaacctccgtttggcgacagctatattgttatcggggtgggagattctgcgctgaccctgcattggttcagaaaaggcagctccattgggaagatgtttgagtctacataccgcggagctaaacggatggccatcctcggcgaaacggcctgggacttcgggagcgtcggcggactgtttacctcccttggcaaggctgtgcaccaggttttcgggagcgtgtatacaaccatgtttggaggcgtctcttggattatcagaatcctgattgggttcctcgtgctgtggatcggaacaaactcccgcaataccagcatggccatgacgtgcattgctgttggcgggatcacactgtttcttggcttcaccgtgcaggccgatatgggatgtgtcgtgtcttggaacggcaaggagctcaaatgcgggtccggaatttttgtggtcgacaatgttcatacctggacagaacaatacaagttccagcccgagagccctgcgcggctggcctccgctatcctgaacgcccacaaagacggcgtgtgtgggattagatctaccacacgcctcgagaatgtgatgtggaagcagatcacgaacgaactgaattatgtcctttgggagggaggccacgatctgaccgtggttgctggcgacgtgaaaggggtcctcacaaagggaaagcgggccctgacaccccctgtgaacgatctgaaatacagctggaagacatggggcaaagcgaagatctttacccccgaagccagaaattccacgttccttattgacgggccggatacctctgagtgccctaacgaacggcgcgcttggaatttctttgaggttgaggactacggattcggcatgtttacaaccaacatctggatgaaattcagagaagggagctccgaggtgtgtgatcatcggctcatgagcgccgctattaaggaccagaaagccgtccacgccgatatgggatattggatcgaatcttccaagaatcaaacatggcagattgagaaggctagcctgatcgaagtgaaaacctgcctgtggcccaagacacataccctctggtctaacggcgttctggagtcccagatgcttatccctagaagctacgcgggccccttttctcagcacaactatcgccaagggtacgccacgcagacagctggaccttggcacctgggcaaactcgagattgacttcggggaatgccccggaaccaccgtgacaatccaggaggattgtgaccatcggggcccgagcctgagaaccacgacagcctccgggaagctggtcacccagtggtgctgtcgcagctgcacaatgcctccccttagatttctcggagaagatggctgttggtatggcatggagattcggcccctgtctgagaaagaagagaatatggtgaagtcccaagtgaccgccgggcagggaacaagcgaaaccttctccatgggcctgctctgcctgacgctttttgtcgaggaatgtctgcgcagacgggttacccgcaagcacatgatcctcgtggtggtcattacattctgcgctatcatcctcgggggactgacctgggtggaccttctcagagccctgattatgctgggcgacacaatgtctgggcggatcggaggccagattcatctcgcgatcatggctgtttttaaaatgagccctggctacgtgctgggggtcttccttcgcaagctgacctccagagagacggccctcatggtgattggaatggccatgacaaccgtcttttctatcccgcgggatctgatggagctgatcgacggcattagccttgggctgatcctcctgaaaattgtgacacacttcgataacacccaggtcggaaccctcgctctgtcccttacattcatccgctctacgacacccctggtgatggcctggagaacaattatggtcgtgtttttcgttgtgaccctcatccctctgtgtcggacaagctgcctgcaaaagcagtcccattgggtcgaaattaccgcgcttatcctgggcgctcaggccctccccgtgtatctgatgacgctcatgaaaggggccagcagacgctcttggcctctgaatgagggaatcatggctgttggccttgtgtccctgctcggcagcgccctgctgaagaacgacgtcccccttgctgggcctatggtggccggaggcctgctcctggcggcctacgtgatgtctgggtccagcgctgatctctctctggaaaaggccgctaatgttcaatgggacgagatggccgatattacaggatccagccccatcattgaagtcaaacaggacgaggatggctcctttagcatccgggacgtggaggaaaccaacatgattacccttctggtgaagctggccctcatcacagtctctgggctgtacccgcttgctatccctgtgaccatggcgctgtggtatatttggcaggttaaaacacagagaagcggagccctctgggatgtgccctcccctgctgccatccaaaaggccacgctgtctgagggcgtctaccgcattatgcagcggggcctcttcgggaaaacccaggtgggagttggcatccacatggaaggggtgtttcacacaatgtggcatgtcaccagaggaagcgtgatttgtcacgagacaggccgcctggaaccctcctgggctgacgttcggaatgatatgatctcttatgggggaggctggagacttggcgacaagtgggacaaggaggaggatgtgcaggtcctggccatcgaaccggggaaaaaccctaagcatgtgcaaaccaaacccggactgttcaagacgctcaccggcgagattggggcggtgacactggactttaaacctggaaccagcggctcccccatcattaataagaaagggaaggtcatcggcctttacggaaacggcgttgtgacaaagtctggggattatgtgagcgctattacccaggccgaacgcatcggagagcccgactacgaggtcgatgaagacattttccggaaaaagagactgacaatcatggatctccaccctggcgccgggaaaacgaagcggatcctgccgtccattgtgcgcgaggctctcaaaagacggctgcgcacccttatcctggcccccacaagagttgtggcggctgaaatggaggaagccctgcggggactccctattagatatcagacccccgccgtcaagagcgagcataccggccgcgagatcgtggacctgatgtgccacgctacatttacgacccggcttctgtcttccacaagagttcctaattacaacctcattgtgatggatgaagcccacttcaccgacccctgcagcgtcgctgcccgcgggtacatctctacacgggtggagatgggcgaagcggccgctatctttatgaccgccacgcctccgggatccattgatcccttccctcagagcaattcccccatcgaggacattgaaagagagatccctgagcgctcttggaacacaggcttcgactggattaccgattatcaagggaagaccgtctggtttgtgcccagcatcaaagctggaaatgacatcgccaactgtctgcggaagtccggcaaaaaggttattcagctcagcagaaaaacattcgataccgaatacccgaagacaaagctgaccgactgggattttgtggtgacgacagacatctctgagatgggggccaacttccgcgctggaagagtcattgatcctcggcgctgccttaaacccgttatcctgaccgacggccccgaaagagtgattctggcggggcctatccccgtgacccctgcttccgctgcccagcggcgcggcagaattggacggaatccggcccaagaggatgaccagtatgtctttagcggcgatcccctcaagaacgacgaagatcatgctcactggaccgaggccaaaatgctgcttgacaatatctacacgcctgaggggatcattcccaccctgttcggacctgaaagagagaagacacaggcgatcgacggcgaatttcgcctcagaggggaacagcggaaaaccttcgtggagctgatgcgccggggagatctgcccgtttggctctcttataaggtggctagcgccggcatttcctacaaggacagagaatggtgttttacaggcgagcggaacaatcaaatccttgaagagaacatggaagtcgagatttggacccgcgagggggagaaaaagaaactgagaccgaagtggctggatgcccgggtgtatgctgaccctatggccctcaaagatttcaaggagtttgcgtctggacgcaagagcatcacactggacatccttaccgaaattgccacgctgcccacatacctctcctctaaagctaagctggccctggataatatcgtcatgctccataccgctgagaaaggcgggagagcctaccagcacgctcttaacgaactgcctgagagcctggagaccctcatgctggtggcccttctgggagcgatgacagccggcattttcctctttttcatgcaggggaagggaatcggcaaactgtccatgggcctgattgctatcgccgttgctagcgggctcctttgggtggccgaaatccagccccaatggattgccgcttctatcattctggagttctttctgatggtcctcctgatccctgaacccgagaagcagcggaccccgcaggacaatcagcttatttatgtgatcctgacaattctcacgatcatcggactgattgcggccaacgaaatgggcctgatcgagaaaaccaagacagatttcgggttttaccaagttaagaccgagacaaccattctcgacgtggatcttcgccctgcttccgcctggacgctgtatgccgtcgctaccacaatcctgacccccatgctcagacacacaattgaaaataccagcgccaacctgtcccttgcggccatcgctaatcaggccgctgtgctgatgggactcggcaaagggtggcccctgcatcggatggacctgggagtgcctctccttgccatgggctgctactctcaggttaacccgacgacactgaccgcgagcctggtcatgctcctggtgcactatgccatcattggccccgggcttcaggctaaggccacacgcgaggctcagaaaagaaccgccgctggaatcatgaagaatcctaccgtggatggcattacagtcatcgacctggaacccatttcctacgaccctaaattcgagaagcagctcgggcaggttatgctgctggtgctctgtgtgggacaacttctgctgatgcggacgacctgggccctctgcgaggtcctgacacttgcgaccggccccatcatgacactgtgggaagggaaccctggaagattttggaacaccacgatcgccgtgtctacagctaatattttccgcggcagctatctcgccggcgctgggctggccttttccctgatcaagaacgcccagaccccgcggagaggaaccggcacaaccggggagacactcggagaaaaatggaagcgccagcttaatagcctggatcggaaagagttcgaagagtacaagagatctggcattctggaggttgaccgcacggaagcgaaatccgctctccgggatgggagcaagatcaagcatgccgtgtctagaggatccagcaaaattcgctggatcgtcgagcggggcatgattaagcccaaaggcaaggtggttgacctggggtgtggaagaggcgggtggtcttactatatggctacccttaaaaacgtgacagaagtcaagggatacaccaagggcgggcctggacacgaggaacccatccctatggccacatatggctggaatctggtgaaactccatagcggcgtggatgtcttttacaagcccaccgagcaggttgacacgctgctgtgcgatatcggggagtcctctagcaacccgaccattgaagagggacgcacactccgggtgcttaaaatggtggaaccttggctgtccagcaagcccgagttctgtatcaaagtcctgaatccctatatgcctaccgtgattgaagaactggagaagctgcaaagacgccacggcgggtcccttgttagatgccccctgtctcggaacagcacacacgaaatgtactgggtgtccggagcctctggcaatatcgtcagctccgtgaacaccatttctaaaatgctcctgaatcgctttacaaccagacatcggaagcctacgtatgagaaggacgttgatctgggggctggaacaagaagcgtgtccaccgaaaccgagaaaccggacatgacaatcatcggccggcgcctccagagacttcgggaggaacacaaggagacgtggcattacgatcaggaaaacccctaccgcacctgggcctatcacggcagctacgaggcgccttctacagggtccgccagctctatggtcaatggagtggttaaactgctgaccaagccctgggacgtgattcctatggtcacacagctcgctatgaccgacacaacccccttcggccaacagagagtgtttaaagaaaaggtcgatacgcggaccccgcagcctaagcccgggacacgcatgatcatgaccacaaccgccaactggctgtgggcccttctgggcaaaaagaaatcccctagactctgtacgcgggaggagttcattagcaaggtgcgctctaatgccgcgatcggcgccgttttccaggaagaacaagggtggacatccgctagcgaagccgtgaacgactccagattttgggagctggtcgataaagaacgggctctgcaccaggagggcaagtgcgagagctgcgtgtataatatgatgggaaagcgcgagaaaaagctcggcgagttcgggagagccaaaggatctcgggctatttggtacatgtggctgggcgcccgctttcttgagttcgaggcgctggggtttctcaacgaagaccattggttcagcagagagaactcctggtctggagtggagggcgaagggctgcaccggcttggctatatcctggaggatatcgacaagaaagatggagacctcatttacgccgatgacaccgctggctgggatacaagaatcaccgaagacgatctgctgaatgaggagctcattacggaacagatggcgccccatcacaagaccctggctaaggccatctttaaacttacatatcaaaacaaggttgtgaaagtcctgcgccctacccccaagggggccgtgatggacattatcagccggaaagaccagagaggatccggccaggttgggacatacggactcaataccttcacaaacatggaggtgcagctgatccgccaaatggaagcggagggcgtcattacccaggatgacatgcagaatccgaaggggcttaaagaacgggtggagaagtggctgaaggagtgtggcgtcgatagactcaaacgcatggctatctctggagacgattgcgtggttaagcctctggacgaacggtttagcacgtccctcctgttcctgaacgatatgggcaaagtgagaaaggacattccccagtgggagccctctaaagggtggaagaattggcaagaagtccctttttgtagccatcacttccacaagatctttatgaaagatggacgctcccttgtggttccgtgccggaaccaggacgagctgattggcagagcccgcatcagccagggggccggatggtctctccgggaaacagcttgtctgggcaaggcctacgctcagatgtggtcccttatgtatttccatagacgggatctgagactcgccagcatggcgatttgctctgccgtgcccaccgagtggttccctacctcccgcacaacctggagcatccacgctcatcaccaatggatgacaacggaggacatgctgaaagtctggaatcgggtgtggatcgaagacaaccccaatatgaccgataagacacctgtgcactcctgggaggacattccctacctggggaaaagagaagatctctggtgtggctctctgatcggacttagctcccgcgccacctgggctaagaacattcatacagccatcacccaggttagaaatctgattggcaaggaggaatatgtcgactacatgcctgcgatgaaacggtatagcgccccctttgagtctgagggggtgctctga

SEQ ID NO: 21030 - RNA, 9867 nt, synthetic construct
  misc_feature 1..9867: note = derived and/or modified CDS sequence (opt5) from DENV-4__JQ915088__SS-prME
  source 1..9867: mol_type = other RNA
agcaccatgacactgctctgcctgatccccacggtgatggccttccacctttccaccagagacggcgagcctctgatgattgtcgctaagcatgaacgggggcgcccgctcctgtttaaaacaaccgagggaatcaacaagtgtacacttattgccatggatctgggcgaaatgtgcgaggacaccgttacatacaaatgtcccctcctggtgaataccgaacctgaggatatcgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggattcttagaaatcctggcttcgctctgctcgccggctttatggcttacatgatcgggcagacaggaatccagcggattgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcaccacaatggcccaggggaagcctaccctggattttgaactgaccaagacaacggctaaagaggttgccctcctgcggacctactgtatcgaagctagcatttctaatatcacaaccgccacacgctgcccgacccaaggagagccctatcttaaggaggaacaggaccagcagtacatttgtagacgggatgtggtggaccgcggctgggggaacggatgcggcctgttcgggaaaggaggcgtcgtgacgtgcgcgaagtttctctgttccggcaaaatcacagggaatctggttcaaattgagaaccttgaatataccgtggtcgtgaccgttcataatggagatacacacgccgtgggcaacgacaccagcaatcacggggtcacagctacgatcacccctagatctccctccgtggaggtcaagctgcctgattacggagaactcacactggactgcgagccccggagcggcatcgacttcaacgagatgattctgatgaagatgaaaaagaaaacctggctcgtgcataagcagtggtttctggatcttccgctgccttggacagccggggctgacacctctgaagttcactggaattacaaagagagaatggtgacgttcaaggtcccccatgccaaacgccaggatgtgaccgttctcggctcccaggaaggagccatgcacagcgctctggcgggcgccacagaggtggactccggggatggaaaccacatgtttgctggccatcttaagtgtaaggtccggatggaaaaactgagaatcaaggggatgtcttataccatgtgcagcggaaaattctccattgacaaggagatggccgagacacaacacggcaccacggtggtgaaagttaagtacgaaggggccggcgctccttgtaagatccccattgagatccgcgatgtcaataaagaaaaggtggtgggacggatcattagctctacacccttcgccgagaacaccaactccgtcatcaatattgagctcgaacctccgtttggcgacagctatatcgtgattggggttggagattctgcgctgacactgcattggttcagaaaaggcagctccatcgggaagatgtttgagtctacctaccgcggagctaaacggatggccatcctcggcgaaaccgcctgggacttcgggagcgtgggcggactgtttacatcccttggcaaggctgtccaccaggtgttcgggagcgtttatacgaccatgtttggaggcgtgtcttggatgattagaatcctgattgggttcctcgtcctgtggatcggaacaaactcccgcaataccagcatggccatgacatgcattgctgtgggcgggatcaccctgtttcttggcttcacggttcaggccgatatgggatgtgtggtctcttggaacggcaaggagctcaaatgcgggtccggaatttttgtggtggacaatgtccatacatggaccgaacaatacaagttccagcccgagagccctgcgcggctggcctccgctatcctgaacgcccacaaagacggcgtttgtgggatcagatctaccacacgcctcgagaatgtgatgtggaagcagattaccaacgaactgaattatgtgctttgggagggaggccacgatctgacagtcgtggctggcgacgttaaaggggtgctcacgaagggaaagcgggccctgaccccccctgtcaacgatctgaaatacagctggaagacatggggcaaagcgaagatctccacccccgaagccagaaattctacatttcttattgacgggccggataccagcgagtgccctaacgaacggcgcgcttggaatttcttcgaggtggaggactacggatttggcatgttcacgaccaacatctggatgaaatttagagaagggtccagcgaggtttgtgatcatcggctcatgtctgccgctattaaggaccagaaagccgtgcacgccgatatgggatattggatcgaatccagcaagaatcaaacatggcagatcgagaaggcttctctgattgaagtcaaaacctgcctgtggcccaagacacataccctctggtccaacggcgtgctggagagccagatgcttatccctagatcttacgcgggccccttcagccagcacaactatcgccaagggtacgccacacagaccgctggaccttggcacctgggcaaactcgagattgactttggggaatgccccggaacgacagttaagatccaggaggattgtgaccatcggggcccgtccctgagaaccaccacagccagcgggaaactggtgacccagtggtgctgtcgctcttgcacgatgcctccccttagattcctcggagaagatggctgttggtatggcatggagattcggcccctgtccgagaaggaagagaatatggtcaagagccaagtgacagccgggcagggaacctccgaaacattttctatgggcctgctctgcctgacccttttcgtggaggaatgtctgcgcagacgggtcacacgcaaacacatgatcctcgttgtggtgatcaccttttgcgctattatcctggggggactgacgtggatggaccttctcagagccctgattatgctgggcgacaccatgagcgggcggatcggaggccagattcatctcgcgatcatgacagtcttcaagatgtcccctggctacgtgctgggggtttttcttcgcaaactgacctctagagagacagctctcatggtgatcggaatggccatgaccacggtcttcagcattccgcacgatctgatggagctgatcgacggcatttcccttgggctgatcctcctgaagattgtgacacattttgataacacccaggttggaacactcgccctgtctcttaccttcatgcggagcaccacacccctggtgatggcttggcgcacgatcatggccgtcttctttgtgattaccctcatccctctgtgtagaacatcctgcctgcaaaaacagagccactgggtcgaaatcaccgcgcttattctgggcgctcaggccctccccgtgtatctgatgacactcatgaagggggcctctcggagatcctggcctctgaatgagggaatcatggctgttggccttgtgagcctgctcggctctgccctgctgaagaacgacgtcccccttgctgggcctatggtggccggaggcctgctcctggcggcctacgttatgtccgggagctctgctgatctctccctggaaaaagccgctaatgtgcaatgggacgagatggccgatattaccggaagctcccccatcattgaagtcaagcaggacgaggatggcagcttctctatccgcgacgtggaggaaacgaacatgatcacacttctggtgaaactggccctcattaccgttagcgggctgtacccgcttgctatccctgtcaccatggcgctgtggtatatttggcaggtgaagacacagcggtccggagccctctgggatgtgccctctcctgctgccacccaaaaagccacactgagcgagggcgtctacagaatcatgcagcgcggcctctttgggaagacgcaggtgggagttggcattcacatggaaggggtgttccataccatgtggcacgtcacacggggatccgtgatctgtcatgagaccggcagactggaaccctcttgggctgacgttcgcaatgatatgatcagctatgggggaggctggcggcttggcgacaagtgggacaaagaggaggatgtgcaggtcctggccattgaaccggggaagaaccctagacacgtgcaaacaaaacccggactgtttaagaccctcacgggcgagatcggggcggttaccctggacttcaaacctggaacatccggctctcccattatcaataagaaagggaaggtgattggcctttacggaaacggcgtcgtgaccaagagcggggattatgtgtccgctatcacacaggccgaacgcattggagagcccgactacgaggtcgatgaagacatctttcggaaaaagagactgaccatcatggatctccatcctggcgccgggaaaacaaagcggattctgccgagcatcgttcgcgaggctctcaaaagacggctgcgcacgcttattctggcccccaccagagtggtggcggctgaaatggaggaagccctgcggggactccctatcagatatcagacacccgccgtcaagtctgagcacaccggccgcgagattgtggacctgatgtgccacgctaccttcacaacgcggcttctgtccagcaccagagttcctaattacaacctcatcgtgatggatgaagcccattttacagacccctgctctgtcgctgcccgcgggtacatctccacccgggtggagatgggcgaagcggccgctattttcatgacagccacccctccgggaagcatcgatccctttcctcagtccaattctcccattgaggacatcgaaagagagattcctgagcgcagctggaacacgggcttcgactggatcacagattatcaagggaagaccgtttggttcgtgccctccatcaaagctggaaatgacattgccaactgtctgcggaagagcggcaaaagagtcatccagctctctcgcaagacctttgatacagaatacccgaaaaccaagctgacagactgggatttcgtggtcaccacggacatttccgagatgggggccaactttagagctggacgggtgatcgatcctcgcagatgccttaagcccgttattctgacagacggccccgaacgggtgatcctggcggggcctattcccgtgacccctgccagcgctgcccagcgcagaggccggatcggaagaaatccggcccaagaggatgaccagtatgtcttctctggcgatcccctcaaaaacgacgaagatcacgctcattggacagaggccaagatgctgcttgacaatatctacacccctgaggggattatccccacgctgtttggacctgaacgcgagaaaacccaggcgattgacggcgaattccggctcagaggggagcagcgcaagacatttgttgagctgatgcggagaggagatctgcccgtgtggctcagctataaagtggcttccgccggcatctcttacaaggaccgggaatggtgtttcaccggcgagcgcaacaatcaaattcttgaagagaacatggaagtcgagatctggacaagagagggggaaaagaaaaagctgcggccgaaatggctggatgcccgcgtgtatgctgaccctatggccctcaaggattttaaagagttcgcgagcggaagaaagtccaccacactggacatccttaccgaaattgccacgctgcccacatacctctctagcaaggctaaactggccctggataatatcgttatgctccacaccaccgagaagggcgggcgggcttaccagcacgcccttaacgaactgcctgagtccctggagacactcatgctggtggctcttctgggagccatgaccgcgggcatttttctcttctttatgcaggggaaaggaatcggcaagctgagcatgggcctgattgccatggctgtcgcctctgggctcctttgggtggctgaaatccagccccaatggatcgccgcctccattatcctggagttcttcctgatggtcctcctgattcctgaacccgagaaacagcgcacaccgcaggacaatcagcttatctatgtgattctgacgatcctcaccattatcggactgatcgctgcgaacgaaatgggcctgattgagaagacaaaaaccgattttgggttctaccaagttaagacagagaccacgatcctcgacgtggatcttagacctgccagcgcttggaccctgtatgccgtcgccacaaccattctgacacccatgctccggcataccatcgaaaatacgtccgctaacctgtctcttgccgcgattgccaatcaggctgccgtgctgatgggactcggcaaggggtggcccctgcaccgcatggacctgggagttcctctccttgctatgggctgctacagccaggtgaacccgacaaccctgacagcctccctggtcatgctcctgatccattatgcgatcattggccccgggcttcaggccaaagctaccagagaggcccaaaagcggaccgctgccggaatcatgaaaaatcctacagtggatggcattacggtgatcgacctggaacccatttcttacgaccctaagtttgagaaacagctcgggcaggttatgctgctggtcctctgtgtgggacaacttctgctgatgagaaccacatgggctctctgcgaggtgctgacccttgccacaggccccatcatgaccctgtgggaagggaaccctggacgcttctggaacacgacaatcgcggtcagcaccgccaatatttttcggggctcctatctcgctggcgccgggctggctttcagcctgatcaagaacgcccagaccccgagacgcggaacaggcaccacaggggagacgctcggagaaaagtggaaacggcagcttaattctctggatagaaaggagtttgaagagtacaaacgctccggcattctggaggttgaccggaccgaagccaagagcgcgctcagagatgggtctaaaatcaagcacgctgtgtcccgcggaagctctaagattcggtggatcgtggagagaggcatgattaaacccaagggcaaagtcgtggacctggggtgtggacgcggcgggtggagctactatatggccacacttaagaacgttaccgaagtgaaaggatacacaaagggcgggcctggacatgaggaacccatccctatggctacctatggctggaatctggtcaagctccactccggcgtggatgttttctacaaacccacggagcaggtggacaccctgctgtgcgatatcggggagtctagctccaacccgacaattgaagagggacggaccctcagaatccttaagatggtcgaaccttggctgagctccaaacccgagttttgtattaaggtgctgaatccctatatgcctacagtgatcgaagagctcgagaaactgcaacgcagacacggcgggtctcttgtccggtgccccctgagccgcaactccacccatgaaatgtactgggtttctggagccagcggcaatattgtgtcctctgtgaacacaatcagcaagatgctcctgaatagattcaccacgcggcacagaaaacctacatatgagaaggacgtcgatctgggggccggaacccggtccgtgagcaccgaaacagagaagccggacatgacgatcattggccgcagactccagcggcttcaggaggaacataaagagacctggcactacgatcaggaaaacccctaccgcacatgggcttatcacggctcttacgaggccccttccaccgggagcgcgtcttccatggttaatggagtggtcaagctgctgacaaaaccctgggacgtgatccctatggttacccaactcgccatgacagacaccacgccctttggccagcagagagtgttcaaggaaaaagtcgatacccggacaccgcagcctaagctggggacccgcatgattatgacaaccacggctaactggctttgggccctgctcggaaagaaaaagagccccagactgtgtacacgggaggagtttatctctaaagtgcgctccaatgctgccattggcgcggttttccaagaagagcaggggtggaccagcgcctccgaagctgtgaacgacagcagattctgggagctggtcgataaggaacgggccctccatcaggagggcaaatgcgagtcttgcgtgtataatatgatgggaaagcgcgaaaagaaactgggcgagtttgggagagctaagggaagccgggccatctggtacatgtggcttggcgctcgcttcctggaatttgaggccctcgggttcctgaacgaagaccactggttttccagagagaactcttggagcggagtcgagggcgaagggcttcatcggctgggctatatcctcgaggatattgacaaaaaggatggagacctgatctacgcggatgacacagccggctgggataccagaattacggaagacgatctgctcaatgaggagctgatcaccgaacaaatggctcctcaccataaaacacttgccaaggctattttcaagctgacctatcagaacaaagtggttaaggtgctccgccccacacctaaaggggccgtcatggacatcatctcccggaaggaccagagaggatctggccaggtggggacctacggactgaatacatttaccaacatggaggtgcaacttattcgccagatggaagccgagggcgttatcacgcaggatgacatgcagaatcccaaagggctgaaggaacgggtggagaaatggctcaaggagtgtggcgtcgatagactgaagcgcatggcgattagcggagacgattgcgtggttaaaccgctggacgaacggttctccacatctctcctgtttcttaacgatatgggcaaggtgagaaaagacgtccctcaatgggagcccagcaaggggtggaaaaattggcaggaagtgcccttctgttcccaccactttcataagatcttcatgaaggatggacgcagcctggtcgtgccttgccggaaccaggacgagctcattggcagagctcgcatctctcagggggccggatggtccctgcgggaaaccgcctgtcttggcaaagcttacgcccaaatgtggagcctgatgtattttcacagacgggatctcagactggcttctatggccatttgctccgcggttccgaccgagtggttccccacaagccgcaccacatggtccatccatgcccagcaccagtggatgacgaccgaggacatgctgaaggtgtggaatcgggtctggatcgaagacaaccctaatatgacagataaaacccccgtgcactcttgggaggacattccttacctcgggaagagagaagatctgtggtgtggcagccttatcggactgtccagccgcgctacatgggccaaaaacattcataccgctatcacgcaggttagaaatctcattggcaaggaggaatatgtggactacatgcccgtcatgaagcggtattcttcccctagcgagtctgagggggtgctgtga

SEQ ID NO: 21031 - RNA, 9867 nt, synthetic construct
  misc_feature 1..9867: note = derived and/or modified CDS sequence (opt5) from DENV-4__JQ915086__SS-prME
  source 1..9867: mol_type = other RNA
agcaccatgacactgctctgcctgatccccacggtgatggccttccacctttccaccagagacggcgagcctctgatgattgtcgctaagcatgaacgggggcgcccgctcctgtttaaaacaaccgagggaatcaacaagtgtacacttattgccatggatctgggcgaaatgtgcgaggacaccgttacatacaaatgtcccctcctggtgaataccgaacctgaggatatcgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggattcttagaaatcctggcttcgctctgctcgccggctttatggcttacatgatcgggcagacaggaatccagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtattgaagctagcatctctaatattaccacagccacccgctgcccgacgcaaggagagccctatcttaaggaggaacaggaccagcagtacatctgtagacgggatgtggtggaccgcggctgggggaacggatgcggcctgttcgggaaaggaggcgtcgtgacatgcgcgaagtttctctgttccggcaaaattaccgggaatctggttcaaatcgagaaccttgaatataccgtggtcgtgacagttcataatggagatacccacgccgtgggcaacgacacaagcaatcacggggtcacggctaccattacacctagatctccctccgtggaggtcaagctgcctgattacggagaactcaccctggactgcgagccccggagcggcatcgacttcaacgagatgatcctgatgaagatgaaaaagaaaacatggctcgtgcataagcagtggtttctggatcttccgctgccttggaccgccggggctgacacgtctgaagttcactggaattacaaagagagaatggtgaccttcaaggtcccccatgccaaacgccaggatgtgacagttctcggctcccaggaaggagccatgcacagcgctctggcgggcgccaccgaggtggactccggggatggaaaccacatgtttgctggccatcttaagtgtaaggtccggatggaaaaactgagaattaaggggatgtcttatacaatgtgcagcggaaaattctccatcgacaaggagatggccgagacccaacacggcacgacagtggtgaaagttaagtacgaaggggccggcgctccttgtaagattcccatcgagattcgcgatgtcaataaagaaaaggtggtgggacggatcatcagctctacccccttcgccgagaacacaaactccgtcattaatatcgagctcgaacctccgtttggcgacagctatattgtgatcggggttggagattctgcgctgaccctgcattggttcagaaaaggcagctccattgggaagatgtttgagtctacctaccgcggagctaaacggatggccatcctcggcgaaacagcctgggacttcgggagcgtgggcggactgtttacgtcccttggcaaggctgtccaccaggtgttcgggagcgtttataccacaatgtttggaggcgtgtcttggatgatcagaattctgatcgggttcctcgtcctgtggattggaaccaactcccgcaatacaagcatggccatgacctgcatcgctgtgggcgggattacgctgtttcttggcttcacagttcaggccgatatgggatgtgtggtctcttggaacggcaaggagctcaaatgcgggtccggaatctttgtggtggacaatgtccatacctggaccgaacaatacaagttccagcccgagagccctgcgcggctggcctccgctattctgaacgcccacaaagacggcgtttgtgggatcagatctacaacccgcctcgagaatgtgatgtggaagcagatcacaaacgaactgaattatgtgctttgggagggaggccacgatctgacggtcgtggctggcgacgttaaaggggtgctcaccaagggaaagcgggtcctgacaccccctgtgaacgatctgaaatacagctggaagacctggggcaaagccaagatttttacacccgaagcgagaaattccaccttccttatcgacgggccggatacgtctgagtgccctaacgaacggcgcgcctggaatttctttgaggttgaggactacggattcggcatgtttaccacaaacatttggatgaaattcagagaagggagctccgaggtgtgtgatcatcggctcatgagcgctgccatcaaggaccagaaagctgtccacgccgatatgggatattggattgaatcttccaagaatcaaacctggcagatcgagaaggccagcctgatcgaagtgaaaacatgcctgtggcccaagacccatacactctggtctaacggcgttctggagtcccagatgcttattcctagaagctacgctggccccttttctcagcacaactatcgccaagggtacgcgacccagacggccggaccttggcacctgggcaaactcgagatcgacttcggggaatgccccggaacaaccgtgaagattcaggaggattgtgaccatcggggcccgagcctgagaaccacaaccgcttccgggaaactggtcacgcagtggtgctgtcgcagctgcacaatgcctccccttagatttctcggagaagatggctgttggtatggcatggagatccggcccctgtctgagaaggaagagaatatggtgaagtcccaagtgaccgccgggcagggaacaagcgaaaccttctccatgggcctgctctgcctgacactttttgtcgaggaatgtctgcgcagacgggttacccgcaaacacatgattctcgtggtggtcatcacgttctgcgccatcattctggggggactgacctggatggaccttctcagagctctgatcatgctgggcgacacaatgtctgggcggattggaggccagatccatctcgccattatgaccgtgtttaagatgagccctggctacgttctgggggtgttccttcgcaaactgacatccagagagaccgcgctcatggtcatcggaatggctatgacgacagtgttttctatcccgcacgatctgatggagctgattgacggcatcagccttgggctgattctcctgaagatcgttacccatttcgataacacacaggtgggaaccctcgccctgtcccttaccttcattcggtctacaacgcccctggtcatggcctggcgcaccatcatggctgtgtttttcgtcattacactcatccctctgtgtagaaccagctgcctgcaaaaacagtcccactgggtggaaatcacagcccttattctgggcgcgcaggctctccccgtttatctgatgaccctcatgaagggggccagccggagatcttggcctctgaatgagggaatcatggccgtgggccttgtctccctgctcggcagcgctctgctgaagaacgacgtgccccttgccgggcctatggttgctggaggcctgctcctggccgcgtacgtgatgtctgggtccagcgccgatctctctctggaaaaagctgccaatgtccaatgggacgagatggctgatattacgggatccagccccatcattgaagtgaagcaggacgaggatggctcctttagcatccgcgacgtggaggaaacaaacatgatcacccttctggttaaactggccctcattaccgtctctgggctgtacccgcttgccatccctgtgacaatggctctgtggtatatttggcaggtgaagacccagcggagcggagcgctctgggatgtcccctcccctgccgctacacaaaaagccacgctgtctgagggcgtgtacagaatcatgcagcgcggcctcttcgggaagacccaggttggagtgggcattcacatggaaggggtctttcatacaatgtggcacgtgacccggggaagcgttatctgtcatgagacaggcagactggaaccctcctgggccgacgtgcgcaatgatatgatctcttatgggggaggctggcggcttggcgacaagtgggacaaagaggaggatgtccaggtgctggctattgaaccggggaagaaccctagacacgttcaaaccaaacccggactgttcaagacgctcaccggcgagatcggggccgtgacactggactttaaacctggaaccagcggctcccccattatcaataagaaagggaaggtcattggcctttacggaaacggcgtggtgacaaagtctggggattatgtcagcgcgatcacccaggctgaacgcattggagagcccgactacgaggttgatgaagacatcttccggaaaaagagactgacaatcatggatctccatcctggcgccgggaaaacgaagcggattctgccgtccatcgtgcgcgaggccctcaaaagacggctgcgcacccttattctggctcccacaagagtggtcgccgcggaaatggaggaagctctgcggggactccctatcagatatcagacccccgccgtgaagagcgagcacaccggccgcgagattgttgacctgatgtgccacgccacatttacgacccggcttctgtcttccacaagagtgcctaattacaacctcatcgtcatggatgaagctcatttcaccgacccctgcagcgtggccgctcgcgggtacatctctacacgggttgagatgggcgaagccgcggccatttttatgaccgctacgcctccgggatccatcgatcccttccctcagagcaattcccccattgaggacatcgaaagagagattcctgagcgctcttggaacacaggcttcgactggatcaccgattatcaagggaagaccgtgtggtttgtccccagcatcaaagccggaaatgacattgctaactgtctgcggaagtccggcaaaagagtgatccagctcagccgcaagacattcgataccgaatacccgaaaacaaagctgaccgactgggattttgtcgtgacgacagacatttctgagatgggggccaacttcagagccggacgggttatcgatcctcgcagatgccttaagcccgtgattctgaccgacggccccgaacgggtgatcctggctgggcctattcccgtcacacctgcgtccgccgctcagcgcagaggccggatcggaagaaatccggcccaagaggatgaccagtatgtttttagcggcgatcccctcaaaaacgacgaagatcacgcccattggaccgaggctaagatgctgcttgacaatatctacacgcctgaggggattatccccaccctgttcggacctgaacgcgagaaaacacaggccattgacggcgaatttcggctcagaggggagcagcgcaagaccttcgtggagctgatgcggagaggagatctgcccgtgtggctctcttataaagtcgcgagcgctggcatctcctacaaggaccgggaatggtgttttacaggcgagcgcaacaatcaaattcttgaagagaacatggaagtggagatctggaccagagagggggaaaagaaaaagctgcggccgaaatggctggatgcccgcgtttatgccgaccctatggctctcaaggatttcaaagagtttgcctctggaagaaagagcacaaccctggacatccttacggaaattgcgacactgcccacctacctctcctctaaggccaaactggctctggataatatcgtgatgctccacaccacagagaagggcgggcgggcctaccagcacgctcttaacgaactgcctgagagcctggagaccctcatgctggtcgcccttctgggagctatgacagccggcattttcctctttttcatgcaggggaaaggaatcggcaagctgtccatgggcctgattgcgatcgccgtggctagcgggctcctttgggtcgccgaaatccagccccaatggattgctgcctctatcattctggagttctttctgatggtgctcctgatccctgaacccgagaaacagcgcacgccgcaggacaatcagcttatttatgttatcctgaccattctcacaatcatcggactgattgccgctaacgaaatgggcctgatcgagaagaccaaaacagatttcgggttttaccaagtgaagaccgagacgaccattctcgacgtcgatcttagacctgcgtccgcctggacactgtatgctgtggccaccacaatcctgacccccatgctccggcatacgattgaaaatacaagcgccaacctgtcccttgctgccatcgcgaatcaggccgctgttctgatgggactcggcaaggggtggcccctgcaccgcatggacctgggagtgcctctccttgccatgggctgctactctcaggtcaacccgaccacactgaccgctagcctggtgatgctcctgatccattatgccattatcggccccgggcttcaggcgaaagccaccagagaggctcaaaagcggacagccgctggaattatgaaaaatcctacggtggatggcatcaccgttattgacctggaacccatctcctacgaccctaagttcgagaaacagctcgggcaggtcatgctgctggtgctctgtgtgggacaacttctgctgatgagaacaacctgggccctctgcgaggtcctgacacttgctaccggccccatcatgacgctgtgggaagggaaccctggacgcttttggaacacaaccattgccgtttctaccgcgaatatcttccggggcagctatctcgccggcgctgggctggccttttccctgattaagaacgctcagacaccgagacgcggaaccggcacaacgggggagaccctcggagaaaagtggaaacggcagcttaatagcctggatagaaaggagttcgaagagtacaaacgctctggcatcctggaggtggaccggacagaagccaagtccgccctcagagatgggagcaaaattaagcacgcggtgtctcgcggatccagcaagatccggtggattgtcgagagaggcatgatcaaacccaagggcaaagtggttgacctggggtgtggacgcggcgggtggtcttactatatggctacccttaagaacgtgacagaagtcaaaggatacaccaagggcgggcctggacatgaggaacccatccctatggccacgtatggctggaatctggtgaagctccacagcggcgttgatgtgttttacaaacccaccgagcaggtcgacacactgctgtgcgatattggggagtcctctagcaacccgaccatcgaagagggacggacactcagaattcttaagatggtggaaccttggctgtccagcaaacccgagttctgtatcaaggtgctgaatccctatatgcctaccgtcattgaagagctcgagaaactgcaacgcagacacggcgggtcccttgttcggtgccccctgtctcgcaacagcacacatgaaatgtactgggtgtccggagcttctggcaatatcgtgagctccgtcaacaccatctctaagatgctcctgaatagatttacgacacggcacagaaaacctacctatgagaaggacgtggatctgggggccggaacccggagcgtttccacagaaacggagaagccggacatgaccattatcggccgcagactccagcggcttcaggaggaacataaagagacatggcactacgatcaggaaaacccctaccgcacctgggcctatcacggcagctacgaggctccttctacagggtccgccagctctatggtgaatggagtcgtgaagctgctgaccaaaccctgggacgttattcctatggtgacacaactcgcgatgaccgacacgacccccttcggccagcagagagtctttaaggaaaaagtggatacacggaccccgcagcctaagctggggacacgcatgatcatgaccacgacagccaactggctttgggctctgctcggaaagaaaaagtcccccagactgtgtacccgggaggagttcattagcaaagttcgctctaatgccgctatcggcgccgtgttccaagaagagcaggggtggacatccgcgagcgaagccgtcaacgactccagattttgggagctggtggataaggaacgggctctccatcaggagggcaaatgcgagagctgcgtctataatatgatgggaaagcgcgaaaagaaactgggcgagttcgggagagccaagggatctcgggctatctggtacatgtggcttggcgcccgctttctggaattcgaggctctcgggtttctgaacgaagaccactggttcagcagagagaactcctggtctggagtggagggcgaagggcttcatcggctgggctatattctcgaggatatcgacaaaaaggatggagacctgatttacgccgatgacaccgcgggctgggatacgagaatcaccgaagacgatctgctcaatgaggagctgattacagaacaaatggcccctcaccataaaacccttgctaaggccatctttaagctgacatatcagaacaaagttgtgaaggtcctccgccccacccctaaaggggctgtgatggacatcattagccggaaggaccagagaggatccggccaggtggggacatacggactgaataccttcacgaacatggaggttcaacttatccgccagatggaagccgagggcgtgattacacaggatgacatgcagaatcccaaagggctgaaggaacgggtcgagaaatggctcaaggagtgtggcgtggatagactgaagcgcatggccatctctggagacgattgcgttgtgaaaccgctggacgaacggtttagcacctccctcctgttccttaacgatatgggcaaggtcagaaaagacgtgcctcaatgggagccctctaaggggtggaaaaattggcaggaagtccccttttgtagccaccacttccataagatttttatgaaggatggacgctccctggtggttccttgccggaaccaggacgagctcatcggcagagcgcgcattagccagggggctggatggtctctgcgggaaaccgcctgtcttggcaaagcctacgctcaaatgtggtccctgatgtatttccacagacgggatctcagactggccagcatggctatctgctctgccgtgccgacagagtggttccccacctcccgcacaacgtggagcatccatgcgcagcaccagtggatgaccacagaggacatgctgaaggtctggaatcgggtgtggattgaagacaaccctaatatgaccgataaaacacccgttcactcctgggaggacatcccttacctcgggaagagagaagatctgtggtgtggctctcttattggactgagctcccgcgccacctgggctaaaaacatccatacggccattacccaggtgagaaatctcatcggcaaggaggaatatgtcgactacatgcccgtgatgaagcggtatagcgctccttctgagtccgagggggtgctgtga

SEQ ID NO: 21032 - RNA, 9867 nt, synthetic construct
  misc_feature 1..9867: note = derived and/or modified CDS sequence (opt5) from DENV-4__JQ915087__SS-prME
  source 1..9867: mol_type = other RNA
agcaccatgacactgctctgcctgatccccacggtgatggccttccacctttccaccagagacggcgagcctctgatgattgtcgctaagcatgaacgggggcgcccgctcctgtttaaaacaaccgagggaatcaacaagtgtacacttattgccatggatctgggcgaaatgtgcgaggacaccgttacatacaaatgtcccctcctggtgaataccgaacctgaggatatcgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggattcttagaaatcctggcttcgctctgctcgccggctttatggcttacatgatcgggcagacaggaatccagcggattgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcaccacaatggcccaggggaagcctaccctggattttgaactgaccaagacaacggctaaagaggttgccctcctgcggacctactgtatcgaagctagcatttctaatatcacaaccgccacacgctgcccgacccaaggagagccctatcttaaggaggaacaggaccagcagtacatttgtagacgggatgtggtggaccgcggctgggggaacggatgcggcctgttcgggaaaggaggcgtcgtgacgtgcgcgaagtttctctgttccggcaaaatcacagggaatctggttcaaattgagaaccttgaatataccgtggtcgtgaccgttcataatggagatacacacgccgtgggcaacgacaccagcaatcacggggtcacagctacgatcacccctagatctccctccgtggaggtcaagctgcctgattacggagaactcacactggactgcgagccccggagcggcatcgacttcaacgagatgattctgatgaagatgaaaaagaaaacctggctcgtgcataagcagtggtttctggatcttccgctgccttggacagccggggctgacacctctgaagttcactggaattacaaagagagaatggtgacgttcaaggtcccccatgccaaacgccaggatgtgaccgttctcggctcccaggaaggagccatgcacagcgctctggcgggcgccacagaggtggactccggggatggaaaccacatgtttgctggccatcttaagtgtaaggtccggatggaaaaactgagaatcaaggggatgtcttataccatgtgcagcggaaaattctccattgacaaggagatggccgagacacaacacggcaccacggtggtgaaagttaagtacgaaggggccggcgctccttgtaagatccccattgagatccgcgatgtcaataaagaaaaggtggtgggacggatcattagctctacacccttcgccgagaacaccaactccgtcatcaatattgagctcgaacctccgtttggcgacagctatatcgtgattggggttggagattctgcgctgacactgcattggttcagaaaaggcagctccatcgggaagatgtttgagtctacctaccgcggagctaaacggatggccatcctcggcgaaaccgcctgggacttcgggagcgtgggcggactgtttacatcccttggcaaggctgtccaccaggtgttcgggagcgtttatacgaccatgtttggaggcgtgtcttggatgattagaatcctgattgggttcctcgtcctgtggatcggaacaaactcccgcaataccagcatggccatgacatgcattgctgtgggcgggatcaccctgtttcttggcttcacggttcaggccgatatgggatgtgtggtctcttggaacggcaaggagctcaaatgcgggtccggaatttttgtggtggacaatgtccatacatggaccgaacaatacaagttccagcccgagagccctgcgcggctggcctccgctatcctgaacgcccacaaagacggcgtttgtgggatcagatctaccacacgcctcgagaatgtgatgtggaagcagattaccaacgaactgaattatgtgctttgggagggaggccacgatctgacagtcgtggctggcgacgttaaaggggtgctcacgaagggaaagcgggccctgaccccccctgtcaacgatctgaaatacagctggaagacatggggcaaagcgaagatctttacccccgaagccagaaattccacattccttattgacgggccggatacctctgagtgccctaacgaacggcgcgcttggaatttctttgaggtggaggactacggattcggcatgtttacgaccaacatctggatgaaattcagagaagggagctccgaggtttgtgatcatcggctcatgagcgccgctattaaggaccagaaagccgtgcacgccgatatgggatattggatcgaatcttccaagaatcaaacatggcagatcgagaaggctagcctgattgaagtcaaaacctgcctgtggcccaagacacataccctctggtctaacggcgtgctggagtcccagatgcttatccctagaagctacgcgggccccttttctcagcacaactatcgccaagggtacgccacacagaccgctggaccttggcacctgggcaaactcgagattgacttcggggaatgccccggaacgacagttaagatccaggaggattgtgaccatcggggcccgagcctgagaaccaccacagcctccgggaaactggtgacccagtggtgctgtcgcagctgcacgatgcctccccttagatttctcggagaagatggctgttggtatggcatggagattcggcccctgtctgagaaggaagagaatatggtcaagtcccaagtgacagccgggcagggaaccagcgaaacattctccatgggcctgctctgcctgaccctttttgtggaggaatgtctgcgcagacgggtcacacgcaaacacatgatcctcgttgtggtgatcaccttctgcgctattatcctggggggactgacgtggatggaccttctcagagccctgattatgctgggcgacaccatgtctgggcggatcggaggccagattcatctcgcgatcatgacagtctttaagatgagccctggctacgtgctgggggttttccttcgcaaactgacctccagagagacagctctcatggtgatcggaatggccatgaccacggtcttttctattccgcacgatctgatggagctgatcgacggcattagccttgggctgatcctcctgaagattgtgacacatttcgataacacccaggttggaacactcgccctgtcccttaccttcatccggtctaccacacccctggtgatggcttggcgcacgattatggccgtctttttcgtgatcaccctcatccctctgtgtagaacaagctgcctgcaaaaacagtcccactgggtcgaaattaccgcgcttatcctgggcgctcaggccctccccgtgtatctgatgacactcatgaagggggccagccggagatcttggcctctgaatgagggaattatggctgttggccttgtgtccctgctcggcagcgccctgctgaagaacgacgtcccccttgctgggcctatggtggccggaggcctgctcctggcggcctacgttatgtctgggtccagcgctgatctctctctggaaaaagccgctaatgtgcaatgggacgagatggccgatatcaccggatccagccccattatcgaagtcaagcaggacgaggatggctcctttagcatccgcgacgtggaggaaacgaacatgattacacttctggtgaaactggccctcatcaccgtttctgggctgtacccgcttgctattcctgtcaccatggcgctgtggtatatctggcaggtgaagacacagcggagcggagccctctgggatgtgccctcccctgctgccacccaaaaagccacactgtctgagggcgtctacagaattatgcagcgcggcctcttcgggaagacgcaggtgggagttggcatccacatggaaggggtgtttcataccatgtggcacgtcacacggggaagcgtgatctgtcatgagaccggcagactggaaccctcctgggctgacgttcgcaatgatatgatttcttatgggggaggctggcggcttggcgacaagtgggacaaagaggaggatgtgcaggtcctggccatcgaaccggggaagaaccctagacacgtgcaaacaaaacccggactgttcaagaccctcacgggcgagattggggcggttaccctggactttaaacctggaacaagcggctcccccatcattaataagaaagggaaggtgatcggcctttacggaaacggcgtcgtgaccaagtctggggattatgtgagcgctattacacaggccgaacgcatcggagagcccgactacgaggtcgatgaagacatcttccggaaaaagagactgaccattatggatctccatcctggcgccgggaaaacaaagcggatcctgccgtccattgttcgcgaggctctcaaaagacggctgcgcacgcttatcctggcccccaccagagtggtggcggctgaaatggaggaagccctgcggggactccctattagatatcagacacccgccgtcaagagcgagcacaccggccgcgagatcgtggacctgatgtgccacgctacctttacaacgcggcttctgtcttccaccagagttcctaattacaacctcatcgtgatggatgaagcccatttcacagacccctgcagcgtcgctgcccgcgggtacatttctacccgggtggagatgggcgaagcggccgctatctttatgacagccacccctccgggatccattgatcccttccctcagagcaattcccccatcgaggacattgaaagagagatccctgagcgctcttggaacacgggcttcgactggatcacagattatcaagggaagaccgtttggtttgtgcccagcattaaagctggaaatgacatcgccaactgtctgcggaagtccggcaaaagagtcattcagctcagccgcaagaccttcgatacagaatacccgaaaaccaagctgacagactgggattttgtggtcaccacggacatctctgagatgggggccaacttcagagctggacgggtgattgatcctcgcagatgccttaagcccgttatcctgacagacggccccgaacgggtgattctggcggggcctatccccgtgacccctgcctccgctgcccagcgcagaggccggatcggaagaaatccggcccaagaggatgaccagtatgtctttagcggcgatcccctcaaaaacgacgaagatcacgctcattggacagaggccaagatgctgcttgacaatatttacacccctgaggggatcattcccacgctgttcggacctgaacgcgagaaaacccaggcgatcgacggcgaatttcggctcagaggggagcagcgcaagacattcgttgagctgatgcggagaggagatctgcccgtgtggctctcttataaagtggctagcgccggcatttcctacaaggaccgggaatggtgttttaccggcgagcgcaacaatcaaatccttgaagagaacatggaagtcgagatctggacaagagagggggaaaagaaaaagctgcggccgaaatggctggatgcccgcgtgtatgctgaccctatggccctcaaggatttcaaagagtttgcgtctggaagaaagagcaccacactggacattcttaccgaaatcgccacgctgcccacatacctctcctctaaggctaaactggccctggataatattgttatgctccacaccaccgagaagggcgggcgggcttaccagcacgcccttaacgaactgcctgagagcctggagacactcatgctggtggctcttctgggagccatgaccgcgggcatcttcctctttttcatgcaggggaaaggaattggcaagctgtccatgggcctgatcgccatcgctgtcgccagcgggctcctttgggtggctgaaattcagccccaatggatcgccgcctctattatcctggagttctttctgatggtcctcctgattcctgaacccgagaaacagcgcacaccgcaggacaatcagcttatctatgtgattctgacgatcctcaccatcattggactgatcgctgcgaacgaaatgggcctgattgagaagacaaaaaccgatttcgggttttaccaagttaagacagagaccacgatcctcgacgtggatcttagacctgcctccgcttggaccctgtatgccgtcgccacaaccattctgacacccatgctccggcataccatcgaaaatacgagcgctaacctgtcccttgccgcgatcgccaatcaggctgccgtgctgatgggactcggcaaggggtggcccctgcaccgcatggacctgggagttcctctccttgctatgggctgctactctcaggtgaacccgacaaccctgacagccagcctggtcatgctcctgattcattatgcgatcattggccccgggcttcaggccaaagctaccagagaggcccaaaagcggaccgctgccggaatcatgaaaaatcctacagtggatggcattacggtgatcgacctggaacccatctcctacgaccctaagttcgagaaacagctcgggcaggttatgctgctggtcctctgtgtgggacaacttctgctgatgagaaccacatgggctctctgcgaggtgctgacccttgccacaggccccattatgaccctgtgggaagggaaccctggacgcttttggaacacgacaatcgcggtctctaccgccaatattttccggggcagctatctcgctggcgccgggctggctttttccctgatcaagaacgcccagaccccgagacgcggaacaggcaccacaggggagacgctcggagaaaagtggaaacggcagcttaatagcctggatagaaaggagttcgaagagtacaaacgctctggcattctggaggttgaccggaccgaagccaagtccgcgctcagagatgggagcaaaatcaagcacgctgtgtctcgcggatccagcaagattcggtggatcgtggagagaggcatgatcaaacccaagggcaaagtcgtggacctggggtgtggacgcggcgggtggtcttactatatggccacacttaagaacgttaccgaagtgaaaggatacacaaagggcgggcctggacatgaggaacccattcctatggctacctatggctggaatctggtcaagctccacagcggcgtggatgttttttacaaacccacggagcaggtggacaccctgctgtgcgatatcggggagtcctctagcaacccgacaattgaagagggacggaccctcagaatccttaagatggtcgaaccttggctgtccagcaaacccgagttctgtattaaggtgctgaatccctatatgcctacagtgatcgaagagctcgagaaactgcaacgcagacacggcgggtcccttgtccggtgccccctgtctcgcaacagcacccatgaaatgtactgggtttccggagcctctggcaatatcgtgagctccgtgaacacaatttctaagatgctcctgaatagatttaccacgcggcacagaaaacctacatatgagaaggacgtcgatctgggggccggaacccggagcgtgtccaccgaaacagagaagccggacatgacgatcattggccgcagactccagcggcttcaggaggaacataaagagacctggcactacgatcaggaaaacccctaccgcacatgggcttatcacggcagctacgaggccccttctaccgggtccgcgagctctatggttaatggagtggtcaagctgctgacaaaaccctgggacgtgatccctatggttacccaactcgccatgacagacaccacgcccttcggccagcagagagtgtttaaggaaaaagtcgatacccggacaccgcagcctaagctggggacccgcatgattatgacaaccacggctaactggctttgggccctgctcggaaagaaaaagtcccccagactgtgtacacgggaggagttcatcagcaaagtgcgctctaatgctgccatcggcgcggttttccaagaagagcaggggtggacctccgccagcgaagctgtgaacgactccagattttgggagctggtcgataaggaacgggccctccatcaggagggcaaatgcgagagctgcgtgtataatatgatgggaaagcgcgaaaagaaactgggcgagttcgggagagctaagggatctcgggccatttggtacatgtggcttggcgctcgctttctggaattcgaggccctcgggtttctgaacgaagaccactggttcagcagagagaactcctggtctggagtcgagggcgaagggcttcatagcctgggctatatcctcgaggatattgacaaaaaggatggagacctgatctacgcggatgacacagccggctgggatacccggattacggaagacgatctgctcaatgaggagctgatcaccgaacaaatggctcctcaccataaaacacttgccaaggctatctttaagctgacctatcagaacaaagtggttaaggtgctcagacccacacctaaaggggccgtcatggacattatctcccgcaaggaccagcggggatctggccaggtggggacctacggactgaatacattcaccaacatggaggtgcaacttattagacagatggaagccgagggcgttatcacgcaggatgacatgcagaatcccaaagggctgaaggaacgcgtggagaaatggctcaaggagtgtggcgtcgatcggctgaagagaatggcgattagcggagacgattgcgtggttaaaccgctggacgaacgcttttccacatctctcctgttccttaacgatatgggcaaggtgcggaaagacgtccctcaatgggagcccagcaaggggtggaaaaattggcaggaagtgcccttttgttcccaccacttccataagatctttatgaaggatggaagaagcctggtcgtgccttgccgcaaccaggacgagctcattggccgggctagaatctctcagggggccggatggtccctgcgcgaaaccgcctgtcttggcaaagcttacgcccaaatgtggagcctgatgtatttccaccggagagatctccggctggcttctatggccatctgctccgcggttccgaccgagtggttccccacaagcagaaccacatggtccattcatgcccagcaccagtggatgacgaccgaggacatgctgaaggtgtggaatcgcgtctggatcgaagacaaccctaatatgacagataaaacccccgtgcactcttgggaggacattccttacctcgggaagcgggaagatctgtggtgtggcagccttatcggactgtccagcagagctacatgggccaaaaacattcataccgctatcacgcaggttcgcaatctcatcggcaaggaggaatatgtggactacatgcccgtcatgaagagatattctgccccttccgagagcgagggggtgctgtga

SEQ ID NO: 21033 - RNA, 9867 nt, synthetic construct
  misc_feature 1..9867: note = derived and/or modified CDS sequence (opt5) from DENV-4__JQ915089__SS-prME
  source 1..9867: mol_type = other RNA
agcacaatgacactgctctgcctgatccccacggtgatggccttccacctttccaccagagacggcgagcctctgatgattgttgctaagcatgaacgggggagaccgctcctgtttaaaacaaccgagggaatcaacaagtgtacacttattgccatggatctgggcgaaatgtgcgaggacaccgttacatacaaatgtcccctcctggtgaataccgaacctgaggatatcgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccagcgcgtggagtcttggattcttagaaatcctggcttcgctctgctcgccggctttatggcttacatgatcgggcagacaggaatccagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtattgaagctagcatctctaatattaccacagccacccgctgcccgacgcaaggagagccctatcttaaggaggaacaggaccagcagtacatctgtagacgggatgtggtggaccgcggctgggggaacggatgcggcctgttcgggaaaggaggcgtcgtgacatgcgcgaagtttctctgttccggcaaaattaccgggaatctggttcaaatcgagaaccttgaatataccgtggtcgtgacagttcataatggagatacccacgccgtgggcaacgacacaagcaatcacggggtcacggctaccattacacctagatctccctccgtggaggtcaagctgcctgattacggagaactcaccctggactgcgagccccggagcggcatcgacttcaacgagatgatcctgatgaagatgaaaaagaaaacatggctcgtgcataagcagtggtttctggatcttccgctgccttggaccgccggggctgacacgtctgaagttcactggaattacaaagagagaatggtgaccttcaaggtcccccatgccaaacgccaggatgtgacagttctcggctcccaggaaggagccatgcacagcgctctggcgggcgccaccgaggtggactccggggatggaaaccacatgtttgctggccatcttaagtgtaaggtccggatggaaaaactgagaattaaggggatgtcttatacaatgtgcagcggaaaattctccatcgacaaggagatggccgagacccaacacggcacgacagtggtgaaagttaagtacgaaggggccggcgctccttgtaagattcccatcgagattcgcgatgtcaataaagaaaaggtggtgggacggatcatcagctctacccccttcgccgagaacacaaactccgtcattaatatcgagctcgaacctccgtttggcgacagctatattgtgatcggggttggagattctgcgctgaccctgcattggttcagaaaaggcagctccattgggaagatgtttgagtctacctaccgcggagctaaacggatggccatcctcggcgaaacagcctgggacttcgggagcgtgggcggactgtttacgtcccttggcaaggctgtccaccaggtgttcgggagcgtttataccacaatgtttggaggcgtgtcttggatgatccgcattctgatcgggttcctcgtcctgtggattggaaccaactcccgcaatacaagcatggccatgacctgcatcgctgtgggcgggattacgctgtttcttggcttcacagttcaggccgatatgggatgtgtggtctcttggaacggcaaggagctcaaatgcgggtccggaatctttgtggtggacaatgtccatacctggaccgaacaatacaagttccagcccgagagccctgcgcggctggcctccgctattctgaacgcccacaaagacggcgtttgtgggatcagatctacaacccgcctcgagaatgtgatgtggaagcagatcacaaacgaactgaattatgtgctttgggagggaggccacgatctgacggtcgtggctggcgacgttaaaggggtgctcaccaagggaaagcgggtcctgacaccccctgtgaacgatctgaaatacagctggaagacctggggcaaagccaagatttttacacccgaagcgagaaattccaccttccttatcgacgggccggatacgtctgagtgccctaacgaacggcgcgcctggaatttctttgaggttgaggactacggattcggcatgtttaccacaaacatttggatgaaattcagagaagggagctccgaggtgtgtgatcatcggctcatgagcgctgccatcaaggaccagaaagctgtccacgccgatatgggatattggattgaatcttccaagaatcaaacctggcagatcgagaaggccagcctgatcgaagtgaaaacatgcctgtggcccaagacccatacactctggtctaacggcgttctggagtcccagatgcttattcctagaagctacgctggccccttttctcagcacaactatcgccaagggtacgcgacccagacggccggaccttggcacctgggcaaactcgagatcgacttcggggaatgccccggaacaaccgtgaagattcaggaggattgtgaccatcggggcccgagcctgagaaccacaaccgcttccgggaaactggtcacgcagtggtgctgtcgcagctgcacaatgcctccccttagatttctcggagaagatggctgttggtatggcatggagatccggcccctgtctgagaaggaagagaatatggtgaagtcccaagtgaccgccgggcagggaacaagcgaaaccttctccatgggcctgctctgcctgacactttttgtcgaggaatgtctgcgcagacgggttacccgcaaacacatgattctcgtggtggtcatcacgttctgcgccatcattctcgggggactgacctggatggaccttctcagagctctgatcatgctgggcgacacaatgtctgggcggattggaggccagatccatctcgccattatgaccgtgtttaagatgagccctggctacgttctgggggtgttccttcgcaaactgacatccagagagaccgcgctcatggtcatcggaatggctatgacgacagtgttttctatcccgcacgatctgatggagctgattgacggcatcagccttgggctgattctcctgaagatcgttacccatttcgataacacacaggtgggaaccctcgccctgtcccttaccttcattcggtctacaacgcccctggtcatggcctggcgcaccatcatggctgtgtttttcgtcattacactcatccctctgtgtagaaccagctgcctgcaaaaacagtcccactgggtggaaatcacagcccttattctgggcgcgcaggctctccccgtttatctgatgaccctcatgaagggggccagctctcggtcctggcctctgaatgagggaatcatggccgtgggccttgtcagcctgctcggctctgctctgctgaagaacgacgtgccccttgccgggcctatggttgctggaggcctgctcctggccgcgtacgtgatgtccgggagctctgccgatctctccctggaaaaagctgccaatgtccaatgggacgagatggctgatattacgggaagctcccccatcattgaagtgaagcaggacgaggatggcagcttttctatcagagacgtggaggaaacaaacatgatcacccttctggttaaactggccctcattaccgtcagcgggctgtacccgcttgccatccctgtgacaatggctctgtggtatatttggcaagtgaagacccagcgctccggagcgctctgggatgtcccctctcctgccgctacacaaaaagccacgctgagcgagggcgtgtaccggatcatgcagagaggcctcttcgggaagacccaggttggagtgggcattcacatggaaggggtctttcatacaatgtggcacgtgacccgcggatccgttatctgtcatgagacaggccggctggaaccctcttgggccgacgtgagaaatgatatgatcagctatgggggaggctggcgccttggcgacaagtgggacaaagaggaggatgtccaggtgctggctattgaaccggggaagaaccctcggcacgttcaaaccaaacccggactgttcaagacgctcaccggcgagatcggggccgtgacactggactttaaacctggaacctccggctctcccattatcaataagaaagggaaggtcattggcctttacggaaacggcgtggtgacaaagagcggggattatgtctccgcgatcacccaggctgaaagaattggagagcccgactacgagatcgatgaagacatcttccgcaaaaagcggctgacaattatggatctccatcctggcgccgggaaaacgaagagaatcctgccgagcattgttcgggaggccctcaaacgcagactgcggacccttatcctggctcccacacgcgtggtggccgcggaaatggaggaagctctgagaggactccctattcggtatcagacccccgccgtcaagtctgagcacaccggcagagagatcgtggacctgatgtgccacgccacatttacgacccgccttctgtccagcacacgggttcctaattacaacctcatcgtgatggatgaagctcatttcaccgacccctgctctgtcgccgctagagggtacatttccacacgcgtggagatgggcgaagccgcggccatctttatgaccgctacgcctccgggaagcattgatcccttccctcagtccaattctcccatcgaggacattgaacgggagatccctgagagaagctggaacacaggcttcgactggatcaccgattatcaagggaagaccgtttggtttgtgccctccattaaagccggaaatgacatcgctaactgtctgcgcaagagcggcaaacgggtcattcagctctctagaaagacattcgataccgaatacccgaaaacaaagctgaccgactgggattttgtggtcacgacagacatctccgagatgggggccaacttccgcgccggaagagtgattgatcctcggcgctgccttaagcccgttatcctgaccgacggccccgaaagagtgattctggctgggcctatccccgtgacccctgcgagcgccgctcagcggcgcggcagaatcggacggaatccggcccaagaggatgaccagtatgtcttttctggcgatcccctcaaaaacgacgaagatcacgcccattggaccgaggctaagatgctgcttgacaatatttacacgcctgaggggatcattcccaccctgttcggacctgaaagagagaaaacacaggccatcgacggcgaatttcgcctcagaggggagcagcggaagaccttcgttgagctgatgcgccggggagatctgcccgtgtggctcagctataaagtggcgtccgctggcatttcttacaaggacagagaatggtgttttacaggcgagcggaacaatcaaatccttgaagagaacatggaagtcgagatctggacccgcgagggggaaaagaaaaagctgagaccgaaatggctggatgcccgggtgtatgccgaccctatggctctcaaggatttcaaagagtttgccagcggacgcaagtccacaaccctggacattcttacggaaatcgcgacactgcccacctacctctctagcaaggccaaactggctctggataatattgttatgctccacaccacagagaagggcgggagagcctaccagcacgctcttaacgaactgcctgagtccctggagaccctcatgctggtggcccttctgggagctatgacagccggcatcttcctctttttcatgcaggggaaaggaattggcaagctgagcatgggcctgatcgcgatcgccgtcgcttctgggctcctttgggtggccgaaattcagccccaatggatcgctgcctccattatcctggagttctttctgatggtcctcctgattcctgaacccgagaaacagcggacgccgcaggacaatcagcttatctatgtgattctgaccatcctcacaatcattggactgatcgccgctaacgaaatgggcctgattgagaagaccaaaacagatttcgggttttaccaagttaagaccgagacgaccatcctcgacgtggatcttcgccctgcgagcgcctggacactgtatgctgtcgccaccacaattctgacccccatgctcagacatacgatcgaaaatacatccgccaacctgtctcttgctgccatcgcgaatcaggccgctgtgctgatgggactcggcaaggggtggcccctgcaccggatggacctgggagttcctctccttgccatgggctgctacagccaggtgaacccgaccacactgaccgcttccctggtcatgctcctgattcattatgccatcattggccccgggcttcaggcgaaagccacccgcgaggctcaaaagagaacagccgctggaatcatgaaaaatcctacggtggatggcattaccgtgatcgacctggaacccatctcttacgaccctaagttcgagaaacagctcgggcaggttatgctgctggtcctctgtgtgggacaacttctgctgatgcggacaacctgggccctctgcgaggtgctgacacttgctaccggccccattatgacgctgtgggaagggaaccctggaagattttggaacacaaccatcgccgtcagcaccgcgaatattttccgcggctcctatctcgccggcgctgggctggcctttagcctgatcaagaacgctcagacaccgcggagaggaaccggcacaacgggggagaccctcggagaaaagtggaaacgccagcttaattctctggatcggaaggagttcgaagagtacaaaagatccggcattctggaggttgaccgcacagaagccaagagcgccctccgggatgggtctaaaatcaagcacgcggtgtccagaggaagctctaagattcgctggatcgtggagcggggcatgatcaaacccaagggcaaagtcgtggacctggggtgtggaagaggcgggtggagctactatatggctacccttaagaacgttacagaagtgaaaggatacaccaagggcgggcctggacatgaggaacccattcctatggccacgtatggctggaatctggtcaagctccactccggcgtggatgtcttttacaaacccaccgaacaggtggacacactgctgtgcgatatcggggagtctagctccaacccgaccattgaagagggacgcacactccggatccttaagatggtcgaaccttggctgagctccaaacccgagttctgtattaaggtgctgaatccctatatgcctaccgtgatcgaagaactggagaaactgcaaagacgccacggcgggtctcttgtcagatgccccctgagccggaactccacacatgaaatgtactgggtttctggagctagcggcaatatcgtgtcctctgtgaacaccattagcaagatgctcctgaatcgctttacgacaagacaccggaaacctacctatgagaaggacgtcgatctgggggccggaaccagatccgtgagcacagaaacggagaagccggacatgaccatcattggccggcgcctccagagacttcaggaggaacataaagagacatggcactacgatcaggaaaacccctaccggacctgggcctatcacggctcttacgaggctccttccacagggagcgcctcttccatggttaatggagtggtcaagctgctgaccaaaccctgggacgtgatccctatggttacacaactcgcgatgaccgacacgacccccttcggccagcagcgcgtgtttaaggaaaaagtcgatacaagaaccccgcagcctaagctggggacacggatgattatgaccacgacagccaactggctttgggctctgctcggaaagaaaaagagcccccgcctgtgtaccagagaggagttcatctctaaagtgcggtccaatgccgctatcggcgccgttttccaagaggagcaggggtggacaagcgcgtccgaagccgtgaacgacagccgcttttgggagctggtcgataaggaaagagctctccatcaggagggcaaatgcgagtcttgcgtgtataatatgatgggaaagcgggaaaagaaactgggcgagttcgggcgcgccaagggaagcagagctatttggtacatgtggcttggcgcccggtttctggagttcgaggctctcgggtttctgaacgaagaccactggttctcccgcgagaactcttggagcggagtcgagggcgaagggcttcatagactgggctatatcctcgaggatattgacaaaaaggatggagacctgatctacgccgatgacaccgcgggctgggatacgcggattaccgaagacgatctgctcaatgaggagctgatcacagaacaaatggcccctcaccataaaacccttgctaaggccatctttaagctgacatatcagaacaaagtggttaaggtgctcagacccacccctaaaggggctgtcatggacattatctcccgcaaggaccagcggggatctggccaggtggggacatacggactgaataccttcacgaacatggaggtgcaacttattagacagatggaagccgagggcgttatcacacaggatgacatgcagaatcccaaagggctgaaggaacgcgtggagaaatggctcaaggagtgtggcgtcgatcggctgaagagaatggccattagcggagacgattgcgtggttaaaccgctggacgaacgcttttccacctctctcctgttccttaacgatatgggcaaggtgcggaaagacgtccctcaatgggagcccagcaaggggtggaaaaattggcaggaagtgcccttttgttcccaccacttccataagatctttatgaaggatggaagaagcctggtcgtgccttgccgcaaccaggacgagctcattggccgggcgagaatctctcagggggctggatggtccctgcgcgaaaccgcctgtcttggcaaagcctacgctcaaatgtggagcctgatgtatttccaccggagagatctccggctggcctctatggctatctgctccgccgttccgacagagtggttccccaccagcagaacaacgtggtccattcatgcgcagcaccagtggatgaccacagaggacatgctgaaggtgtggaatcgcgtctggatcgaagacaaccctaatatgaccgataaaacacccgtgcactcttgggaggacattccttacctcgggaagcgggaagatctgtggtgtggcagccttatcggactgtccagcagagccacctgggctaaaaacattcatacggccatcacccaggttcgcaatctcatcggcaaggaggaatatgtggactacatgcccgtcatgaagagatattctgctccttccgagagcgagggggtgctgtga

SEQ ID NO: 21034 - RNA, 9867 nt, synthetic construct
  misc_feature 1..9867: note = derived and/or modified CDS sequence (opt5) from DENV-4__JQ915082__SS-prME
  source 1..9867: mol_type = other RNA
agcaccatgacactgctctgcctgatccccacggtgatggccttccacctttccaccagagacggcgagcctctgatgattgtcgctaagcatgaacgggggcgcccgctcctgtttaaaacaaccgagggaatcaacaagtgtacacttattgccatggatctgggcgaaatgtgcgaggacaccgttacatacaaatgtcccctcctggtgaataccgaacctgaggatatcgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggattcttagaaatcctggcttcgctctgctcgccggctttatggcttacatgatcgggcagacaggaatccagcggattgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcaccacaatggcccaggggaagcctaccctggattttgaactgaccaagacaacggctaaagaggttgccctcctgcggacctactgtatcgaagctagcatttctaatatcacaaccgccacacgctgcccgacccaaggagagccctatcttaaggaggaacaggaccagcagtacatttgtagacgggatgtggtggaccgcggctgggggaacggatgcggcctgttcgggaaaggaggcgtcgtgacgtgcgcgaagtttctctgttccggcaaaatcacagggaatctggttcaaattgagaaccttgaatataccgtggtcgtgaccgttcataatggagatacacacgccgtgggcaacgacaccagcaatcacggggtcacagctacgatcacccctagatctccctccgtggaggtcaagctgcctgattacggagaactcacactggactgcgagccccggagcggcatcgacttcaacgagatgattctgatgaagatgaaaaagaaaacctggctcgtgcataagcagtggtttctggatcttccgctgccttggacagccggggctgacacctctgaagttcactggaattacaaagagagaatggtgacgttcaaggtcccccatgccaaacgccaggatgtgaccgttctcggctcccaggaaggagccatgcacagcgctctggcgggcgccacagaggtggactccggggatggaaaccacatgtttgctggccatcttaagtgtaaggtccggatggaaaaactgagaatcaaggggatgtcttataccatgtgcagcggaaaattctccattgacaaggagatggccgagacacaacacggcaccacggtggtgaaagttaagtacgaaggggccggcgctccttgtaagatccccattgagatccgcgatgtcaataaagaaaaggtggtgggacggatcattagctctacacccttcgccgagaacaccaactccgtcatcaatattgagctcgaacctccgtttggcgacagctatatcgtgattggggttggagattctgcgctgacactgcattggttcagaaaaggcagctccatcgggaagatgtttgagtctacctaccgcggagctaaacggatggccatcctcggcgaaaccgcctgggacttcgggagcgtgggcggactgtttacatcccttggcaaggctgtccaccaggtgttcgggagcgtttatacgaccatgtttggaggcgtgtcttggatgattagaatcctgattgggttcctcgtcctgtggatcggaacaaactcccgcaataccagcatggccatgacatgcattgctgtgggcgggatcaccctgtttcttggcttcacggttcaggccgatatgggatgtgtggtctcttggaacggcaaggagctcaaatgcgggtccggaatttttgtggtggacaatgtccatacatggaccgaacaatacaagttccagcccgagagccctgcgcggctggcctccgctatcctgaacgcccacaaagacggcgtttgtgggatcagatctaccacacgcctcgagaatgtgatgtggaagcagattaccaacgaactgaattatgtgctttgggagggaggccacgatctgacagtcgtggctggcgacgttaaaggggtgctcacgaagggaaagcgggccctgaccccccctgtcaacgatctgaaatacagctggaagacatggggcaaagcgaagatctttacccccgaagccagaaattccacattccttattgacgggccggatacctctgagtgccctaacgaacggcgcgcttggaatttctttgaggtggaggactacggattcggcatgtttacgaccaacatctggatgaaattcagagaagggagctccgaggtttgtgatcatcggctcatgagcgccgctattaaggaccagaaagccgtgcacgccgatatgggatattggatcgaatcttccaagaatcaaacatggcagatcgagaaggctagcctgattgaagtcaaaacctgcctgtggcccaagacacataccctctggtctaacggcgtgctggagtcccagatgcttatccctagaagctacgcgggccccttttctcagcacaactatcgccaagggtacgccacacagaccgctggaccttggcacctgggcaaactcgagattgacttcggggaatgccccggaacgacagttaagatccaggaggattgtgaccatcggggcccgagcctgagaaccaccacagcctccgggaaactggtgacccagtggtgctgtcgcagctgcacgatgcctccccttagatttctcggagaagatggctgttggtatggcatggagattcggcccctgtctgagaaggaagagaatatggtcaagtcccaagtgacagccgggcagggaaccagcgaaacattctccatgggcctgctctgcctgaccctttttgtggaggaatgtctgcgcagacgggtcacacgcaaacacatgatcctcgttgtggtgatcaccttctgcgctattatcctggggggactgacgtggatggaccttctcagagccctgattatgctgggcgacaccatgtctgggcggatcggaggccagattcatctcgcgatcatgacagtctttaagatgagccctggctacgtgctgggggttttccttcgcaaactgacctccagagagacagctctcatggtgatcggaatggccatgaccacggtcttttctattccgcacgatctgatggagctgatcgacggcattagccttgggctgatcctcctgaagattgtgacacatttcgataacacccaggttggaacactcgccctgtcccttaccttcatccggtctaccacacccctggtgatggcttggcgcacgattatggccgtctttttcgtgatcaccctcatccctctgtgtagaacaagctgcctgcaaaaacagtcccactgggtcgaaattaccgcgcttatcctgggcgctcaggccctccccgtgtatctgatgacactcatgaagggggccagccggagatcttggcctctgaatgagggaattatggctgttggccttgtgtccctgctcggcagcgccctgctgaagaacgacgtcccccttgctgggcctatggtggccggaggcctgctcctggcggcctacgttatgtctgggtccagcgctgatctctctctggaaaaagccgctaatgtgcaatgggacgagatggccgatatcaccggatccagccccattatcgaagtcaagcaggacgaggatggctcctttagcatccgcgacgtggaggaaacgaacatgattacacttctggtgaaactggccctcatcaccgtttctgggctgtacccgcttgctattcctgtcaccatggcgctgtggtatatctggcaggtgaagacacagcggagcggagccctctgggatgtgccctcccctgctgccacccaaaaagccacactgtctgagggcgtctacagaattatgcagcgcggcctcttcgggaagacgcaggtgggagttggcatccacatggaaggggtgtttcataccatgtggcacgtcacacggggaagcgtgatctgtcatgagaccggcagactggaaccctcctgggctgacgttcgcaatgatatgatttcttatgggggaggctggcggcttggcgacaagtgggacaaagaggaggatgtgcaggtcctggccatcgaaccggggaagaaccctagacacgtgcaaacaaaacccggactgttcaagaccctcacgggcgagattggggcggttaccctggactttaaacctggaacaagcggctcccccatcattaataagaaagggaaggtgatcggcctttacggaaacggcgtcgtgaccaagtctggggattatgtgagcgctattacacaggccgaacgcatcggagagcccgactacgaggtcgatgaagacatcttccggaaaaagagactgaccattatggatctccatcctggcgccgggaaaacaaagcggatcctgccgtccattgttcgcgaggctctcaaaagacggctgcgcacgcttatcctggcccccaccagagtggtggcggctgaaatggaggaagccctgcggggactccctattagatatcagacacccgccgtcaagagcgagcacaccggccgcgagatcgtggacctgatgtgccacgctacctttacaacgcggcttctgtcttccaccagagttcctaattacaacctcatcgtgatggatgaagcccatttcacagacccctgcagcgtcgctgcccgcgggtacatttctacccgggtggagatgggcgaagcggccgctatctttatgacagccacccctccgggatccattgatcccttccctcagagcaattcccccatcgaggacattgaaagagagatccctgagcgctcttggaacacgggcttcgactggatcacagattatcaagggaagaccgtttggtttgtgcccagcattaaagctggaaatgacatcgccaactgtctgcggaagtccggcaaaagagtcattcagctcagccgcaagaccttcgatacagaatacccgaaaaccaagctgacagactgggattttgtggtcaccacggacatctctgagatgggggccaacttcagagctggacgggtgattgatcctcgcagatgccttaagcccgttatcctgacagacggccccgaacgggtgattctggcggggcctatccccgtgacccctgcctccgctgcccagcgcagaggccggatcggaagaaatccggcccaagaggatgaccagtatgtctttagcggcgatcccctcaaaaacgacgaagatcacgctcattggacagaggccaagatgctgcttgacaatatttacacccctgaggggatcattcccacgctgttcggacctgaacgcgagaaaacccaggcgatcgacggcgaatttcggctcagaggggagcagcgcaagacattcgttgagctgatgcggagaggagatctgcccgtgtggctctcttataaagtggctagcgccggcatttcctacaaggaccgggaatggtgttttaccggcgagcgcaacaatcaaatccttgaagagaacatggaagtcgagatctggacaagagagggggaaaagaaaaagctgcggccgaaatggctggatgcccgcgtgtatgctgaccctatggccctcaaggatttcaaagagtttgcgtctggaagaaagagcaccacactggacattcttaccgaaatcgccacgctgcccacatacctctcctctaaggctaaactggccctggataatattgttatgctccacaccaccgagaagggcgggcgggcttaccagcacgcccttaacgaactgcctgagagcctggagacactcatgctggtggctcttctgggagccatgaccgcgggcatcttcctctttttcatgcaggggaaaggaattggcaagctgtccatgggcctgatcgccatcgctgtcgccagcgggctcctttgggtggctgaaattcagccccaatggatcgccgcctctattatcctggagttctttctgatggtcctcctgattcctgaacccgagaaacagcgcacaccgcaggacaatcagcttatctatgtgattctgacgatcctcaccatcattggactgatcgctgcgaacgaaatgggcctgattgagaagacaaaaaccgatttcgggttttaccaagttaagacagagaccacgatcctcgacgtggatcttagacctgcctccgcttggaccctgtatgccgtcgccacaaccattctgacacccatgctccggcataccatcgaaaatatgagcgctaacctgtcccttgccgcgatcgccaatcaggctgccgtgctgatgggactcggcaaggggtggcccctgcaccgcatggacctgggagttcctctccttgctatgggctgctactctcaggtgaacccgacgacactgaccgccagcctggtcatgctcctgattcattatgcgatcattggccccgggcttcaggccaaagctacaagagaggcccaaaagcggaccgctgccggaatcatgaaaaatcctaccgtggatggcattacagtgatcgacctggaacccatctcctacgaccctaagttcgagaaacagctcgggcaggttatgctgctggtcctctgtgtgggacaacttctgctgatgagaacgacctgggctctctgcgaggtgctgacacttgccaccggccccattatcacactgtgggaagggaaccctggacgcttttggaacaccacgattgcggtctctacagccaatatcttccggggcagctatctcgctggcgccgggctggctttttccctgattaagaacgcccagaccccgagacgcggaaccggcacaaccggggagacactcggagaaaagtggaaacggcagcttaatagcctggatagaaaggagttcgaagagtacaaacgctctggcatcctggaggttgaccggacggaagccaagtccgcgctcagagatgggagcaaaattaagcacgctgtgtctcgcggatccagcaagatccggtggatcgtggagagaggcatgattaaacccaagggcaaagtcgtggacctggggtgtggacgcggcgggtggtcttactatatggccacccttaagaacgttacagaagtgaaaggatacaccaagggcgggcctggacatgaggaacccatccctatggctacatatggctggaatctggtcaagctccacagcggcgtggatgttttttacaaacccaccgagcaggtggacacgctgctgtgcgatattggggagtcctctagcaacccgaccatcgaagagggacggacactcagaattcttaagatggtcgaaccttggctgtccagcaaacccgagttctgtatcaaggtgctgaatccctatatgcctaccgtgatcgaagagctcgagaaactgcaacgcagacacggcgggtcccttgtccggtgccccctgtctcgcaacagcacacatgaaatgtactgggtttccggagcctctggcaatattgtgagctccgtgaacaccatctctaagatgctcctgaatagatttacaacccggcacagaaaacctacgtatgagaaggacgtcgatctgggggccggaacacggagcgtgtccaccgaaaccgagaagccggacatgacaattatcggccgcagactccagcggcttcaggaggaacataaagagacgtggcactacgatcaggaaaacccctaccgcacctgggcttatcacggcagctacgaggccccttctacagggtccgcgagctctatggttaatggagtggtcaagctgctgaccaaaccctgggacgtgattcctatggttacacaactcgccatgaccgacacaacccccttcggccagcagagagtgtttaaggaaaaagtcgatacgcggaccccgcagcctaagctggggacacgcatgatcatgaccacaaccgctaactggctttgggccctgctcggaaagaaaaagtcccccagactgtgtacgcgggaggagttcatcagcaaagtgcgctctaatgctgccattggcgcggttttccaagaagagcaggggtggacatccgccagcgaagctgtgaacgactccagattttgggagctggtcgataaggaacgggccctccatcaggagggcaaatgcgagagctgcgtgtataatatgatgggaaagcgcgaaaagaaactgggcgagttcgggagagctaagggatctcgggccatctggtacatgtggcttggcgctcgctttctggaattcgaggccctcgggtttctgaacgaagaccactggttcagcagagagaactcctggtctggagtcgagggcgaagggcttcatcggctgggctatattctcgaggatatcgacaaaaaggatggagacctgatttacgcggatgacaccgccggctgggatacaagaatcaccgaagacgatctgctcaatgaggagctgatcacggaacaaatggctcctcaccataaaacccttgccaaggctatttttaagctgacatatcagaacaaagtggttaaggtgctccgccccacccctaaaggggccgtcatggacatcattagccggaaggaccagagaggatccggccaggtggggacatacggactgaataccttcacaaacatggaggtgcaacttatccgccagatggaagccgagggcgttattacccaggatgacatgcagaatcccaaagggctgaaggaacgggtggagaaatggctcaaggagtgtggcgtcgatagactgaagcgcatggcgatctctggagacgattgcgtggttaaaccgctggacgaacggtttagcacgtccctcctgttccttaacgatatgggcaaggtgagaaaagacgtccctcaatgggatccctctaaggggtggaaaaattggcaggaggtgcccttttgtagccaccacttccataagatttttatgaaggacggacgctccctggtcgtgccttgccggaaccaggatgaactcatcggcagagctcgcatcagccagggggccggatggtctctgcgggagacagcctgtcttggcaaagcttacgcccaaatgtggtccctgatgtatttccacagacgggacctcagactggctagcatggccatttgctctgcggttccgaccgaatggttccccacctcccgcacaacctggagcatccatgcccagcaccagtggatgacaacggaggacatgctgaaggtgtggaatcgggtctggattgaggataaccctaatatgaccgacaaaacacccgtgcactcctgggaagatatcccttacctcgggaagagagaggacctgtggtgtggctctcttattggactgagctcccgcgctacctgggccaaaaacatccatacagctatcacccaggttagaaatctcattggcaaggaagagtatgtggattacatgcccgtcatgaagcggtatagcgccccttctgaatccgagggggtgctgtga

SEQ ID NO: 21035 - RNA, 9867 nt, synthetic construct
  misc_feature 1..9867: note = derived and/or modified CDS sequence (opt5) from DENV-4__JQ915081__SS-prME
  source 1..9867: mol_type = other RNA
agcaccatgacactgctctgcctgatccccacggtgatggccttccacctttccaccagagacggcgagcctctgatgattgtcgctaagcatgaacgggggcgcccgctcctgtttaaaacaaccgagggaatcaacaagtgtacacttattgccatggatctgggcgaaatgtgcgaggacaccgttacatacaaatgtcccctcctggtgaataccgaacctgaggatatcgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggattcttagaaatcctggcttcgctctgctcgccggctttatggcttacatgatcgggcagacaggaatccagcggattgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcaccacaatggcccaggggaagcctaccctggattttgaactgaccaagacaacggctaaagaggttgccctcctgcggacctactgtatcgaagctagcatttctaatatcacaaccgccacacgctgcccgacccaaggagagccctatcttaaggaggaacaggaccagcagtacatttgtagacgggatgtggtggaccgcggctgggggaacggatgcggcctgttcgggaaaggaggcgtcgtgacgtgcgcgaagtttctctgttccggcaaaatcacagggaatctggttcaaattgagaaccttgaatataccgtggtcgtgaccgttcataatggagatacacacgccgtgggcaacgacaccagcaatcacggggtcacagctacgatcacccctagatctccctccgtggaggtcaagctgcctgattacggagaactcacactggactgcgagccccggagcggcatcgacttcaacgagatgattctgatgaagatgaaaaagaaaacctggctcgtgcataagcagtggtttctggatcttccgctgccttggacagccggggctgacacctctgaagttcactggaattacaaagagagaatggtgacgttcaaggtcccccatgccaaacgccaggatgtgaccgttctcggctcccaggaaggagccatgcacagcgctctggcgggcgccacagaggtggactccggggatggaaaccacatgtttgctggccatcttaagtgtaaggtccggatggaaaaactgagaatcaaggggatgtcttataccatgtgcagcggaaaattctccattgacaaggagatggccgagacacaacacggcaccacggtggtgaaagttaagtacgaaggggccggcgctccttgtaagatccccattgagatccgcgatgtcaataaagaaaaggtggtgggacggatcattagctctacacccttcgccgagaacaccaactccgtcatcaatattgagctcgaacctccgtttggcgacagctatatcgtgattggggttggagattctgcgctgacactgcattggttcagaaaaggcagctccatcgggaagatgtttgagtctacctaccgcggagctaaacggatggccatcctcggcgaaaccgcctgggacttcgggagcgtgggcggactgtttacatcccttggcaaggctgtccaccaggtgttcgggagcgtttatacgaccatgtttggaggcgtgtcttggatgattagaatcctgattgggttcctcgtcctgtggatcggaacaaactcccgcaataccagcatggccatgacatgcattgctgtgggcgggatcaccctgtttcttggcttcacggttcaggccgatatgggatgtgtggtctcttggaacggcaaggagctcaaatgcgggtccggaatttttgtggtggacaatgtccatacatggaccgaacaatacaagttccagcccgagagccctgcgcggctggcctccgctatcctgaacgcccacaaagacggcgtttgtgggatcagatctaccacacgcctcgagaatgtgatgtggaagcagattaccaacgaactgaattatgtgctttgggagggaggccacgatctgacagtcgtggctggcgacgttaaaggggtgctcacgaagggaaagcgggccctgaccccccctgtcaacgatctgaaatacagctggaagacatggggcaaagcgaagatctttacccccgaagccagaaattccacattccttattgacgggccggatacctctgagtgccctaacgaacggcgcgcttggaatttctttgaggtggaggactacggattcggcatgtttacgaccaacatctggatgaaattcagagaagggagctccgaggtttgtgatcatcggctcatgagcgccgctattaaggaccagaaagccgtgcacgccgatatgggatattggatcgaatcttccaagaatcaaacatggcagatcgagaaggctagcctgattgaagtcaaaacctgcctgtggcccaagacacataccctctggtctaacggcgtgctggagtcccagatgcttatccctagaagctacgcgggccccttttctcagcacaactatcgccaagggtacgccacacagaccgctggaccttggcacctgggcaaactcgagattgacttcggggaatgccccggaacgacagttaagatccaggaggattgtgaccatcggggcccgagcctgagaaccaccacagcctccgggaaactggtgacccagtggtgctgtcgcagctgcacgatgcctccccttagatttctcggagaagatggctgttggtatggcatggagattcggcccctgtctgagaaggaagagaatatggtcaagtcccaagtgacagccgggcagggaaccagcgaaacattctccatgggcctgctctgcctgaccctttttgtggaggaatgtctgcgcagacgggtcacacgcaaacacatgatcctcgttgtggtgatcaccttctgcgctattatcctggggggactgacgtggatggaccttctcagagccctgattatgctgggcgacaccatgtctgggcggatcggaggccagattcatctcgcgatcatgacagtctttaagatgagccctggctacgtgctgggggttttccttcgcaaactgacctccagagagacagctctcatggtgatcggaatggccatgaccacggtcttttctattccgcacgatctgatggagctgatcgacggcattagccttgggctgatcctcctgaagattgtgacacatttcgataacacccaggttggaacactcgccctgtcccttaccttcatccggtctaccacacccctggtgatggcttggcgcacgattatggccgtctttttcgtgatcaccctcatccctctgtgtagaacaagctgcctgcaaaaacagtcccactgggtcgaaattaccgcgcttatcctgggcgctcaggccctccccgtgtatctgatgacactcatgaagggggccagccggagatcttggcctctgaatgagggaattatggctgttggccttgtgtccctgctcggcagcgccctgctgaagaacgacgtcccccttgctgggcctatggtggccggaggcctgctcctggcggcctacgttatgtctgggtccagcgctgatctctctctggaaaaagccgctaatgtgcaatgggacgagatggccgatatcaccggatccagccccattatcgaagtcaagcaggacgaggatggctcctttagcatccgcgacgtggaggaaacgaacatgattacacttctggtgaaactggccctcatcaccgtttctgggctgtacccgcttgctattcctgtcaccatggcgctgtggtatatctggcaggtgaagacacagcggagcggagccctctgggatgtgccctcccctgctgccacccaaaaagccacactgtctgagggcgtctacagaattatgcagcgcggcctcttcgggaagacgcaggtgggagttggcatccacatggaaggggtgtttcataccatgtggcacgtcacacggggaagcgtgatctgtcatgagaccggcagactggaaccctcctgggctgacgttcgcaatgatatgatttcttatgggggaggctggcggcttggcgacaagtgggacaaagaggaggatgtgcaggtcctggccatcgaaccggggaagaaccctagacacgtgcaaacaaaacccggactgttcaagaccctcacgggcgagattggggcggttaccctggactttaaacctggaacaagcggctcccccatcattaataagaaagggaaggtgatcggcctttacggaaacggcgtcgtgaccaagtctggggattatgtgagcgctattacacaggccgaacgcatcggagagcccgactacgaggtcgatgaagacatcttccggaaaaagagactgaccattatggatctccatcctggcgccgggaaaacaaagcggatcctgccgtccattgttcgcgaggctctcaaaagacggctgcgcacgcttatcctggcccccaccagagtggtggcggctgaaatggaggaagccctgcggggactccctattagatatcagacacccgccgtcaagagcgagcacaccggccgcgagatcgtggacctgatgtgccacgctacctttacaacgcggcttctgtcttccaccagagttcctaattacaacctcatcgtgatggatgaagcccatttcacagacccctgcagcgtcgctgcccgcgggtacatttctacccgggtggagatgggcgaagcggccgctatctttatgacagccacccctccgggatccattgatcccttccctcagagcaattcccccatcgaggacattgaaagagagatccctgagcgctcttggaacacgggcttcgactggatcacagattatcaagggaagaccgtttggtttgtgcccagcattaaagctggaaatgacatcgccaactgtctgcggaagtccggcaaaagagtcattcagctcagccgcaagaccttcgatacagaatacccgaaaaccaagctgacagactgggattttgtggtcaccacggacatctctgagatgggggccaacttcagagctggacgggtgattgatcctcgcagatgccttaagcccgttatcctgacagacggccccgaacgggtgattctggcggggcctatccccgtgacccctgcctccgctgcccagcgcagaggccggatcggaagaaatccggcccaagaggatgaccagtatgtctttagcggcgatcccctcaaaaacgacgaagatcacgctcattggacagaggccaagatgctgcttgacaatatttacacccctgaggggatcattcccacgctgttcggacctgaacgcgagaaaacccaggcgatcgacggcgaatttcggctcagaggggagcagcgcaagacattcgttgagctgatgcggagaggagatctgcccgtgtggctctcttataaagtggctagcgccggcatttcctacaaggaccgggaatggtgttttaccggcgagcgcaacaatcaaatccttgaagagaacatggaagtcgagatctggacaagagagggggaaaagaaaaagctgcggccgaaatggctggatgcccgcgtgtatgctgaccctatggccctcaaggatttcaaagagtttgcgtctggaagaaagagcaccacactggacattcttaccgaaatcgccacgctgcccacatacctctcctctaaggctaaactggccctggataatattgttatgctccacaccaccgagaagggcgggcgggcttaccagcacgcccttaacgaactgcctgagagcctggagacactcatgctggtggctcttctgggagccatgaccgcgggcatcttcctctttttcatgcaggggaaaggaattggcaagctgtccatgggcctgatcgccatcgctgtcgccagcgggctcctttgggtggctgaaattcagccccaatggatcgccgcctctattatcctggagttctttctgatggtcctcctgattcctgaacccgagaaacagcgcacaccgcaggacaatcagcttatctatgtgattctgacgatcctcaccatcattggactgatcgctgcgaacgaaatgggcctgattgagaagacaaaaaccgatttcgggttttaccaagttaagacagagaccacgatcctcgacgtggatcttagacctgcctccgcttggaccctgtatgccgtcgccacaaccattctgacacccatgctccggcataccatcgaaaatatgagcgctaacctgtcccttgccgcgatcgccaatcaggctgccgtgctgatgggactcggcaaggggtggcccctgcaccgcatggacctgggagttcctctccttgctatgggctgctactctcaggtgaacccgacgacactgaccgccagcctggtcatgctcctgattcattatgcgatcattggccccgggcttcaggccaaagctacaagagaggcccaaaagcggaccgctgccggaatcatgaaaaatcctaccgtggatggcattacagtgatcgacctggaacccatctcctacgaccctaagttcgagaaacagctcgggcaggttatgctgctggtcctctgtgtgggacaacttctgctgatgagaacgacctgggctctctgcgaggtgctgacacttgccaccggccccattatcacactgtgggaagggaaccctggacgcttttggaacaccacgattgcggtctctacagccaatatcttccggggcagctatctcgctggcgccgggctggctttttccctgattaagaacgcccagaccccgagacgcggaaccggcacaaccggggagacactcggagaaaagtggaaacggcagcttaatagcctggatagaaaggagttcgaagagtacaaacgctctggcatcctggaggttgaccggacggaagccaagtccgcgctcagagatgggagcaaaattaagcacgctgtgtctcgcggatccagcaagatccggtggatcgtggagagaggcatgattaaacccaagggcaaagtcgtggacctggggtgtggacgcggcgggtggtcttactatatggccacccttaagaacgttacagaagtgaaaggatacaccaagggcgggcctggacatgaggaacccatccctatggctacatatggctggaatctggtcaagctccacagcggcgtggatgttttttacaaacccaccgagcaggtggacacgctgctgtgcgatattggggagtcctctagcaacccgaccatcgaagagggacggacactcagaattcttaagatggtcgaaccttggctgtccagcaaacccgagttctgtatcaaggtgctgaatccctatatgcctaccgtgatcgaagagctcgagaaactgcaacgcagacacggcgggtcccttgtccggtgccccctgtctcgcaacagcacacatgaaatgtactgggtttccggagcctctggcaatattgtgagctccgtgaacaccatctctaagatgctcctgaatagatttacaacccggcacagaaaacctacgtatgagaaggacgtcgatctgggggccggaacacggagcgtgtccattgaaaccgagaagccggacatgaccatcattggccgcagactccagcggcttcaggaggaacataaagagacatggcactacgatcaggaaaacccctaccgcacgtgggcttatcacggcagctacgaggccccttctaccgggtccgcgagctctatggttaatggagtggtcaagctgctgacaaaaccctgggacgtgatccctatggttacccaactcgccatgacagacaccacacccttcggccagcagagagtgtttaaggaaaaagtcgatacccggacgccgcagcctaagctggggacccgcatgatcatgacaaccacagctaactggctttgggccctgctcggaaagaaaaagtcccccagactgtgtacccgggaggagttcattagcaaagtgcgctctaatgctgccatcggcgcggttttccaagaagagcaggggtggacgtccgccagcgaagctgtgaacgactccagattttgggagctggtcgataaggaacgggccctccatcaggagggcaaatgcgagagctgcgtgtataatatgatgggaaagcgcgaaaagaaactgggcgagttcgggagagctaagggatctcgggccatttggtacatgtggcttggcgctcgctttctggaattcgaggccctcgggtttctgaacgaagaccactggttcagcagagagaactcctggtctggagtcgagggcgaagggcttcatcggctgggctatatcctcgaggatattgacaaaaaggatggagacctgatctacgcggatgacacagccggctgggataccagaatcacagaagacgatctgctcaatgaggagctgattaccgaacaaatggctcctcaccataaaacgcttgccaaggctatctttaagctgacctatcagaacaaagtggttaaggtgctccgccccacacctaaaggggccgtcatggacattatcagccggaaggaccagagaggatccggccaggtggggacctacggactgaatacattcaccaacatggaggtgcaacttattcgccagatggaagccgagggcgttatcacacaggatgacatgcagaatcccaaagggctgaaggaacgggtggagaaatggctcaaggagtgtggcgtcgatagactgaagcgcatggcgatttctggagacgattgcgtggttaaaccgctggacgaacggtttagcacctccctcctgttccttaacgatatgggcaaggtgagaaaagacgtccctcaatgggatccctctaaggggtggaaaaattggcaggaggtgcccttttgtagccaccacttccataagatctttatgaaggacggacgctccctggtcgtgccttgccggaaccaggatgaactcatcggcagagctcgcattagccagggggccggatggtctctgcgggagacggcctgtcttggcaaagcttacgcccaaatgtggtccctgatgtatttccacagacgggacctcagactggctagcatggccatctgctctgcggttccgacagaatggttccccacctcccgcaccacatggagcattcatgcccagcaccagtggatgaccacagaggacatgctgaaggtgtggaatcgggtctggatcgaggataaccctaatatgacggacaaaacccccgtgcactcctgggaagatattccttacctcgggaagagagaggacctgtggtgtggctctcttatcggactgagctcccgcgctacatgggccaaaaacatccataccgctattacacaggttagaaatctcatcggcaaggaagagtatgtggattacatgcccgtcatgaagcggtatagcgccccttctgaatccgagggggtgctgtga

SEQ ID NO: 21036 - RNA, 9867 nt, synthetic construct
  misc_feature 1..9867: note = derived and/or modified CDS sequence (opt5) from DENV-4__JQ915084__SS-prME
  source 1..9867: mol_type = other RNA
agcaccatgacactgctctgcctgatccccacggtgatggccttccacctttccaccagagacggcgagcctctgatgattgtcgctaagcatgaacgggggcgcccgctcctgtttaaaacaaccgagggaatcaacaagtgtacacttattgccatggatctgggcgaaatgtgcgaggacaccgttacatacaaatgtcccctcctggtgaataccgaacctgaggatatcgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggattcttagaaatcctggcttcgctctgctcgccggctttatggcttacatgatcgggcagacaggaatccagcggattgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcaccacaatggcccaggggaagcctaccctggattttgaactgaccaagacaacggctaaagaggttgccctcctgcggacctactgtatcgaagctagcatttctaatatcacaaccgccacacgctgcccgacccaaggagagccctatcttaaggaggaacaggaccagcagtacatttgtagacgggatgtggtggaccgcggctgggggaacggatgcggcctgttcgggaaaggaggcgtcgtgacgtgcgcgaagtttctctgttccggcaaaatcacagggaatctggttcaaattgagaaccttgaatataccgtggtcgtgaccgttcataatggagatacacacgccgtgggcaacgacaccagcaatcacggggtcacagctacgatcacccctagatctccctccgtggaggtcaagctgcctgattacggagaactcacactggactgcgagccccggagcggcatcgacttcaacgagatgattctgatgaagatgaaaaagaaaacctggctcgtgcataagcagtggtttctggatcttccgctgccttggacagccggggctgacacctctgaagttcactggaattacaaagagagaatggtgacgttcaaggtcccccatgccaaacgccaggatgtgaccgttctcggctcccaggaaggagccatgcacagcgctctggcgggcgccacagaggtggactccggggatggaaaccacatgtttgctggccatcttaagtgtaaggtccggatggaaaaactgagaatcaaggggatgtcttataccatgtgcagcggaaaattctccattgacaaggagatggccgagacacaacacggcaccacggtggtgaaagttaagtacgaaggggccggcgctccttgtaagatccccattgagatccgcgatgtcaataaagaaaaggtggtgggacggatcattagctctacacccttcgccgagaacaccaactccgtcatcaatattgagctcgaacctccgtttggcgacagctatatcgtgattggggttggagattctgcgctgacactgcattggttcagaaaaggcagctccatcgggaagatgtttgagtctacctaccgcggagctaaacggatggccatcctcggcgaaaccgcctgggacttcgggagcgtgggcggactgtttacatcccttggcaaggctgtccaccaggtgttcgggagcgtttatacgaccatgtttggaggcgtgtcttggatgattagaatcctgattgggttcctcgtcctgtggatcggaacaaactcccgcaataccagcatggccatgacatgcattgctgtgggcgggatcaccctgtttcttggcttcacggttcaggccgatatgggatgtgtggtctcttggaacggcaaggagctcaaatgcgggtccggaatttttgtggtggacaatgtccatacatggaccgaacaatacaagttccagcccgagagccctgcgcggctggcctccgctatcctgaacgcccacaaagacggcgtttgtgggatcagatctaccacacgcctcgagaatgtgatgtggaagcagattaccaacgaactgaattatgtgctttgggagggaggccacgatctgacagtcgtggctggcgacgttaaaggggtgctcacgaagggaaagcgggccctgaccccccctgtcaacgatctgaaatacagctggaagacatggggcaaagcgaagatctttacccccgaagccagaaattccacattccttattgacgggccggatacctctgagtgccctaacgaacggcgcgcttggaatttctttgaggtggaggactacggattcggcatgtttacgaccaacatctggatgaaattcagagaagggagctccgaggtttgtgatcatcggctcatgagcgccgctattaaggaccagaaagccgtgcacgccgatatgggatattggatcgaatcttccaagaatcaaacatggcagatcgagaaggctagcctgattgaagtcaaaacctgcctgtggcccaagacacataccctctggtctaacggcgtgctggagtcccagatgcttatccctagaagctacgcgggccccttttctcagcacaactatcgccaagggtacgccacacagaccgctggaccttggcacctgggcaaactcgagattgacttcggggaatgccccggaacgacagttaagatccaggaggattgtgaccatcggggcccgagcctgagaaccaccacagcctccgggaaactggtgacccagtggtgctgtcgcagctgcacgatgcctccccttagatttctcggagaagatggctgttggtatggcatggagattcggcccctgtctgagaaggaagagaatatggtcaagtcccaagtgacagccgggcagggaaccagcgaaacattctccatgggcctgctctgcctgaccctttttgtggaggaatgtctgcgcagacgggtcacacgcaaacacatgatcctcgttgtggtgatcaccttctgcgctattatcctggggggactgacgtggatggaccttctcagagccctgattatgctgggcgacaccatgtctgggcggatcggaggccagattcatctcgcgatcatgacagtctttaagatgagccctggctacgtgctgggggttttccttcgcaaactgacctccagagagacagctctcatggtgatcggaatggccatgaccacggtcttttctattccgcacgatctgatggagctgatcgacggcattagccttgggctgatcctcctgaagattgtgacacatttcgataacacccaggttggaacactcgccctgtcccttaccttcatgcggtctaccacacccctggtgatggcttggcgcacgatcatggccgtctttttcgtgattaccctcatccctctgtgtagaacaagctgcctgcaaaaacagtcccactgggtcgaaatcaccgcgcttattctgggcgctcaggccctccccgtgtatctgatgacactcatgaagggggccagccggagatcttggcctctgaatgagggaatcatggctgttggccttgtgtccctgctcggcagcgccctgctgaagaacgacgtcccccttgctgggcctatggtggccggaggcctgctcctggcggcctacgttatgtctgggtccagcgctgatctctctctggaaaaagccgctaatgtgcaatgggacgagatggccgatattaccggatccagccccatcattgaagtcaagcaggacgaggatggctcctttagcatccgcgacgtggaggaaacgaacatgatcacacttctggtgaaactggccctcattaccgtttctgggctgtacccgcttgctatccctgtcaccatggcgctgtggtatatttggcaggtgaagacacagcggagcggagccctctgggatgtgccctcccctgctgccacccaaaaagccacactgtctgagggcgtctacagaatcatgcagcgcggcctcttcgggaagacgcaggtgggagttggcattcacatggaaggggtgtttcataccatgtggcacgtcacacggggaagcgtgatctgtcatgagaccggcagactggaaccctcctgggctgacgttcgcaatgatatgatctcttatgggggaggctggcggcttggcgacaagtgggacaaagaggaggatgtgcaggtcctggccattgaaccggggaagaaccctagacacgtgcaaacaaaacccggactgttcaagaccctcacgggcgagatcggggcggttaccctggactttaaacctggaacaagcggctcccccattatcaataagaaagggaaggtgattggcctttacggaaacggcgtcgtgaccaagtctggggattatgtgagcgctatcacacaggccgaacgcattggagagcccgactacgaggtcgatgaagacatcttccggaaaaagagactgaccatcatggatctccatcctggcgccgggaaaacaaagcggattctgccgtccatcgttcgcgaggctctcaaaagacggctgcgcacgcttattctggcccccaccagagtggtggcggctgaaatggaggaagccctgcggggactccctatcagatatcagacacccgccgtcaagagcgagcacaccggccgcgagattgtggacctgatgtgccacgctacctttacaacgcggcttctgtcttccaccagagttcctaattacaacctcatcgtgatggatgaagcccatttcacagacccctgcagcgtcgctgcccgcgggtacatctctacccgggtggagatgggcgaagcggccgctatttttatgacagccacccctccgggatccatcgatcccttccctcagagcaattcccccattgaggacatcgaaagagagattcctgagcgctcttggaacacgggcttcgactggatcacagattatcaagggaagaccgtttggtttgtgcccagcatcaaagctggaaatgacattgccaactgtctgcggaagtccggcaaaagagtcatccagctcagccgcaagaccttcgatacagaatacccgaaaaccaagctgacagactgggattttgtggtcaccacggacatttctgagatgggggccaacttcagagctggacgggtgatcgatcctcgcagatgccttaagcccgttattctgacagacggccccgaacgggtgatcctggcggggcctattcccgtgacccctgcctccgctgcccagcgcagaggccggatcggaagaaatccggcccaagaggatgaccagtatgtctttagcggcgatcccctcaaaaacgacgaagatcacgctcattggacagaggccaagatgctgcttgacaatatctacacccctgaggggattatccccacgctgttcggacctgaacgcgagaaaacccaggcgattgacggcgaatttcggctcagaggggagcagcgcaagacattcgttgagctgatgcggagaggagatctgcccgtgtggctctcttataaagtggctagcgccggcatctcctacaaggaccgggaatggtgttttaccggcgagcgcaacaatcaaattcttgaagagaacatggaagtcgagatctggacaagagagggggaaaagaaaaagctgcggccgaaatggctggatgcccgcgtgtatgctgaccctatggccctcaaggatttcaaagagtttgcgtctggaagaaagagcaccacactggacatccttaccgaaattgccacgctgcccacatacctctcctctaaggctaaactggccctggataatatcgttatgctccacaccaccgagaagggcgggcgggcttaccagcacgcccttaacgaactgcctgagagcctggagacactcatgctggtggctcttctgggagccatgaccgcgggcattttcctctttttcatgcaggggaaaggaatcggcaagctgtccatgggcctgattgccatcgctgtcgccagcgggctcctttgggtggctgaaatccagccccaatggattgccgcctctatcattctggagttctttctgatggtcctcctgatccctgaacccgagaaacagcgcacaccgcaggacaatcagcttatttatgtgatcctgacgattctcgctatcatcggactgattgcggccaacgaaatgggcctgatcgagaagaccaaaacagatttcgggttttaccaagttaagaccgagacaaccattctcgacgtggatcttagacctgcttccgcctggacgctgtatgccgtcgctaccacaatcctgacccccatgctccggcatacaattgaaaataccagcgccaacctgtcccttgcggccatcgctaatcaggccgctgtgctgatgggactcggcaaggggtggcccctgcaccgcatggacctgggagttcctctccttgccatgggctgctactctcaggtgaacccgacgacactgaccgcgagcctggtcatgctcctgatccattatgccattatcggccccgggcttcaggctaaagccacaagagaggctcaaaagcggaccgccgctggaattatgaaaaatcctaccgtggatggcatcacagtgattgacctggaacccatctcctacgaccctaagttcgagaaacagctcgggcaggttatgctgctggtcctctgtgtgggacaacttctgctgatgagaacgacctgggccctctgcgaggtgctgacacttgcgaccggccccatcatgacactgtgggaagggaaccctggacgcttttggaacaccacgattgccgtctctacagctaatatcttccggggcagctatctcgccggcgctgggctggccttttccctgattaagaacgcccagaccccgagacgcggaaccggcacaaccggggagacactcggagaaaagtggaaacggcagcttaatagcctggatagaaaggagttcgaagagtacaaacgctctggcatcctggaggttgaccggacggaagcgaagtccgctctcagagatgggagcaaaattaagcacgccgtgtctcgcggatccagcaagatccggtggattgtggagagaggcatgatcaaacccaagggcaaagtcgtggacctggggtgtggacgcggcgggtggtcttactatatggctacccttaagaacgttacagaagtgaaaggatacaccaagggcgggcctggacatgaggaacccatccctatggccacatatggctggaatctggtcaagctccacagcggcgtggatgttttttacaaacccaccgagcaggtggacacgctgctgtgcgatattggggagtcctctagcaacccgaccatcgaagagggacggacactcagaattcttaagatggtcgaaccttggctgtccagcaaacccgagttctgtatcaaggtgctgaatccctatatgcctaccgtgattgaagagctcgagaaactgcaacgcagacacggcgggtcccttgtccggtgccccctgtctcgcaacagcacacatgaaatgtactgggtttccggagcctctggcaatatcgtgagctccgtgaacaccatctctaagatgctcctgaatagatttacaacccggcacagaaaacctacgtatgagaaggacgtcgatctgggggctggaacacggagcgtgtccaccgaaaccgagaagccggacatgacaattatcggccgcagactccagcggcttcaggaggaacataaagagacgtggcactacgatcaggaaaacccctaccgcacctgggcctatcacggcagctacgaggcgccttctacagggtccgccagctctatggttaatggagtggtcaagctgctgaccaaaccctgggacgtgattcctatggttacacaactcgctatgaccgacacaacccccttcggccagcagagagtgtttaaggaaaaagtcgatacgcggaccccgcagcctaagatcgggacacgcatgattatgaccacaaccgccaactggctgtgggctcttctgggaaagaaaaagtcccccagactctgtacgcgggaggagttcatcagcaaagtgcgctctaatgccgcgatcggcgccgttttccaagaagagcaggggtggacatccgctagcgaagccgtgaacgactccagattttgggagctggtcgataaggaacgggctctgcatcaggagggcaaatgcgagagctgcgtgtataatatgatgggaaagcgcgaaaagaaactcggcgagttcgggagagccaagggatctcgggctatttggtacatgtggctgggcgcccgctttcttgaattcgaggcgctggggtttctcaacgaagaccactggttcagcagagagaactcctggtctggagtcgagggcgaagggctgcatcggcttggctatatcctggaggatattgacaaaaaggatggagacctcatctacgccgatgacaccgctggctgggatacaagaattaccgaagacgatctgctgaatgaggagctcatcacggaacaaatggcccctcaccataaaaccctggctaaggccatctttaagcttacatatcagaacaaagtggttaaggtgctgcgccccacccctaaaggggccgtcatggacattatcagccggaaggaccagagaggatccggccaggtggggacatacggactcaataccttcacaaacatggaggtgcaactgattcgccagatggaagcggagggcgttatcacccaggatgacatgcagaatcccaaagggcttaaggaacgggtggagaaatggctgaaggagtgtggcgtcgatagactcaagcgcatggctatttctggagacgattgcgtggttaaaccgctggacgaacggtttagcacgtccctgctcttcctgaacgatatgggcaaggtgagaaaagacgtccctcaatgggagccctctaaggggtggaaaaattggcaggaagtgcccttttgtagccaccacttccataagatctttatgaaggatggacgctcccttgtcgtgccttgccggaaccaggacgagctgattggcagagcccgcatcagccagggggccggatggtctctccgggaaacagcttgtctgggcaaagcctacgctcaaatgtggtcccttatgtatttccacagacgggatctgagactcgccagcatggcgatctgctctgccgttccgaccgagtggttccccacctcccgcacaacctggagcattcatgctcagcaccagtggatgacaacggaggacatgctgaaggtgtggaatcgggtctggatcgaagacaaccctaatatgaccgataaaacacccgtgcactcctgggaggacattccttacctggggaagagagaagatctctggtgtggctctctgatcggacttagctcccgcgccacctgggctaaaaacattcatacagccatcacccaggttagaaatctgatcggcaaggaggaatatgtggactacatgcccgtcatgaagcggtatagctctccttccgagagcgagggggtgctctga

SEQ ID NO: 21037 - RNA, 9867 nt, synthetic construct
  misc_feature 1..9867: note = derived and/or modified CDS sequence (opt5) from DENV-4__KM190936__SS-prME
  source 1..9867: mol_type = other RNA
agcaccatcacactgctctgcctgattcccacggtgatggccttctccctttctaccagagacggcgagcctctgatgatcgtcgctaagcacgaacgggggcgcccgctcctgtttaaaacaaccgagggaattaacaagtgtacacttatcgccatggatctgggcgaaatgtgcgaggacaccgttacatacaaatgtcccctcctggtgaataccgaacctgaggatattgactgctggtgtaacctgacgagcacctgggtgatgtatgggacatgcacccagtccggagagagacggcgcgaaaagagatctgtcgcgctcacaccccatagcggcatggggctggagacccgggctgaaacgtggatgtcctctgagggagcctggaaacacgcccaacgcgtggagagctggatccttagaaatcctggcttcgctctgctcgccggctttatggcttacatgatcgggcagacaggaattcagcggaccgttttctttgtgctgatgatgcttgtcgccccctcctatggcatgcgctgtgtgggggttggaaacagagatttcgtggaaggcgtcagcgggggagcgtgggtggacctggtgctcgagcatggcggctgcgtcacaaccatggcccaggggaagcctaccctggattttgaactgacaaagacgaccgctaaagaggttgccctcctgcggacatactgtatcgaagcttctatttccaatatcaccacagccacccgctgcccgacgcaaggagagccctatcttaaggaggaacaggaccagcagtacatttgtagacgggatgtggtggaccgcggctgggggaacggatgcggcctgttcgggaaaggaggcgtcgtgacatgcgcgaagtttagctgttctggcaaaatcaccgggaatctcgttcaaattgagaacctggaatataccgtggtcgtgacagttcacaatggagatacccatgccgtgggcaacgacacatccaatcacggggtcacggctatgatcacccctagaagcccctctgtggaggtcaagcttcctgattacggagaactgacactcgactgcgagccccggtccggcatcgacttcaacgagatgattctgatgaagatgaaaaagaaaacctggctggtgcacaagcagtggtttctcgatctgccgcttccttggacagccggggctgacaccagcgaagttcattggaattacaaagagagaatggtgacgttcaaggtcccccacgccaaacgccaggatgtgaccgttctgggctcccaggaaggagccatgcattctgctctcgcgggcgccacagaggtggacagcggggatggaaaccacatgtttgctggccacctgaagtgtaaggtccggatggaaaaacttagaatcaaggggatgtcctataccatgtgcagcggaaaattctctattgacaaggagatggccgagacacaacatggcaccacggtggtgaaagttaagtacgaaggggccggcgctccttgtaaggtccccatcgagattcgcgatgtgaataaagaaaaggtggtcggacggatcatctccagcacacccctggccgagaacaccaactctgtgacaaatattgagctcgaacctccgttcggcgacagctatatcgttattggggtgggaaactccgcgctgaccctgcactggtttagaaaaggctctagcatcgggaagatgttcgagtccacctaccgcggagctaaacggatggccattctcggcgaaacagcctgggattttgggagcgtcggcggactgttcacgtctcttggcaaggctgtgcatcaggtttttgggtccgtgtataccacaatgttcggaggcgtcagctggatgatcagaatcctgattgggtttctcgtgctgtggatcggaaccaattctcgcaacacatccatggccatgacctgcattgctgttggcgggatcacgctgttccttggctttacagtgcaggccgacatgggatgtgtcgtgagctggtccggcaaggagctcaaatgcgggtctggaattttcgtggtcgataatgttcacacctggaccgaacaatacaagtttcagcccgagagccctgcgcggctggcctccgctatcctgaacgcccataaagacggcgtgtgtgggattagatctacaacccgcctcgagaatgtgatgtggaagcagatcacaaacgaactgaattatgtcctttgggagggaggccacgacctgacggtggttgctggcgatgtgaaaggggtcctcaccaagggaaagcgggccctgacaccccctgtgagcgacctgaaatactcctggaagacctggggcaaagcgaagatcttcacacccgaagccagaaacagcacctttcttattgatgggccggacacgtctgagtgccctaatgaacggcgcgcttggaactccctcgaggttgaggattacggattcggcatgttcaccacaaatatctggatgaaatttagagaagggagctctgaggtgtgtgaccaccggctgatgtccgccgctattaaggatcagaaagccgtccatgccgacatgggatattggatcgaaagctctaagaaccaaacctggcagattgagaaggctagcctgatcgaagtgaaaacatgcctctggcccaagacccacacactgtggtccaatggcgttcttgagagccagatgctgatccctaaatcttacgcgggccccttctcccagcataactatagacaagggtacgccacccagacggtgggaccttggcacctcggcaagctggagattgattttggggaatgccccggaacaaccgtcaccatccaggaggactgtgatcaccgcggcccgagcctgcggacaaccacggcttccgggaaacttgtgacacagtggtgctgtagatcttgcaccatgcctcccctccgcttcctgggagaagacggctgttggtatggcatggagattagacccctgagcgagaaggaagagaacatggtgaagtcccaagtcacagccgggcagggaacctctgaaacatttagcatgggcctcctgtgccttaccctgttcgttgaggaatgtctccggcgcagagtgacgcggaaacatatgatcctggtggtcgtgattaccctgtgcgccatcatccttgggggactcacatggatggatctgctgcgcgctctcattatgctgggcgacaccatgtccgggagaatcggaggccagattcaccttgccatcatggcggtttttaagatgtctcctggctacgtgctgggggtcttcctccggaaactgacaagccgcgagaccgctctgatggtgattggaatggccatgacgacagttctttccatcccgcatgacctgatggagctcatcgatggcattagcctggggctcatcctgcttaagattgtgacccagtttgacaatacacaagtcggaaccctggccctctctctgaccttcatcagatccacaatgcccctggtgatggcttggcggacgattatggccgtcctttttgtggttaccctgatccctctctgtcgcacaagctgcctgcagaaacagtctcactgggtggaaattaccgcgctcatcctgggcgctcaagcccttcccgtctatctgatgacactcatgaagggggcctccagacggagctggcctctgaacgagggaatcatggctgtgggcctggtttctcttctgggctccgccctcctgaagaatgatgtgcccctcgctgggcctatggtcgccggaggcctgcttctggcggcctacgtgatgagcgggtccagcgctgacctgtctctcgaaaaagccgctaacgtgcagtgggatgagatggccgacattaccggaagctcccccatcattgaagttaagcaggatgaggacggctctttcagcatcagagatgtcgaggaaacgaatatgattacactgcttgtgaaactggccctcatcaccgtgtccgggctgtacccgctcgctatccctgtcaccatgacactgtggtatatgtggcaggtgaagacccaacgctctggagcgctttgggacgttcccagccctgccgctacacagaaagccgccctgtccgagggcgtgtaccggattatgcagagaggcctgtttgggaagacgcaggtcggagtgggcatccatatggaaggggttttccacaccatgtggcacgtgacacgcggatctgtcatttgtcatgagaccggccggctcgaacccagctgggctgatgtgagaaacgacatgatctcctatgggggaggctggcgcctgggcgataagtgggacaaagaggaggacgttcaagtgcttgccattgaaccggggaagaatcctaaacacgtccagacaaagcccggactgttcaaaaccctcacgggcgagatcggggcggtgaccctggattttaagcctggaacaagcggctctcccatcattaaccggaaagggaaggtgatcggcctctacggaaatggcgtcgttaccaagtccggggactatgtgagcgctattacacaggccgaaagaatcggagagcccgattacgaggtggacgaagatattttccgcaaaaagcggctgaccatcatggaccttcatcctggcgccgggaaaacaaagagaattctgccgtctatcgtccgggaggctctgaaacgcagactccggacgctgatccttgcccccacccgcgtggttgcggctgaaatggaggaagccctgagaggactccctattcggtatcagacacccgccgtgaagtccgagcacaccggcagagagatcgtcgatctgatgtgccatgctacctttacaacgcgcctcctgagctccacccgggtgcctaactacaatcttattgttatggacgaagcccacttcacagatccctctagcgtggctgccagagggtacatctccacccgcgtcgagatgggcgaagcggccgctatttttatgacagccacccctccgggagctacggaccccttccctcaaagcaactctcccatcgaggatatcgaacgggagattcctgagagatcctggaatacaggctttgactggatcaccgactatcaggggaagaccgtgtggttcgtccccagcattaaagccggaaacgatatcgccaattgcctgcgcaagtctggcaaaaaggtgattcagctgagccggaaaacatttgacaccgaatacccgaagacaaagctcaccgattgggacttcgttgtgacgacagatatctccgagatgggggctaactttagagcgggacgcgtgatcgaccctagacggtgtctgaaacccgtcattcttaccgatggccccgaacgcgttatcctggccgggcctattcccgtgacacctgcttctgccgcccaaagacggggccgcatcggaagaaacccggctcaggaggacgatcagtatgtgttcagcggcgaccccctcaagaatgatgaagaccacgcccattggaccgaggcgaaaatgctgctggataacatttacacgcctgaggggatcattcccaccctcttcggacctgaacgggagaagacacaggctatcgacggcgaatttagacttcgcggggagcaacggaaaaccttcgtcgagctgatgagacgcggagacctgcccgtgtggctctcctataaggttgcctctgccggcatcagctacaaggatcgggaatggtgctttacaggcgagagaaataaccagattctggaagagaatatggaagtggagatctggacccgggagggggaaaaaaagaaacttcgcccgagatggctggacgctcgggtctatgccgatcctatggcgctcaaggacttcaaagagtttgcctccggacgcaagagcattacactggatatcctgaccgaaattgcttctctccccacgtacctttccagcagagccaagctggctctggacaacatcgtgatgctccacacaaccgagcggggcgggcgcgcctaccagcatgctctgaatgaacttcctgagtccctggagaccctcatgctggtcgccctgctcggagcgatgacagccggcatcttcctttttttcatgcaggggaaaggaattggcaagctgtctatgggcctgatcaccattgctgtggccagcgggctcctgtgggttgctgaaatccaaccccagtggattgccgcctccatcatccttgagtttttcctgatggtgctcctgattcctgaacccgagaaacagagaacaccgcaggataaccaactgatctatgtcattctcacgatccttaccattatcggactgattgctgcgaatgaaatgggcctgatcgagaagacaaaaaccgactttgggttctaccaggtgaagacagagaccacgatcctcgatgttgacctgcggcctgcctctgcttggaccctttatgccgtggccacaaccattctgacacccatgctccgccacaccatcgaaaacacgagcgctaatctgtccctggccgcgattgccaaccaggctgccgtcctcatgggacttggcaaagggtggcccctgcacagaatggatctgggagtgcctctcctggctatgggctgttacagccaggtgaatccgacaacccttacagcctctctggttatgctcctggtccattatgcgatcattggccccgggctgcaagccaaggctacccgggaggcccagaagagaaccgctgccggaatcatgaaaaaccctacagtggacggcatcacggtgattgatctcgaacccatctcctacgaccctaagtttgagaaacagcttgggcaagtcatgctgctggttctctgcgctggacagctgcttctgatgcgcaccacatgggccttctgtgaggtgctcaccctggcgacaggccccattctgaccctctgggaagggaatcctggacggttctggaacacgacaatcgccgtgagcaccgctaacatttttagaggctcttatcttgccggcgctgggctggccttctccctgatcaagaatgcccagaccccgcgccggggaacaggcaccacaggggagacgctcggagaaaaatggaagagacagctgaacagccttgaccgcaaggagtttgaagagtacaaacggtctggcatcctggaggtcgatagaaccgaagcgaagagcgctctcaaagacgggtccaagattaaacacgccgtgtctcgcggaagctccaagatccggtggattgttgagagaggcatggtgaagcccaaaggcaaggtcgtggatctggggtgcggacgcggcgggtggagctactatatggctacactgaaaaatgttaccgaagtgaagggatacacaaaaggcgggcctggacatgaggaacccatccctatggccacctatggctggaacctcgtcaagcttcactccggcgtggacgtgttctacaagcccacggagcaagtcgataccctgctgtgtgacattggggagtctagctccaatccgacaatcgaagagggacggaccctcagagttctgaaaatggtggaaccttggctttctagcaagcccgagttttgcattaaagtgctgaacccctatatgcctacagtcatcgaagagctcgagaagctgcagcgcaaacatggcgggaatctggtgagatgtcccctctcccggaactctacccacgaaatgtactgggttagcggagcctccggcaatatcgtgagctctgtcaacacaacctccaagatgcttctgaatcgcttcacgacaagacaccggaaacctacctatgagaaggatgtggacctgggggctggaaccagaagcgtttctacagaaacggagaagccggatatgaccattatcggccggcgcctccagagactgcaggaggaacataaagagacatggcactacgaccaagaaaacccctaccggacctgggcctatcatggctcctacgaggcgcctagcacagggtctgcctccagcatggtgaatggagtcgtgaagcttctgaccaaaccctgggatgttattcctatggtgacacagctcgctatgaccgacacgaccccctttggccagcagcgcgtcttcaaggaaaaagtggacacaagaaccccgcaacctaagcccgggacacggatggtcatgaccacgacagccaactggctgtgggctctgctcggaaagaaaaagaatcctcgcctgtgcaccagagaggagtttatctccaaagtgcggagcaacgccgcgattggcgccgttttccaggaagagcaggggtggacatctgctagcgaagccgtgaatgattcccgcttttgggagcttgtcgacaaggaaagagctctgcaccaagagggcaaatgtgagtcttgcgtgtataacatgatgggaaagcgggaaaagaaactcggcgagttcgggcgcgccaagggaagcagagctatctggtacatgtggctgggcgcccggtttcttgaattcgaggcgctggggttcctcaacgaagatcactggtttggacgcgagaattcctggtctggcgtggagggggaaggcctgcatagactgggatatatcctcgaggaaattgacaaaaaggatggcgacctgatgtacgccgatgacaccgctgggtgggatacgcggatcaccgaggacgatcttcagaacgaggaactgattacagagcagatggccccccaccataaaatcctcgctaaggccattttcaagctgacctatcagaataaagttgtgaaggtccttagacctacaccccgcggagccgtgatggacatcatcagccggaaagatcaaagaggctccgggcaggttggaacctacggcctgaacacatttaccaatatggaagtgcagctcattcgccagatggaggcggaaggggtcatcacgcaagacgacatgcagaacccgaagggcctgaaagagcgggtggagaagtggctgaaagaatgcggagtcgatagactcaagcgcatggctatttctggcgacgattgtgtggttaagcctctggacgagcggttcgggacaagccttctgtttctcaatgatatgggaaaagtgagaaaggacatcccccagtgggaaccctccaaaggctggaagaactggcaggaggtccctttctgcagccaccattttcacaaaattttcatgaaggatgggcgctctctggtggttccgtgtcggaatcaagacgaacttatcggaagagcccgcatctcccagggcgccgggtggagcctgcgggagaccgcttgcctcggcaaggcctacgctcagatgtggtctctgatgtattttcacagacgggatctgagactcgcctccatggcgatttgtagcgccgtgcccaccgagtggttccctacatcccgcaccacatggtctatccatgctcaccatcagtggatgacgaccgaagacatgctgaaagtctggaaccgggtgtggattgaggataatcccaacatgacagacaagacccctgtgcacagctgggaagacatcccctaccttggaaaaagagaggatctgtggtgcggctccctcattgggctgagctctcgcgccacatgggctaagaatatccacaccgccattacgcaagttagaaaccttatcggaaaagaagagtatgtcgactacatgcctgtgatgaagcggtattccgcgcccagcgagtctgaaggcgtgctgtga

SEQ ID NO: 21038 - RNA, 9867 nt, synthetic construct
  misc_feature 1..9867: note = derived and/or modified CDS sequence (opt5) from DENV-4__JQ915090__SS-prME
  source 1..9867: mol_type = other RNA
agcaccatgacactgctctgcctgatccccacggtgatggccttccacctttccaccagagacggcgagcctctgatgattgtcgctaagcatgaacgggggcgcccgctcctgtttaaaacaaccgagggaatcaacaagtgtacacttattgccatggatctgggcgaaatgtgcgaggacaccgttacatacaaatgtcccctcctggtgaataccgaacctgaggatatcgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggattcttagaaatcctggcttcgctctgctcgccggctttatggcttacatgatcgggcagacaggaatccagcggattgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcaccacaatggcccaggggaagcctaccctggattttgaactggctaagaccacagccaaagaggttgctctcctgcggacgtactgtatcgaagccagcatttctaatatcaccacagcgacccgctgcccgacacaaggagagccctatcttaaggaggaacaggaccagcagtacatttgtagacgggatgtggtggaccgcggctgggggaacggatgcggcctgttcgggaaaggaggcgtcgtgacctgcgccaagtttctctgttccggcaaaatcacggggaatctggttcaaattgagaaccttgaatatacagtggtcgtgaccgttcataatggagatacccacgctgtgggcaacgacacaagcaatcacggggtcaccgccacaatcacgcctagatctccctccgtggaggtcaagctgcctgattacggagaactcaccctggactgcgagccccggagcggcatcgacttcaacgagatgattctgatgaagatgaaaaagaaaacatggctcgtgcataagcagtggtttctggatcttccgctgccttggaccgctggggccgacacatctgaagttcactggaattacaaagagagaatggtgaccttcaaggtcccccatgccaaacgccaggatgtgacggttctcggctcccaggaaggagctatgcacagcgcgctggccggcgctaccgaggtggactccggggatggaaaccacatgtttgccggccatcttaagtgtaaggtccggatggaaaaactgagaatcaaggggatgtcttatacaatgtgcagcggaaaattctccattgacaaggagatggccgagacccaacacggcacaaccgtggtgaaagttaagtacgaaggggctggcgccccttgtaagatccccattgagatccgcgatgtcaataaagaaaaggtggtgggacggatcattagctctacgcccttcgcggagaacacaaactccgtcatcaatattgagctcgaacctccgtttggcgacagctatatcgtgattggggttggagattctgctctgaccctgcattggttcagaaaaggcagctccatcgggaagatgtttgagtctacataccgcggagccaaacggatggccatcctcggcgaaaccgcttgggacttcgggagcgtgggcggactgtttacctcccttggcaaggccgtccaccaggtgttcgggagcgtttatacaacgatgtttggaggcgtgtcttggatgattagaatcctgattgggttcctcgtcctgtggatcggaaccaactcccgcaatacaagcatggctatgacctgcattgccgtgggcgggatcacactgtttcttggcttcaccgttcaggcggatatgggatgtgtggtctcttggaacggcaaggagctcaaatgcgggtccggaatttttgtggtggacaatgtccatacgtggacagaacaatacaagttccagcccgagagccctgcccggctggcttccgccatcctgaacgctcacaaagacggcgtttgtgggatcagatctaccacccgcctcgagaatgtgatgtggaagcagattacaaacgaactgaattatgtgctttgggagggaggccacgatctgaccgtcgtggccggcgacgttaaaggggtgctcacaaagggaaagcgggcgctgacgccccctgtcaacgatctgaaatacagctggaagacctggggcaaagccaagatctttacacccgaagctagaaattccaccttccttattgacgggccggatacatctgagtgccctaacgaacggcgcgcctggaatttctttgaggtggaggactacggattcggcatgtttaccacgaacatctggatgaaattcagagaagggagctccgaggtttgtgatcatcggctcatgagcgctgccattaaggaccagaaagccgtgcacgctgatatgggatattggatcgaatcttccaagaatcaaacctggcagatcgagaaggcgagcctgattgaagtcaaaacatgcctgtggcccaagacccatacactctggtctaacggcgtgctggagtcccagatgcttatccctagaagctacgccggccccttttctcagcacaactatcgccaagggtacgctacccagacagccggaccttggcacctgggcaaactcgagattgacttcggggaatgccccggaaccacggttaagatccaggaggattgtgaccatcggggcccgagcctgagaacaaccaccgcctccgggaaactggtgacacagtggtgctgtcgcagctgcaccatgcctccccttagatttctcggagaagatggctgttggtatggcatggagattcggcccctgtctgagaaggaagagaatatggtcaagtcccaagtgacggctgggcagggaacaagcgaaaccttctccatgggcctgctctgcctgacactttttgtggaggaatgtctgcgcagacgggtcacccgcaaacacatgatcctcgttgtggtgatcacattctgcgccattatcctggggggactgacctggatggaccttctcagagcgctgattatgctgggcgacacgatgtctgggcggatcggaggccagattcatctcgctatcatgaccgtctttaagatgagccctggctacgtgctgggggttttccttcgcaaactgacatccagagagaccgccctcatggtgatcggaatggccatgacaaccgtcttttctattccgcacgatctgatggagctgatcgacggcattagccttgggctgatcctcctgaagattgtgacgcatttcgataacacacaggttggaaccctcgctctgtcccttacattcatgcggtctaccacccccctggtgatggcctggcgcacaatcatggcggtctttttcgtgattacgctcatccctctgtgtagaaccagctgcctgcaaaaacagtcccactgggtcgaaatgacagctcttatcctgggcgcccaggccctccccgtgtatctgatgaccctcatgaagggggctagccggagatcttggcctctgaatgagggaattatggccgttggccttgtgtccctgctcggcagcgctctgctgaagaacgacgtcccccttgccgggcctatggtggcgggaggcctgctcctggccgcttacgttatgtctgggtccagcgccgatctctctctggaaaaagctgccaatgtgcaatgggacgagatggccgatatcacaggatccagccccattatcgaagtcaagcaggacgaggatggctcctttagcattcgcgacgtggaggaaaccaacatgatcacgcttctggtgaaactggctctcatcacagtttctgggctgtacccgcttgcgattcctgtcaccatggccctgtggtatatctggcaggtgaagacccagcggagcggagctctctgggatgtgccctcccctgccgccacacaaaaagctaccctgtctgagggcgtctacagaattatgcagcgcggcctcttcgggaagacacaggtgggagttggcatccacatggaaggggtgtttcatacgatgtggcacgtcacccggggaagcgtgatttgtcatgagacaggcagactggaaccctcctgggccgacgttcgctctgatatgatcagctatgggggaggctggcggcttggcgacaagtgggacaaagaggaggatgtgcaggtcctggcgatcgaaccggggaagaatcctagacacgtgcaaaccaaacccggactgttcaagacactcaccggcgagattggggctgttacgctggactttaaacctggaacctccggctctcccatcattaacaagaaagggaaggtgatcggcctttacggaaatggcgtcgtgacaaagagcggggattatgtgtccgccattacccaggccgaacgcatcggagagcccgactacgaggtcgatgaagacattttccggaaaaagagactgacaatcatggatctccatcctggcgctgggaaaaccaagcggatcctgccgagcattgttcgcgaggccctcaaaagacggctgcgcacacttatcctggcgcccacgagagtggtggctgccgaaatggaggaagccctgcggggactccctattagatatcagacccccgctgtcaagtctgagcacacaggccgcgagatcgtggacctgatgtgccacgccacctttaccacacggcttctgtccagcacgagagttcctaactacaatctcattgtgatggatgaagctcatttcaccgacccctgctctgtcgccgcgcgcgggtacatctccacacgggtggagatgggcgaagccgctgccatctttatgaccgctacacctccgggaagcattgatcccttccctcagtccaactctcccatcgaggacattgaaagagagatccctgagcgcagctggaataccggcttcgactggattacggattatcaagggaagacagtttggtttgtgccctccatcaaagccggaaacgacatcgccaattgtctgcggaagagcggcaaaagagtcattcagctctctcgcaagaccttcgataccgaatacccgaaaacaaagctgaccgactgggattttgtggtcacaaccgacatctccgagatgggggctaacttcagagcgggacgggtgattgatcctcgcagatgccttaagcccgttatcctgacggacggccccgaacgggtgattctggccgggcctatccccgtgacacctgctagcgccgcccagcgcagaggccggattggaagaaacccggctcaagaggatgaccagtatgtcttttctggcgatcccctcaaaaatgacgaagatcacgcccattggaccgaggcgaagatgctgcttgacaacatctacacacctgaggggatcattcccaccctgttcggacctgaacgcgagaaaacgcaggctatcgacggcgaatttcggctcagaggggagcagcgcaagaccttcgttgagctgatgcggagaggagatctgcccgtgtggctcagctataaagtggcctccgccggcatttcttacaaggaccgggaatggtgttttacaggcgagcgcaataaccaaatccttgaagagaatatggaagtcgagatttggaccagagagggggaaaagaaaaagctgcggccgaaatggctggatgctcgcgtgtatgccgaccctatggcgctcaaggatttcaaagagtttgccagcggaagaaagtccacaaccctggacatccttacagaaatcgctaccctgcccacgtacctctctagcaaggccaaactggctctggataacattgttatgctccacacaaccgagaagggcgggcgggcctaccagcacgctcttaatgaactgcctgagtccctggagaccctcatgctggtggcccttctgggagcgatgacagccggcatcttcctctttttcatgcaggggaaaggaattggcaagctgagcatgggcctgatcgctattgccgtcgcttctgggctcctttgggtggccgaaatccagccccaatggatcgccgcttccattatcctggagttctttctgatggtcctcctgattcctgaacccgagaaacagcgcaccccgcaggacaaccagcttatctatgtgattctgacaatcctcacgattatcggactgatcgcggccaatgaaatgggcctgattgagaagaccaaaacagatttcgggttttaccaagttaagaccgagacaaccatcctcgacgtggatcttagacctgctagcgcctggacgctgtatgccgtcgctaccacaattctgacccccatgctccggcatacaatcgaaaacatgtccgccaatctgtctcttgcggccattgctaaccaggccgctgtgctgatgggactcggcaaggggtggcccctgcaccgcatggacctgggagttcctctccttgccatgggctgctacagccaggtgaatccgaccacgctgacagcgtccctggtcatgctcctgatccattatgccatcattggccccgggcttcaggctaaagccaccagagaggctcaaaagcggacagccgctggaatcatgaaaaaccctaccgtggatggcattaccgtgatcgacctggaacccatttcttacgaccctaagttcgagaaacagctcgggcaggttatgctgctggtcctctgtgtgggacaacttctgctgatgagaacaacgtgggccctctgcgaggtgctgacccttgcgacaggccccatcatgaccctgtgggaagggaatcctggacgcttttggaacacaaccatcgccgtcagcacggctaacattttccggggctcctatctcgccggcgctgggctggcctttagcctgatcaagaatgcccagacaccgagacgcggaaccggcaccacaggggagaccctcggagaaaagtggaaacggcagcttaactctctggatagaaaggagttcgaagagtacaaacgctccggcattctggaggttgaccggacagaagcgaagagcgctctcagagatgggtctaaaatcaagcacgccgtgtcccgcggaagctctaagattcggtggatcgtggagagaggcatgattaaacccaagggcaaagtcgtggacctggggtgtggacgcggcgggtggagctactatatggctacgcttaagaatgttaccgaagtgaaaggatacacaaagggcgggcctggacatgaggaacccatccctatggccacctatggctggaacctggtcaagctccactccggcgtggatgttttttacaaacccacagagcaggtggacaccctgctgtgcgatatcggggagtctagctccaatccgacgattgaagagggacggaccctcagaatccttaagatggtcgaaccttggctgagctccaaacccgagttctgtattaaggtgctgaacccctatatgcctacagtgatcgaagagctcgagaaactgcaacgcagacacggcgggtctcttgtccggtgccccctgagccgcaattccacccatgaaatgtactgggtttctggagccagcggcaacattgtgtcctctgtgaatacaatcagcaagatgctcctgaacagatttaccacacggcacagaaaacctacctatgagaaggacgtcgatctgggggctggaacgcggtccgtgagcacagaaaccgagaagccggacatgaccatcattggccgcagactccagcggcttcaggaggaacataaagagacatggcactacgatcaggaaaatccctaccgcacgtgggcctatcacggctcttacgaggcgccttccaccgggagcgcctcttccatggttaacggagtggtcaagctgctgacaaaaccctgggacgtgatccctatggttacccaactcgctatgacagacaccacacccttcggccagcagagagtgtttaaggaaaaagtcgatacccggacgccgcagcctaagctggggacccgcatgattatgacaaccacagccaattggctttgggctctgctcggaaagaaaaagagccccagactgtgtacccgggaggagttcatctctaaagtgcgctccaacgccgcgattggcgccgttttccaagaagagcaggggtggacgagcgctatcgaagccgtgaatgactccagattttgggagctggtcgataaggaacgggctctccatcaggagggcaaatgcgagagctgcgtgtataacatgatgggaaagcgcgaaaagaaactgggcgagttcgggagagccaagggatctcgggctatctggtacatgtggcttggcgcccgctttctggaattcgaggcgctcgggtttctgaatgaagaccactggttcagcagagagaactcctggtctggagtcgagggcgaagggcttcatcggctgggctatattctcgaggatatcgacaaaaaggatggagacctgatttacgccgatgacacagctggctgggataccagaatcacagaagacgatctgctcaacgaggagctgattaccgaacaaatggcccctcaccataaaacgcttgctaaggccatctttaagctgacctatcagaataaagtggttaaggtgctccgccccacacctaaaggggccgtcatggacatcattagccggaaggaccagagaggatccggccaggtggggacctacggactgaacacattcaccaatatggaggtgcaacttatccgccagatggaagcggagggcgttattacacaggatgacatgcagaaccccaaagggctgaaggaacgggtggagaaatggctcaaggagtgtggcgtcgatagactgaagcgcatggctatctctggagacgattgcgtggttaaaccgctggacgaacggtttagcacctccctcctgttccttaatgatatgggcaaggtgagaaaagacgtccctcaatgggagccctctaaggggtggaaaaactggcaggaagtgcccttttgtagccaccacttccataagatttttatgaaggatggacgctccctggtcgtgccttgccggaatcaggacgagctcatcggcagagcccgcattagccagggggccggatggtctctgcgggaaacggcttgtcttggcaaagcctacgctcaaatgtggtccctgatgtatttccacagacgggatctcagactggccagcatggcgatctgctctgccgttccgacagagtggttccccacctcccgcaccacatggagcatccatgctcagcaccagtggatgaccacagaggacatgctgaaggtgtggaaccgggtctggattgaagacaatcctaacatgacggataaaacccccgtgcactcctgggaggacatcccttacctcgggaagagagaagatctgtggtgtggctctcttattggactgagctcccgcgccacatgggctaaaaatatccataccgccattacacaggttagaaacctcatcggcaaggaggaatatgtggactacatgcccgtcatgaagcggtatagctctccttccgagagcgagggggtgctgtga

SEQ ID NO: 21039 - RNA, 9867 nt, synthetic construct
  misc_feature 1..9867: note = derived and/or modified CDS sequence (opt5) from DENV-4__KJ160504__SS-prME
  source 1..9867: mol_type = other RNA
agcaccatcaccctgctctgcctgattcccacggtgatggccttccacctttccaccagagacggagagcctctgatgatcgttgctaagcatgaacgggggcgcccgcttctgtttaagacaaccgagggaattaacaagtgtacccttatcgccatggatctgggcgaaatgtgcgaggacaccgttacatacaagtgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaagcatgcccagcgcgtggagtcttggatccttagaaatcctggcttcgctctgctcgccggctttatggcttacatgatcgggcagacaggcattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctagcatttctaatatcaccacagccacccgctgcccgacgcaaggagagccctatcttaaggaggaacaggaccagcagtacatttgtagacgggatgtggtggaccgcggctgggggaacggatgcggcctgttcgggaaaggaggcgtcgtgacatgcgcgaagttttcctgtagcggcaaaatcaccgggaatctcgttcaaattgagaacctggaatataccgtggtcgtgacagttcataatggagatacccacgccgtgggcaacgacacatctaatcacggggtcacggctaccatcacacctagatcccccagcgtggaggtcaaacttcctgattacggagaactgaccctcgactgcgagccccggtctggcatcgacttcaacgagatgattctgatgaagatgaaaaagaaaacatggctggtgcataagcagtggtttctcgatctgccgcttccttggaccgccggggctgacacgtccgaagttcactggaattacaaagagagaatggtgaccttcaaggtcccccatgccaaacgccaggatgtgacagttctgggcagccaggaaggagccatgcactccgctctcgcgggcgccaccgaggtggactctggggatggaaaccacatgtttgctggccatctgaagtgtaaggtccggatggaaaaacttagaatcaaggggatgagctatacaatgtgctccggaaaattcagcattgacaaggagatggccgagacccaacacggcacgacagtggtgaaagttaagtacgaaggggccggcgctccttgtaaggtccccatcgagattcgcgatgtgaataaagaaaaggtggtcggacgggtgatctcttccacacccctggccgagaacacaaacagcgttaccaatatcgagctcgaacctccgttcggcgactcttatattgtgatcggggtcggaaacagcgcgctgaccctgcattggtttagaaaaggctcctctattgggaagatgttcgagagcacataccgcggagctaaacggatggccatcctcggcgaaacggcctgggattttgggtccgtgggcggactgttcaccagccttggcaaggctgttcaccaggtgtttgggtctgtctatacaaccatgttcggaggcgtgtcctggatgattagaatcctgatcgggtttctcgttctgtggattggaacaaatagccgcaacacctctatggccatgacgtgcatcgctgtgggcgggattacactgttccttggctttaccgtccaggccgacatgggatgtgtggtgtcctggagcggccgggagctcaagtgcgggtccggaatcttcgtcgttgataatgtgcatacctggacagaacaatacaaatttcagcccgagtctcctgcgagactggccagcgctattctgaacgcccacaaggacggcgtgtgtgggatccgctccaccacacggctcgagaatgtcatgtggaaacagattacgaacgaactgaattatgtgctttgggagggaggccacgacctgaccgttgtggctggcgatgtcaagggggtgctcacaaaaggaaagagagccctgacaccccctgtttctgacctgaagtacagctggaaaacatggggcaaggcgaaaatcttcacccccgaagcccggaactccacgtttcttatcgatgggccggacaccagcgagtgccctaatgaacgcagagcttggaactctctcgaggtggaggattacggattcggcatgttcacaaccaatatttggatgaagtttcgggaagggtccagcgaggtctgtgaccatagactgatgtctgccgctatcaaagatcagaaggccgtgcacgccgacatgggatattggattgaatccagcaaaaaccaaacatggcagatcgagaaggcttctctgattgaagttaagacctgcctctggcccaaaacacataccctgtggagcaatggcgtgcttgagtcccagatgctgatccctaagagctacgcgggccccttctctcagcacaactatcgccaagggtacgccacgcagacagtcggaccttggcacctcggcaaactggagatcgattttggggaatgccccggaaccaccgtgacaattcaggaggactgtgatcatcggggcccgtccctgagaaccacgacagctagcgggaaacttgtgacccagtggtgctgtcgctcctgcacaatgcctcccctcagattcctgggagaagacggctgttggtatggcatggagatccggcccctgtctgagaaagaagagaacatggtcaagagccaagttaccgccgggcagggaacatccgaaaccttttctatgggcctcctgtgccttacgctgttcgtggaggaatgtctccgcagacgggtgacccgcaagcacatgattctggtcgtggttatcacactgtgcgccattatccttgggggactcacctggatggatctgctgagagctctcatcatgctgggcgacacaatgagcgggcggattggaggccagatccatcttgccattatggcggtgtttaaaatgtcccctggctacgtcctgggggtgttcctccgcaagctgacctctagagagacggctctgatggttatcggaatggccatgacaaccgtgcttagcattccgcacgacctgatggagctcatcgatggcatctccctggggctcattctgcttaaaatcgtcacacagtttgacaatacccaagtgggaaccctggccctcagcctgacattcattcggtctacgatgcccctggtcatggcttggcgcaccatcatggccgtgctttttgttgtgacactgattcctctctgtagaacctcctgcctgcagaagcagagccattgggtcgaaatcacagcgctcattctgggcgctcaagcccttcccgtgtatctgatgaccctcatgaaaggggcctctcggagatcctggcctctgaacgagggaatcatggctgttggcctggtgagccttctgggctctgccctcctgaagaatgatgtccccctcgctgggcctatggtggccggaggcctgcttctggcggcctacgtgatgtccgggagctccgctgacctgagcctcgaaaaggccgctaacgttcagtgggatgagatggccgacatcacgggatctagccccattatcgaagtcaaacaggatgaggacggctccttctctattcgcgatgtggaggaaacaaatatgatcaccctgcttgtgaagctggccctcattaccgtcagcgggctgtacccgctcgctatccctatcacaatgaccctgtggtatatgtggcaagtgaaaacacaacggtccggagcgctttgggacgttccctctcctgccgctacgcagaaggccgccctgagcgagggcgtgtacagaattatgcagcgcggcctgtttgggaaaacccaggtcggagtgggcatccacatggaaggggttttccacacaatgtggcatgtgacccggggatccgtcatttgtcacgagacaggcagactcgaaccctcttgggctgatgtgcgcaacgacatgatcagctatgggggaggctggcggctgggcgataagtgggacaaggaggaggacgttcaagtgcttgccattgaaccggggaaaaatcctaagcatgtccagaccaaacccggactgttcaagacgctcaccggcgagatcggggcggtgacactggattttaaacctggaacctccggcagccccatcattaacagaaaggggaaagtgatcggcctctacggaaatggcgtcgttacaaagtctggggactatgtgtccgctattacccaggccgaacgcatcggagagcccgattacgaggtggacgaagatattttccggaagaaaagactgacaatcatggaccttcaccctggcgccgggaagacgaaacggattctgccgagcatcgtccgcgaggctctgaagagacggctccgcaccctgatccttgcccccacaagagtggttgcggctgaaatggaggaagccctgcggggactccctattagatatcagacccccgccgtgaaatctgagcataccggccgcgagatcgtcgatctgatgtgccacgctacatttacgacccggctcctgtccagcacaagagtgcctaactacaatcttattgttatggacgaagcccacttcaccgatccctcctctgtggctgcccgcgggtacatcagcacacgggtcgagatgggcgaagcggccgctatttttatgaccgccacgcctccgggagctacagaccccttccctcaatccaacagccccatcgaggatatcgaaagagagattcctgagcgctcttggaataccggctttgactggatcaccgactatcaggggaagacagtgtggttcgtcccctccattaaggccggaaacgatatcgccaattgcctgcggaaaagcggcaagaaagtgattcagctgtctagaaagacctttgggacagaatacccgaaaaccaagctcacggactgggatttcgttgtgacaaccgacatcagcgagatgggagctaactttcgcgcgggcagagtgatcgatcctcggcgctgtctgaagcccgtcattcttacagacgggcccgaaagagttatcctggccggccctattcccgtgacccctgcttccgccgcccaacggcgcggaagagtgggccggaacccggctcaggaggatgaccagtatgtcttctctggggatcccctcaaaaatgacgaagatcatgcccactggacggaggcgaagatgctgctggacaacatctacacccctgagggaattatccccacactcttcggccctgaaagagagaaaacccaggctattgatggggaatttcgccttcggggagagcaaagaaagacattcgtggagctgatgcgccggggcgacctgcccgtttggctcagctataaagtggcctccgccggcatctcttacaaggacagagaatggtgctttaccggggagcggaataaccagatcctggaagagaatatggaagtcgagatttggacacgcgagggagaaaagaagaaacttagaccgcggtggctggatgctcgcgtgtatgccgaccctatggcgctcaaagatttcaaagagtttgccagcggcagaaaatccatcaccctggacattctgacggaaatcgctagcctccccgcctacctttcttcccgggctaagctggccctggataacattgtcatgctccatacaaccgagcgcgggggcagagcttaccagcacgccctgaatgaacttcctgagagcctggagaccctcatgctggtggcgctgctcggagccatgacagctgggatcttcctctttttcatgcagggaaagggcatcggcaaactgtccatggggctgattaccatcgccgttgcttctggactcctgtggattgccgaaatccaaccccagtggattgccgctagcatcatccttgagtttttcctgatggtgctcctgattcctgaacccgagaagcagcggacaccgcaggacaaccaactgatctatgtcattctcacggtgcttaccatcattggcctgatcgcggccaatgaaatggggctgattgagaaaacaaagaccgattttggattctaccaggttaaaacagagaccacgatcctcgacgtggatctgcgccctgcttccgcctggaccctttatgccgtcgctacaaccgtgctgacacccatgctcagacacaccatcgaaaacacgtctgccaatctgagcctggcggccattgctaaccaggccgctgtgctcatgggccttgggaagggatggcccctgcatcggatggacctgggcgttcctctcctggccatgggctgttactcccaggtcaatccgacaacccttacagcgagcctggtgatgctctttgtgcactatgccatcattgggcccggactgcaagctaaagccaccagagaggctcagaagcgcaccgccgctggcatcatgaagaaccctacagtcgatgggattacggttatcgacctggaacccatctcttacgatcctaaattcgagaagcagctcggacaagtgatgcttctggtgctgtgcgccggccagctcctgcttatgcggaccacatgggcgttctgtgaggtcctgaccctcgccacagggcccattctgaccctgtgggaaggaaatcctggcagattttggaacacgacaatcgctgtgtccaccgccaacattttccgcggcagctatctcgctggggccggacttgccttttctctgatcaaaaatgcgcagaccccgcggagaggcacagggaccacaggagagacgctgggcgaaaagtggaaacgccagctcaactccctggaccggaaggagttcgaagagtacaagagaagcgggattcttgaggttgaccgcaccgaagctaaatctgccctgaaggatggaagcaaaatcaagcatgctgtgtcccggggctctagcaaaatcagatggattgtcgagcgcggcatggtgaagcccaaggggaaagttgtggacctcggatgcggcagagggggatggtcctactatatggccacactgaagaatgtcaccgaagtgaaaggctacacaaaagggggacctggccacgaggaacccatccctatggccacctatggctggaacctggtgaaactccatagcggggtcgatgtcttttacaagcccacggagcaagtggacacccttctgtgtgatattggagagtcctctagcaatccgacaatcgaagagggcagaaccctgcgcgtgctcaagatggtcgaaccttggctgtcctctaaacccgagttctgcattaaggtgcttaacccctatatgcctacagttatcgaagaactggagaaactccagagaaagcacgggggaaatctggtgcggtgtcccctgagccgcaactccacccacgaaatgtactgggtctctggcgctagcgggaatattgtgtccagcgttaacacaacctctaaaatgctccttaatagatttacgacacggcatagaaagcctacctatgagaaagacgtggatctgggagccggcacccggtccgtcagcacagaaacggagaagccggacatgaccatcatcggccgcagactgcagcggctccaggaggaacacaaggagacatggcattacgatcaagaaaacccctaccgcacctgggcgtatcacgggtcttacgaggccccttccacaggaagcgcttcttccatggtgaatggcgttgtgaaactgcttaccaagccctgggacgtcattcctatggtgacacagctggccatgaccgatacgacccccttcgggcagcagagagtctttaaagaaaaggtggacacacggaccccgcaacctaaacccggaacacgcatggttatgaccacgacagctaactggctctgggccctgctgggcaagaagaaaaatcctagactctgcacccgggaggagttcatcagcaaggtgcgctccaacgcggccattggggctgtctttcaggaggaacagggctggacaagcgcctctgaagctgtgaatgacagcagattctgggagctggtggataaagaacgggcccttcaccaagagggaaagtgtgagtcctgcgtttataacatgatgggcaaacgcgaaaagaagctgggggagtttggacgggctaaaggctctcgggccatctggtacatgtggctcggggcgcgcttcctggagttcgaggcccttggatttctgaacgaagaccattggttcggcagagagaatagctggtccggggtggagggcgaaggactccaccggctgggctatattctggaggaaatcgataagaaagacggggatctcatgtacgctgacgataccgccggatgggacacgagaatcaccgaggatgacctgcagaacgaggaacttattacagagcagatggctccccatcacaagatcctggccaaagccatttttaagctcacctatcagaataaggtcgtgaaagttctgcgccctacaccccggggcgcggtgatggatatcatttctagaaaggaccaacgcgggagcggacaggtcggcacctacgggcttaacacattcaccaatatggaagtgcagctgatccggcagatggaggctgaaggcgtcatcacgcaagatgacatgcagaacccgaaaggactcaaggagagagtggagaaatggctgcgcgaatgcggcgttgaccggctgaagagaatggccatttccggggatgactgtgtggtcaaacctctcgatgagcgctttggaacatctctgcttttcctgaatgacatgggcaaggtgcggaaggatatcccccagtgggaacccagcaaagggtggaagaactggcaggaggttcctttttgctcccatcacttccacaaaatttttatgaaggacggaagaagcctcgtggtcccgtgtcgcaatcaagatgaactgatcggccgggccagaatttctcagggggctggctggtcccttcgggagaccgcctgcctgggaaaggcttacgcccagatgtggagcctcatgtatttccatagacgcgacctgcggctggcgtctatggccatctgttccgctgtgcccaccgagtggtttcctacaagcagaaccacatggtccatccacgcccatcaccagtggatgacgaccgaagatatgctcaaggtgtggaaccgcgtttggattgaggacaatcccaacatgacagataagacccctgtccactcttgggaagacatcccctacctgggcaaaagagaggacctttggtgcgggagcctgattggactctccagccgggctacatgggccaagaatatccataccgcgattacgcaagtgcgcaacctgatcggcaaagaagagtatgtggattacatgcctgtcatgaagagatattctgccccctccgagagcgaaggggtgctttga

SEQ ID NO: 21040 - RNA, 9867 nt, synthetic construct
  misc_feature 1..9867: note = derived and/or modified CDS sequence (opt5) from DENV-4__GU289913__SS-prME
  source 1..9867: mol_type = other RNA
agcacaatcacactgctctgcctgattcccacggtgatggccttccacctttccaccagagacggagagcctctgatgatcgtggctaagcatgaacgggggagaccgcttctgtttaaaacaaccgagggaattaacaagtgtacacttatcgccatggatctgggcgaaatgtgcgaggacaccgttacatacaaatgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccagcgcgtggagtcttggatccttagaaatcctggcttcgctctgctcgccggctttatggcttacatgatcgggcagacaggcattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctagcatttctaatatcaccacagccacccgctgcccgacgcaaggagagccctatcttaaggaggaacaggaccagcagtacatttgtagacgggatgtggtggaccgcggctgggggaacggatgcggcctgttcgggaaaggaggcgtcgtgacatgcgcgaagttttcctgtagcggcaaaatcaccgggaatctcgttcaaattgagaacctggaatataccgtggtcgtgacagttcataatggagatacccacgccgtgggcaacgacacatctaatcacggggtcacggctatgatcacccctagatcccccagcgtggaggtcaaacttcctgattacggagaactgacactcgactgcgagccccggtctggcatcgacttcaacgagatgattctgatgaagatgaaaaagaaaacctggctggtgcataagcagtggtttctcgatctgccgcttccttggacagccggggctgacacctccgaagttcactggaattacaaagagagaatggtgacgttcaaggtcccccatgccaaacgccaggatgtgaccgttctgggcagccaggaaggagccatgcactccgctctcgcgggcgccacagaggtggactctggggatggaaaccacatgtttgctggccatctgaagtgtaaggtccggatggaaaaacttagaatcaaggggatgagctataccatgtgctccggaaaattcagcattgacaaggagatggccgagacacaacacggcaccacggtggtgaaagttaagtacgaaggggccggcgctccttgtaaggtccccatcgagattcgcgatgtgaataaagaaaaggtggtcggacggatcatctcttccacacccctggccgagaacaccaacagcgtgacaaatattgagctcgaacctccgttcggcgactcttatatcgttattggggtgggaaacagcgcgctgaccctgcattggtttagaaaaggctcctctatcgggaagatgttcgagagcacctaccgcggagctaaacggatggccattctcggcgaaacagcctgggattttgggtccgtcggcggactgttcacgagccttggcaaggctgtgcaccaggtttttgggtctgtgtataccacaatgttcggaggcgtctcctggatgatcagaatcctgattgggtttctcgtgctgtggatcggaaccaatagccgcaacacatctatggccatgacctgcattgctgttggcgggatcacgctgttccttggctttacagtgcaggccgacatgggatgtgtcgtgtcctggagcggcaaggagctcaaatgcgggtccggaattttcgtggtcgataatgttcatacctggaccgaacaatacaagtttcagcccgagtctcctgcgcggctggccagcgctatcctgaacgcccacaaagacggcgtgtgtgggattagatccacaacccgcctcgagaatgtgatgtggaagcagatcacaaacgaactgaattatgtcctttgggagggaggccacgacctgacggtggttgctggcgatgtgaaaggggtcctcaccaagggaaagcgggccctgacaccccctgtgtctgacctgaaatacagctggaagacctggggcaaagcgaagatcttcacacccgaagccagaaactccacctttcttattgatgggccggacacgagcgagtgccctaatgaacggcgcgcttggaactctctcgaggttgaggattacggattcggcatgttcaccacaaatatctggatgaaatttagagaagggtccagcgaggtgtgtgaccatcggctgatgtctgccgctattaaggatcagaaagccgtccacgccgacatgggatattggatcgaatccagcaagaaccaaacctggcagattgagaaggcttctctgatcgaagtgaaaacatgcctctggcccaagacccatacactgtggagcaatggcgttcttgagtcccagatgctgatccctaaaagctacgcgggccccttctctcagcacaactatagacaagggtacgccacccagacggtgggaccttggcacctcggcaagctggagattgattttggggaatgccccggaacaaccgtcaccatccaggaggactgtgatcatcgcggcccgtccctgcggacaaccacggctagcgggaaacttgtgacacagtggtgctgtagatcctgcaccatgcctcccctccgcttcctgggagaagacggctgttggtatggcatggagattagacccctgtctgagaaggaagagaacatggtcaagagccaagtcacagccgggcagggaacctccgaaacattttctatgggcctcctgtgccttaccctgttcgttgaggaatgtctccggcgcagagtgacgcggaaacacatgatcctggtggtcgtgattaccctgtgcgccatcatccttgggggactcacatggatggatctgctgcgcgctctcattatgctgggcgacaccatgagcgggagaatcggaggccagattcatcttgccatcatggcggtttttaagatgtcccctggctacgtgctgggggtcttcctccggaaactgacatctcgcgagaccgctctgatggtgattggaatggccatgacgacagttcttagcatcccgcacgacctgatggagctcatcgatggcatttccctggggctcatcctgcttaagattgtgacccagtttgacaatacacaagtcggaaccctggccctcagcctgaccttcatcagatctacaatgcccctggtgatggcttggcggacgattatggccgtcctttttgtggttaccctgatccctctctgtcgcacatcctgcctgcagaaacagagccattgggtggaaattaccgcgctcatcctgggcgctcaagcccttcccgtctatctgatgacactcatgaagggggcctctagacggtcctggcctctgaacgagggaatcatggctgtgggcctggttagccttctgggctctgccctcctgaagaatgatgtgcccctcgctgggcctatggtcgccggaggcctgcttctggcggcctacgtgatgtccgggagctccgctgacctgagcctcgaaaaagccgctaacgtgcagtgggatgagatggccgacattaccggatctagccccatcattgaagttaagcaggatgaggacggctccttctctatcagagatgtcgaggaaacgaatatgattacactgcttgtgaaactggccctcatcaccgtgagcgggctgtacccgctcgctatccctgtcaccatgacactgtggtatatgtggcaagtgaagacccaacgctccggagcgctttgggacgttccctctcctgccgctacacagaaagccgccctgagcgagggcgtgtaccggattatgcagagaggcctgtttgggaagacgcaggtcggagtgggcatccacatggaaggggttttccacaccatgtggcatgtgacacgcggatccgtcatttgtcacgagaccggccggctcgaaccctcttgggctgatgtgagaaacgacatgatcagctatgggggaggctggcgcctgggcgataagtgggacaaagaggaggacgttcaagtgcttgccattgaaccggggaagaatcctaaacatgtccagacaaagcccggactgttcaaaaccctcacgggcgagatcggggcggtgaccctggattttaagcctggaacatccggcagccccatcattaaccggaaagggaaggtgatcggcctctacggaaatggcgtcgttaccaagtctggggactatgtgtccgctattacacaggccgaaagaatcggagagcccgattacgaggtggacgaagatattttccgcaaaaagcggctgaccatcatggaccttcaccctggcgccgggaaaacaaagcgcattctgccgagcatcgtccgggaggctctgaaacgcagactccggacgctgatccttgcccccacccgcgtggttgcggctgaaatggaggaagccctgagaggactccctattcggtatcagacacccgccgtgaagtctgagcataccggcagagagatcgtcgatctgatgtgccacgctacctttacaacgcgcctcctgtccagcacccgggtgcctaactacaatcttattgttatggacgaagcccacttcacagatccctcctctgtggctgccagagggtacatcagcacccgcgtcgagatgggcgaagcggccgctatttttatgacagccacccctccgggagctacggaccccttccctcaatccaacagccccatcgaggatatcgaacgggagattcctgagagatcttggaatacaggctttgactggatcaccgactatcaggggaagaccgtgtggttcgtcccctccattaaagccggaaacgatatcgccaattgcctgcgcaagagcggcaaaaaggtgattcagctgtctcggaaaacatttgacaccgaatacccgaagacaaagctcaccgattgggacttcgttgtgacgacagatatcagcgagatgggggctaactttagagcgggacgcgtgatcgaccctagacggtgtctgaaacccgtcattcttaccgatggccccgaacgcgttatcctggccgggcctattcccgtgacccctgcttccgccgcccaaagacggggccgcatcggaagaaacccggctcaggaggacgatcagtatgtgttctctggcgaccccctcaagaatgatgaagaccatgcccactggaccgaggcgaaaatgctgctggataacatttacacgcctgaggggatcattcccaccctcttcggacctgaacgggagaagacacaggctatcgacggcgaatttagacttcgcggggagcaacggaaaaccttcgtcgagctgatgagacgcggagacctgcccgtgtggctcagctataaggttgcctccgccggcatctcttacaaggatcgggaatggtgctttacaggcgagagaaataaccagattctggaagagaatatggaagtggagatctggacccgggagggggagaagaagaaacttcgcccgagatggctggacgctcgggtctatgccgatcctatggcgctcaaggacttcaaagagtttgccagcggacgcaagtccattacactggatatcctgaccgaaattgctagcctccccacgtacctttcttccagagccaagctggctctggacaacatcgtgatgctccatacaaccgagcggggcgggcgcgcctaccagcacgctctgaatgaacttcctgagagcctggagaccctcatgctggtcgccctgctcggagcgatgacagccggcatcttcctctttttcatgcaggggaaaggaattggcaagctgtccatgggcctgatcaccattgctgtggcctctgggctcctgtgggttgctgaaatccaaccccagtggattgccgccagcatcatccttgagtttttcctgatggtgctcctgattcctgaacccgagaaacagagaacaccgcaggataaccaactgatctatgtcattctcacgatccttaccattatcggactgattgctgcgaatgaaatgggcctgatcgagaagacaaaaaccgactttgggttctaccaggtgaagacagagaccacgatcctcgatgttgacctgcggcctgcctccgcttggaccctttatgccgtggccacaaccattctgacacccatgctccgccacaccatcgaaaacacgtctgctaatctgagcctggccgcgattgccaaccaggctgccgtcctcatgggacttggcaaagggtggcccctgcatagaatggatctgggagtgcctctcctggctatgggctgttactcccaggtgaatccgacaacccttacagccagcctggttatgctctctgtccactatgcgatcattggccccgggctgcaagccaaggctacccgggaggcccagaagagaaccgctgccggaatcatgaaaaaccctacagtggacggcatcacggtgattgatctggaacccatctcctacgaccctaagtttgagaaacagctcgggcaagtcatgcttctggttctgtgcgctggacagctcctgcttatgcgcaccacatgggccttctgtgaggtgctgaccctcgcgacaggccccattctgaccctgtgggaagggaatcctggacggttctggaacacgacaatcgccgtgagcaccgctaacatttttagaggctcttatctcgccggcgctgggcttgccttctccctgatcaagaatgcccagaccccgcgccggggaacaggcaccacaggggagacgctgggagaaaaatggaagagacagctcaacagcctggaccgcaaggagtttgaagagtacaaacggtctggcatccttgaggtcgatagaaccgaagccaagagcgctctgaaagacgggtccaagattaaacatgccgtgtctcgcggaagctccaagatccggtggattgttgagagaggcatggtgaagcccaaaggcaaggtcgtggatctcgggtgcggacgcggcgggtggagctactatatggctacactgaaaaatgttaccgaagtgaagggatacacaaaaggcgggcctggacacgaggaacccatccctatggccacctatggctggaacctggtcaagctccattccggcgtggacgtgttctacaagcccacggagcaagtcgatacccttctgtgtgacattggggagtctagctccaatccgacaatcgaagagggacggaccctgagagttctcaaaatggtggaaccttggctgtctagcaagcccgagttttgcattaaagtgcttaacccctatatgcctacagtcatcgaggaactggagaagctccagcgcaaacacggcgggaatctggtgagatgtcccctgtcccggaactctacccacgaaatgtactgggttagcggagcctccggcaatatcgtgagctctgtcaacacaacctccaagatgctccttaatcgcttcacgacaagacatcggaaacctacctatgagaaggatgtggacctgggggctggaaccagaagcgtttctacagaaacggagaagccggatatgaccattatcggccggcgcctgcagagactccaggaggaacacaaagagacatggcattacgaccaagaaaacccctaccggacctgggcctatcacggctcctacgaggcgcctagcacagggtctgcctccagcatggtgaatggagtcgtgaagctgcttaccaaaccctgggatgttattcctatggtgacacagctggctatgaccgacacgaccccctttggccagcagcgcgtcttcaaggaaaaagtggacacaagaaccccgcaacctaagcccgggacacggatggtcatgaccacgacagccaactggctctgggctctgctgggaaagaaaaagaatcctcgcctctgcaccagagaggagtttatctccaaagtgcggagcaacgccgcgattggcgccgttttccaggaagaacaggggtggacatctgctagcgaagccgtgaatgattcccgcttttgggagctggtcgacaaggaaagagcccttcaccaagagggcaaatgtgagtcttgcgtgtataacatgatgggaaagcgggaaaagaaactgggcgagttcgggcgcgccaagggaagcagagctatctggtacatgtggctcggcgcccggtttctggagttcgaggcgcttgggttcctgaacgaagatcattggtttggacgcgaaaattcctggtctggcgtggagggggaaggcctccacagactgggatatatcctggaggaaattgacaaaaaggatggcgacctcatgtacgccgatgacaccgctgggtgggatacgcggatcaccgaggacgatctgcagaacgaggaacttattacagagcagatggcgccccatcacaaaatcctggctaaggccattttcaagctcacctatcagaataaagttgtgaaggtcctgagacctacaccccgcggagccgtgatggacatcatcagccggaaagatcaaagaggctccgggcaggttggaacctacggccttaacacatttaccaatatggaagtgcagctgattcgccagatggaggcggaaggggtcatcacgcaagacgacatgcagaacccgaagggcctcaaagagcgggtggagaagtggctgaaagaatgcggagtcgatagactgaagcgcatggctatttctggcgacgattgtgtggttaagcctctcgacgagcggttcgggacaagcctgctttttctgaatgatatgggaaaagtgagaaaggacatcccccagtgggaaccctccaaaggctggaagaactggcaggaggtccctttctgcagccatcactttcacaaaattttcatgaaggatgggcgctctctcgtggttccgtgtcggaatcaagacgaactgatcggcagagctcgcatctcccagggagccgggtggagccttcgggagaccgcttgcctgggcaaggcctacgctcagatgtggtctctcatgtattttcatagacgggatctgagactggcctccatggcgatttgtagcgccgtgcccaccgagtggttccctacatcccgcaccacatggtctatccacgctcatcaccagtggatgacgaccgaagacatgctcaaagtctggaaccgggtgtggattgaggataatcccaacatgacagacaagacccctgtgcacagctgggaagacatcccctacctgggaaaaagagaggatctttggtgcggctccctgattgggctcagctctcgcgccacatgggctaagaatatccataccgccattacgcaagttagaaacctgatcggaaaagaagagtatgtcgactacatgcctgtgatgaagcggtattccgcgcccagcgagtctgaaggcgtgctttga

SEQ ID NO: 21041 - RNA, 9867 nt, synthetic construct
  misc_feature 1..9867: note = derived and/or modified CDS sequence (opt5) from DENV-4__KJ579243__SS-prME
  source 1..9867: mol_type = other RNA
agcaccatcaccctgctttgcctgattcccacggtgatggccttccacctttccaccagagacggagagcctctgatgatcgtcgctaagcatgaacgggggcgcccgctcctgtttaagaccaccgagggaattaacaagtgtacacttatcgccatggatctgggcgaaatgtgcgaggacaccgttacatacaaatgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccagcgcgtggagtcttggatccttagaaatcctggcttcgctctgctcgccggctttatggcttacatgatcgggcagacaggcattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctcttattagcaatatcaccacagccacccgctgcccgacgcaaggagagccctatctgaaggaggaacaggaccagcagtacatttgtagacgggatgtggtggaccgcggctgggggaacggatgcggcctcttcgggaaaggaggcgtcgtgacatgcgcgaagttttcttgttccggcaaaatcaccgggaatctggttcaaattgagaaccttgaatataccgtggtcgtgacagttcataatggagatacccacgccgtgggcaacgacacaagcaatcacggggtcacggctaccatcacacctagatctccctccgtggaggtcaagctgcctgattacggagaactcaccctggactgcgagccccggagcggcatcgacttcaacgagatgattctgatgaagatgaaaaagaaaacatggctcgtgcataagcagtggtttctggatcttccgctgccttggaccacgggggccgacacctctgaagttcactggaattacaaagagagaatggtgacattcaaggtcccccatgctaaacgccaggatgtgaccgttctcggctcccaggaaggagccatgcacagcgccctggctggcgcgacagaggtggactccggggatggaaaccacatgtttgccggccatcttaagtgtaaggtccggatggaaaaactgagaatcaaggggatgtcttataccatgtgcagcggaaaattctccattgacaaggagatggctgagacgcaacacggcacaaccgtggtgaaagttaagtacgaaggggccggcgccccttgtaaggtccccatcgagattcgcgatgtgaataaagaaaaggtggtcggacgggtgatcagcgctacacccctcgccgagaacaccaactctgttaccaatatcgagctggaacctccgttcggcgactcctatattgtgatcggggtcggaaacagcgcgctgacactccattggtttagaaaaggctctagcattgggaagatgttcgagtccacgtaccgcggagctaaacggatggccatcctgggcgaaaccgcctgggattttgggtctgtgggcggacttttcacaagcctgggcaaggctgttcaccaggtgtttgggtccgtctataccacaatgttcggaggcgtgagctggatgattagaatcctcatcgggtgcctggttctgtggattggaaccaattctcgcaacacgtccatggccatgacatgtatcgctgtgggcgggattaccctttttctcggcttcaccgtccaggccgacatgggatgcgtggtgagctggtctggccgggagctgaagtgtgggtccggaatctttgtcgttgataatgtgcatacatggaccgaacaatacaaattccagcccgagagccctgcgagactggcctccgctattctcaacgcccacaaggacggcgtgtgcgggatccgctctacaacgcggctggagaatgtcatgtggaaacagattaccaacgaacttaattatgtgctgtgggagggaggccacgacctcacagttgtggctggcgatgtcaagggggtgctgaccaaaggaaagagagccctgacaccccctgcgagcggccttaagtactcctggaaaacctgggggaaggccaaaatctttacgcccgaagctcggaactctaccttcctcatcgacggaccggatacaagcgagtgtcctaatgaacgcagagcctggaactcctttgaggttgaggactacggcttcgggatgttcaccacaaatatttggatgaagtttcgggaaggaagctctgaggtgtgcgatcatagactgatgtccgctgccatcaaagaccagaaggccgtccacgctgatatgggctattggattgaaagctctaaaaaccaaacctggcagatcgagcgcgcgtccctgattgaagtgaagacatgcctctggcccaagacccatacgctgtggagcaatggcgttcttgagtctcagatgctgatccctaaaagctacgccgggcccttctcccagcacaactatcggcaaggatacgctacacagaccgtgggcccttggcacctcgggaagctggagatcgactttggagaatgtcccggcaccacagtcaccattcaggagaactgcgatcatagagggccgagcctgcgcacgacaaccgcctctggaaaacttgtgacacagtggtgttgcagatcctgtaccatgcctcccctccggttcctgggcgaagacggctgctggtatgggatggagatccgccccctgagcgagaaggaagagaatatggtgaaatcccaagtcacagccggacagggcacctctgaaacgtttagcatggggctcctgtgtcttaccctgttcgttgaggaatgcctcagacggcgcgtgacaagaaagcacatgattctggctgtggtcatcaccctgtgtgccattatccttggaggcctcacatggatggatctgctgcgggcgctcatcattctgggggacaccatgtccggacgcatcggcggccagacgcatcttgctattatggccgtgtttaagatgtctcctgggtacgttctgggagtgttcctcagaaaactgacaagccgggagaccgccctgatggtcatcggcatggctatgacaaccaccctttccattccgcacgatctgatggagctcatcgacgggatctctctgggactcattctgcttaagatcgtgacacagtttgacaacacgcaagttggcaccctggccctcagcctgacattcattcgctccaccatgagcctggtgatggcgtggagaacaatcatggctgtcctttttgtggtcaccctgattcccctctgccggacgtcttgtctgcagaaacagtcccattgggtggaaatcacagccctcattctgggggcccaagcccttcctgtttatctgatgaccctcatgaagggagccagcagacgctcttggcccctgaatgagggcatcatggctgtgggcctggtctcccttctggggagcgccctcctgaaaaacgatgtgcctctcgcgggacccatggttgccggcgggctgcttctggctgcctacgtgatgtctggatccagcgctgacctgtccctcgaaaaggccgccaatgtccagtgggatgagatggctgacatcaccggcagctctcctattatcgaagtgaagcaggatgaggacgggagcttctccattcgggatgtggaggaaacaaacatgatcaccctgcttgttaaactggcgctcattacagtctctggactgtaccccctcgccatcccgatcacgatgaccctgtggtatatgtggcaagtgaagacacaaagaagcggcgctctttgggacgtgccttcccccgccgccacccagaaagctgccctgtctgagggcgtctaccgcattatgcagcgggggctgtttggaaagacacaggtgggcgttgggatccacatggaaggagtgttccacaccatgtggcatgtcacgagaggcagcgtgatttgccacgagaccgggcgcctcgaaccttcctgggcggatgttcggaatgacatgatctcttatggaggcggctggagactgggggataaatgggacaaggaggaggatgtgcaagtccttgctattgaacccggaaagaacccgaaacatgtgcagacaaagcctggcctgttcaaaaccctcacaggggagatcggagccgttaccctggactttaagcccggcacaagcgggtcccctatcattaatcgcaaaggcaaggtgatcggactctacggcaacggggtcgtgacgaaaagcggagactatgtgtctgccattacccaggctgaacggatcggcgagcccgattacgaggtcgacgaagatattttcagaaagaagcggctgacaatcatggaccttcaccccggggccggaaaaaccaagcgcattctgccttccatcgttagagaggcgctgaaacggcgcctcagaaccctgatccttgctccgacacgggtggtggccgccgaaatggaggaagctctgagaggcctccccattcgctatcagacgcctgccgtcaagagcgagcataccgggcgggagatcgtggatctgatgtgccacgctacatttaccacaagactcctgtcttccacccgcgttcccaattacaaccttattgtgatggacgaagcccacttcacggatcctagctccgtcgcggcccggggctacatctctacaagagtggagatgggagaagctgccgctatttttatgaccgccacaccccctggcgccacagacccgttcccccaaagcaattcccctatcgaggatatcgaacgcgagattcccgagcggagctggaacaccgggtttgactggatcacagattatcagggaaaaaccgtttggttcgtgccttctattaaggctggcaatgacatcgcgaactgtctgagaaagtccgggaaaaaggtcattcagctgagccgcaaaacgtttgacacagaataccccaagaccaaactcacagattgggacttcgtggtcaccacggatatctctgagatgggagccaactttagagctggccgggtgatcgacccgcgcagatgcctgaagcctgttattcttaccgatgggcccgaacgggtgatcctggccggccccattcctgtgacacccgccagcgctgcccaacgcagaggacggatcggcagaaatcctgcgcaggaggacgatcagtatgtcttctccggggacccgctcaagaacgatgaagaccatgctcactggaccgaggccaaaatgctgctggataatatttacacacccgagggaatcattcctaccctcttcggccccgaacgcgagaagacacaggccatcgacggggaatttcggcttagaggagagcaacgcaaaaccttcgttgagctgatgcggagaggcgatctgcctgtgtggctctcttataaggtggctagcgccggcatctcctacaaagaccgggaatggtgttttacgggggagcgcaacaatcagattctggaagagaacatggaagtcgagatctggacaagagagggagaaaagaagaaacttcggcccaagtggctggacgcgcgcgtgtatgccgatccgatggctctcaaagacttcaaggagtttgcctctggcagaaaaagcattaccctggatatcctgaccgaaattgcttccctccctacataccttagctctcgggccaagctggctctggacaatatcgttatgctccataccacagagcgcgggggcagagcttaccagcacgcgctgaacgaacttcccgagtccctggagacgctcatgctggtggccctgctcggagctatgaccgccgggatcttcctctttttcatgcagggaaagggcattggcaaactgagcatggggctgatcacaattgctgtcgcctccggactcctgtgggtggccgaaatccaacctcagtggattgctgcgtctatcatccttgagtttttcctgatggtcctcctgattcccgaacctgagaagcagcggacaccccaggataatcaactgatctatgtgattctcacaatccttaccattatcggcctgattgccgctaacgaaatggggctgatcgagaaaacgaagaccgactttggattctaccaggttaaaacagagaccacaatcctcgatgtggacctgcgcccggccagcgcctggaccctttatgctgtcgccacgacaattctgacccctatgctcagacacacaatcgaaaatacctccgcgaacctgtctctggccgctattgccaatcaggctgccgtgctcatgggccttgggaagggatggcccctgcatcggatggatctgggcgttcccctcctggcgatgggctgctacagccaggtgaaccctaccacacttacggcctccctggtcatgctcctggtgcactatgctatcattgggccgggactgcaagccaaagctaccagagaggcccagaagcgcacagctgccggcatcatgaagaatcccaccgtggacgggatcacagttattgatctcgaacctatcagctacgaccccaaatttgagaagcagcttggacaagtcatgctgctggtgctctgtgcgggccagctgcttctgatgcggaccacgtgggccttctgcgaggtgctcacactggctaccgggcctattctgaccctctgggaaggaaaccccggcagattctggaacacaaccatcgccgtctctacagctaatatttttcgcggctcctatcttgccggggccggactggcgttcagcctgatcaaaaacgctcagacgcctcggagaggcaccgggacagccggagagaccctcggcgaaaagtggaaacgccagctcaattctcttgatcggaaggagtttgaagagtacaagagatccgggatcctggaggttgaccgcacagaagctaaaagcgccctcaaggacggatctaaaattaagcatgccgtgagccggggctcctctaaaatcagatggattgtggagcgcggcatggtcaagccgaaggggaaagtggttgatctgggatgtggcagagggggatggagctactatatggctaccctgaagaacgtgacggaagtcaaaggctacaccaaagggggacccggccacgaggaacctatccccatggccacatatggctggaatctcgtgaaacttcattccggggttgacgtgttctacaagcctaccgagcaagtcgatacactgctgtgcgacattggagagagctcctctaaccccaccatcgaagagggcagaacactccgcgtgctgaagatggtggaaccgtggcttagctccaaacctgagttttgtattaaggtcctgaatccctatatgcccaccgttatcgaagaactggagaaactgcagagaaagcacgggggaaacctggtgcggtgccctctctctcgcaatagcacgcacgaaatgtactgggtgtccggcgcgtctgggaacatcgtcagctccgtgaatacaaccagcaaaatgcttctgaacagattcaccacacggcatagaaagcccacgtatgagaaagatgttgacctgggagccggcacccggtctgtgtccacagaaaccgagaagcctgatatgacaattatcggccgcagactccagcggctgcaggaggaacacaaggagacctggcattacgaccaagaaaatccgtaccgcacatgggcttatcacgggagctacgaggccccctctaccggatccgctagctctatggtcaacggcgtggttaaacttctgacgaagccttgggatgtgattcccatggtcacccagctcgccatgacagacaccacaccttttgggcagcagagagtgttcaaagaaaaggttgatacccggacgccccaaccgaaacctggaacacgcatggtgatgaccacaaccgcgaattggctgtgggccctgctcggcaagaagaaaaaccccagactgtgtacgcgggaggagtttatctccaaggtccgcagcaatgctgccattggggctgtgttccaggaggaacagggctggacctccgccagcgaagctgtcaacgactctagattttgggagcttgtggacaaagaacgggccctgcaccaagagggaaagtgcgagagctgcgtttataacatgatgggcaaacgcgaaaagaagctcggggagttcggacgggcgaaaggctcccgggccatctggtacatgtggctgggggctcgctttcttgagttcgaggccctgggattcctcaatgaagatcattggtttggcagagagaactcttggagcggggtggagggcgaaggactgcaccggctgggctatatcctcgaggaaattgacaagaaagatggggacctgatgtacgctgatgacacagccggatgggataccagaatcacagaggacgatcttcagaatgaggaactgattaccgagcagatggcccctcatcacaagatcctcgcgaaagctattttcaagctgacatatcagaacaaggtcgtgaaagtgcttcgccccacccctcggggcgccgttatggacatcatctccagaaaggatcaacgcgggtctggacaggtgggcacgtacgggctgaatacatttaccaacatggaagtccagctcattcggcagatggaggccgaaggcgtgatcacccaagacgatatgcagaatcccaaaggactgaaggagagagttgagaaatggctgcgcgaatgtggcgtggaccggctcaagagaatggctattagcggggacgattgcgtcgtgaaaccgctggacgagcgcttcggaacatcccttctgtttctcaacgatatgggcaaggtccggaaggacatccctcagtgggaaccctctaaagggtggaagaattggcaggaggtgcccttctgtagccatcactttcacaaaattttcatgaaggatggaagatccctggttgtgccttgccgcaaccaagacgaacttatcggccgggccagaatcagccagggggctggctggtctctgcgggagaccgcctgtctcggaaaagcgtacgcccagatgtggtccctgatgtattttcatagacgcgatctgcggctcgctagcatggccatttgctctgctgtcccgacagagtggttccccacgtccagaaccacatggagcatccacgcccatcaccagtggatgaccacagaagacatgctgaaggtgtggaatcgcgtttggattgaggataaccctaatatgatcgacaagacccccgtgcactcctgggaagatattccttaccttggcaaaagagaggacctgtggtgtgggtctctcatcggactgagctcccgggcgacgtgggccaagaacattcataccgctatcacacaagtccgcaatcttatcggcaaagaagagtatgtggactacatgcccgtgatgaagagatatagcgccccttctgagtccgaaggggttctgtga

SEQ ID NO: 21042 - RNA, 9867 nt, synthetic construct
  misc_feature 1..9867: note = derived and/or modified CDS sequence (opt5) from DENV-4__KJ579246__SS-prME
  source 1..9867: mol_type = other RNA
agcaccatcacactgctctgcctgattcccacggtgatggccttccacctttccaccagagacggcgagcctctgatgatcgtcgctaagcatgaacgggggcgcccgctcctgtttaaaacaaccgagggaattaacaagtgtacacttatcgccatggatctgggcgaaatgtgcgaggacaccgttacatacaaatgtcccctcctggtgaataccgaacctgaggatattgactgctggtgtaacctgacgtctacctgggtgatgtatgggacatgcacccagagcggagagagacggcgcgaaaagagatccgtcgcgctcacaccccactctggcatggggctggagacccgggctgaaacgtggatgagctccgagggagcctggaaacatgcccaacgcgtggagtcttggatccttagaaatcctggcttcgctctgctcgccggctttatggcttacatgatcgggcagacaggaattcagcggaccgttttctttgtgctgatgatgcttgtcgcccccagctatggcatgcgctgtgtgggggttggaaacagagatttcgtggaaggcgtctccgggggagcgtgggtggacctggtgctcgagcacggcggctgcgtcacaaccatggcccaggggaagcctaccctggattttgaactgacaaagacgaccgctaaagaggttgccctcctgcggacatactgtatcgaagctcttattagcaatatcaccacagccacccgctgcccgacgcaaggagagccctatctgaaggaggaacaggaccagcagtacatttgtagacgggatgtggtggaccgcggctgggggaacggatgcggcctcttcgggaaaggaggcgtcgtgacatgcgcgaagttttcttgttccggcaaaatcaccgggaatctggttcaaattgagaaccttgaatataccgtggtcgtgacagttcataatggagatacccacgccgtgggcaacgacacaagcaatcacggggtcacggctaccatcacacctagatctccctccgtggaggtcaagctgcctgattacggagaactcaccctggactgcgagccccggagcggcatcgacttcaacgagatgattctgatgaagatgaaaaagaaaacatggctcgtgcataagcagtggtttctggatcttccgctgccttggaccacgggggccgacacctctgaagttcactggaattacaaagagagaatggtgacattcaaggtcccccatgctaaacgccaggatgtgaccgttctcggctcccaggaaggagccatgcacagcgccctggctggcgcgacagaggtggactccggggatggaaaccacatgtttgccggccatcttaagtgtaaggtccggatggaaaaactgagaatcaaggggatgtcttataccatgtgcagcggaaaattctccattgacaaggagatggctgagacgcaacacggcacaaccgtggtgaaagttaagtacgaaggggccggcgccccttgtaaggtccccatcgagattcgcgatgtgaataaagaaaaggtggtcggacgggtgatcagcgctacacccctcgccgagaacaccaactctgttaccaatatcgagctggaacctccgttcggcgactcctatattgtgatcggggtcggaaacagcgcgctgacactccattggtttagaaaaggctctagcattgggaagatgttcgagtccacgtaccgcggagctaaacggatggccatcctgggcgaaaccgcctgggattttgggtctgtgggcggacttttcacaagcctgggcaaggctgttcaccaggtgtttgggtccgtctataccacaatgttcggaggcgtgagctggatgattagaatcctcatcgggtttctggttctgtggattggaaccaattctcgcaacacgtccatggccatgacatgcatcgctgtgggcgggattacccttttcctcggctttaccgtccaggccgacatgggatgtgtggtgagctggtctggccgggagctgaagtgcgggtccggaatcttcgtcgttgataatgtgcatacatggaccgaacaatacaaatttcagcccgagagccctgcgagactggcctccgctattctcaacgcccacaaggacggcgtgtgtgggatccgctctacaacgcggctggagaatgtcatgtggaaacagattaccaacgaacttaattatgtgctgtgggagggaggccacgacctcacagttgtggctggcgatgtcaagggggtgctgaccaaaggaaagagagccctgacaccccctgcgagcgaccttaagtactcctggaaaacctggggcaaggccaaaatcttcacgcccgaagctcggaactctacctttctcatcgatgggccggacacaagcgagtgccctaatgaacgcagagcctggaactccttcgaggttgaggattacggattcggcatgtttaccacaaatatttggatgaagttccgggaagggagctctgaggtgtgtgaccatagactgatgtccgctgccatcaaagatcagaaggccgtccacgctgacatgggatattggattgaaagctctaaaaaccaaacctggcagatcgagcgcgcgtccctgattgaagtgaagacatgcctctggcccaagacccatacgctgtggagcaatggcgttcttgagtctcagatgctgatccctaaaagctacgccggccccttttcccagcacaactatcggcaagggtacgctacacagaccgtgggaccttggcacctcggcaagctggagatcgatttcggggaatgccccggaaccacagtcaccattcaggagaactgtgaccatagaggcccgagcctgcgcacgacaaccgcctctgggaaacttgtgacacagtggtgctgtagatcctgcaccatgcctcccctccggtttctgggagaagatggctgttggtatggcatggagatccgccccctgagcgagaaggaagagaatatggtgaaatcccaagtcacagccgggcagggaacctctgaaacgttcagcatgggcctcctgtgccttaccctgtttgttgaggaatgtctcagacggcgcgtgacaagaaagcacatgattctggctgtggtcatcaccctgtgcgccattatccttgggggactcacatggatggacctgctgcgggcgctcatcattctgggcgataccatgtccgggcgcatcggaggccagacgcatcttgctattatggccgtgttcaagatgtctcctggctacgttctgggggtgtttctcagaaaactgacaagccgggagaccgccctgatggtcatcggaatggctatgacaaccaccctttccattccgcacgacctgatggagctcatcgacggcatctctctggggctcattctgcttaagatcgtgacacagttcgataacacgcaagttggaaccctggccctcagcctgacatttattcgctccaccatgagcctggtgatggcgtggagaacaatcatggctgtccttttcgtggtcaccctgattcccctctgtcggacgtcttgcctgcagaaacagtcccattgggtggaaatcacagccctcattctgggcgcccaagctcttcctgtttatctgatgaccctcatgaagggggccagcagacgctcttggcccctgaatgagggaatcatggctgtgggcctggtctcccttctgggcagcgccctcctgaaaaacgacgtgcctctcgcggggcccatggttgccggaggcctgcttctggctgcctacgtgatgtctgggtccagcgctgatctgtccctcgaaaaggccgccaatgtccagtgggacgagatggctgatatcaccggaagctctcctattatcgaagtgaagcaggacgaggatggcagcttttccattcgggacgtggaggaaacaaacatgatcaccctgcttgttaaactggcgctcattacagtctctgggctgtaccccctcgccatcccgatcacgatgaccctgtggtatatgtggcaggtgaagacacaaagaagcggagctctttgggatgtgccttcccccgccgccacccagaaagctgccctgtctgagggcgtctaccgcattatgcagcggggcctgttcgggaagacacaggtgggagttggcatccacatggaaggggtgttccacaccatgtggcatgtcacgagaggaagcgtgatttgtcacgagaccggccgcctcgaaccttcctgggcggacgttcggaatgatatgatctcttatgggggaggctggagactgggcgacaaatgggataaggaggaggacgtgcaagtccttgctattgaacccgggaagaacccgaaacatgtgcagacaaagcctggactgtttaaaaccctcacaggcgagatcggggccgttaccctggacttcaagcccggaacaagcggctcccctatcattaatcgcaaagggaaggtgatcggcctctacggaaacggcgtcgtgacgaaaagcggggattatgtgtctgccattacccaggctgaacggatcggagagcccgactacgaggtcgatgaagacatttttagaaagaagcggctgacaatcatggatcttcaccccggcgccgggaaaaccaagcgcattctgccttccatcgttagagaggcgctgaaacggcgcctcagaaccctgatccttgctccgacacgggtggtggccgccgaaatggaggaagctctgagaggactccccattcgctatcagacgcctgccgtcaagagcgagcataccggccgggagatcgtggacctgatgtgccacgctacattcaccacaagactcctgtcttccacccgcgttcccaattacaaccttattgtgatggatgaagcccactttacggaccctagctccgtcgcggcccgggggtacatctctacaagagtggagatgggcgaagctgccgctattttcatgaccgccaccccccctggagccacagatccgtttccccaaagcaattcccctatcgaggacatcgaacgcgagattcccgagcggagctggaacaccggcttcgattggatcacagactatcaggggaaaaccgtttggtttgtgccttctattaaggctggaaatgacatcgcgaactgcctgagaaagtccggcaaaaaggtcattcagctgagccgcaaaacgttcgatacagaataccccaagaccaaactcacagactgggattttgtggtcaccacggacatctctgagatgggggccaacttcagagctggacgggtgatcgatccgcgcagatgtctgaagcctgttattcttaccgacggccccgaacgggtgatcctggccgggcccattcctgtgacacccgccagcgctgcccaacgcagaggccggatcggaagaaatcctgcgcaggaggatgaccagtatgtcttctccggcgatccgctcaagaacgacgaagatcatgctcactggaccgaggccaaaatgctgctggacaatatttacacacccgaggggatcattcctaccctctttggacccgaacgcgagaagacacaggccatcgatggcgaattccggcttagaggggagcaacgcaaaacctttgttgagctgatgcggagaggagacctgcctgtgtggctctcttataaggtggctagcgccggcatctcctacaaagaccgggaatggtgcttcacgggcgagcgcaacaatcagattctggaagagaacatggaagtcgagatctggacaagagagggggaaaagaagaaacttcggcccaagtggctggatgcgcgcgtgtatgccgacccgatggctctcaaagattttaaggagttcgcctctggaagaaaaagcattaccctggacatcctgaccgaaattgcttccctccctacataccttagctctcgggccaagctggctctggataatatcgttatgctccataccacagagcgcggcgggagagcctaccagcacgcgctgaacgaacttcccgagtccctggagacgctcatgctggtggccctgctcggagctatgaccgccggcatctttcttttctttatgcaggggaagggaattggcaaactgagcatgggcctgatcacaattgctgtcgcctccgggctcctgtgggtggccgaaatccaacctcagtggattgctgcgtctatcatccttgagttctttctgatggtcctcctgattcccgaacctgagaagcagcggaccccccaggacaatcaactgatctatgtgattctcacaatccttaccattatcggactgattgccgctaacgaaatgggcctgatcgagaaaacgaagaccgatttcgggttttaccaggttaaaacagagaccacaatcctcgacgtggatctgcgcccggccagcgcctggaccctttatgctgtcgccacgacaattctgacccctatgctcagacacacaatcgaaaatacctccgcgaacctgtctctggccgctattgccaatcaggctgccgtgctcatgggacttggcaaggggtggcccctgcatcggatggacctgggagttcccctcctggcgatgggctgttacagccaggtgaaccctaccacacttacggcctccctggtcatgctcctggtgcactatgctatcattggcccggggctgcaagccaaagctaccagagaggcccagaagcgcacagctgccggaatcatgaagaatcccaccgtggatggcatcacagttattgacctcgaacctatcagctacgatcccaaattcgagaagcagcttgggcaagtcatgctgctggtgctctgcgcgggacagctgcttctgatgcggaccacgtgggccttctgtgaggtgctcacactggctaccggccctattctgaccctctgggaagggaaccccggaagattttggaacacaaccatcgccgtctctacagctaatattttccgcggctcctatcttgccggcgccgggctggcgtttagcctgatcaaaaacgctcagacgcctcggagaggaaccggcacagccggggagaccctcggagaaaagtggaaacgccagctgaattctcttgaccggaaggagttcgaagagtacaagagatccggcatcctggaggttgaccgcacagaagctaaaagcgccctcaaggatgggtctaaaattaagcatgccgtgagccggggatcctctaaaatcagatggattgtggagcgcggcatggtcaagccgaagggcaaagtggttgacctggggtgcggacggggcgggtggagctactatatggctaccctgaagaacgtgacggaagtcaaaggatacaccaagggcgggcccggacacgaggaacctatccccatggccacatatggctggaatctcgtgaaacttcattccggcgttgatgtgttttacaagcctaccgagcaagtcgacacactgctgtgtgatattggggagagctcctctaaccccaccatcgaagagggaagaacactccgcgtgctgaagatggtggaaccgtggcttagctccaaacctgagttctgcattaaggtcctgaatccctatatgcccaccgttatcgaagagctcgagaaactgcagagaaagcacggcgggaacctggtgcggtgtcctctctctcgcaatagcacgcacgaaatgtactgggtgtccggagcgtctggcaacatcgtcagctccgtgaatacaaccagcaaaatgcttctgaacagatttaccacacggcatagaaagcccacgtatgagaaagacgttgatctgggggccggaacccggtctgtgtccacagaaaccgagaagcctgacatgacaattatcggccgcagactccagcggctgcaggaggaacacaaggagacctggcattacgatcaagaaaatccgtaccgcacatgggcttatcacggcagctacgaggccccctctaccgggtccgctagctctatggtcaacggagtggttaaacttctgacgaagccttgggacgtgattcccatggtcacccagctcgccatgacagataccacacctttcggccagcagagagtgtttaaagaaaaggttgacacccggacgccccaaccgaaacctgggacacgcatggtgatgaccacaaccgcgaattggctgtgggccctgctcggaaagaagaaaaaccccagactgtgcacgcgggaggagttcatctccaaggtccgcagcaatgctgccattggcgctgtgtttcaggaagagcaggggtggacctccgccagcgaagctgtcaacgactctagattctgggagcttgtggataaagaacgggccctgcaccaagagggcaagtgtgagagctgcgtttataacatgatgggaaaacgcgaaaagaagctcggcgagtttgggagagcgaaaggatcccgggccatctggtacatgtggctgggcgctcgcttccttgaattcgaggccctggggtttctcaatgaagaccattggttcggaagagagaactcttggagcggcgtggagggggaaggcctgcaccggctgggatatatcctcgaggaaattgataagaaagacggcgatctgatgtacgctgacgatacagccgggtgggacaccagaatcacagaggatgaccttcagaatgaggaactgattaccgagcagatggcccctcatcacaagatcctcgcgaaagctatttttaagctgacatatcagaacaaggtcgtgaaagtgcttcgccccacccctcggggagccgttatggatatcatctccagaaaggaccaacgcggctctgggcaggtgggaacgtacggcctgaatacattcaccaacatggaagtccagctcattcggcagatggaggccgaaggggtgatcacccaagatgacatgcagaatcccaaaggcctgaaggagagagttgagaaatggctgcgcgaatgcggagtggaccggctcaagagaatggctattagcggcgatgactgtgtcgtgaaaccgctggatgagcgctttgggacatcccttctgttcctcaacgacatgggaaaggtccggaaggatatccctcagtgggaaccctctaaaggctggaagaattggcaggaggtgcccttttgcagccatcacttccacaaaatttttatgaaggacgggagatccctggttgtgccttgtcgcaaccaagatgaacttatcggacgggccagaatcagccagggcgctgggtggtctctgcgggagaccgcctgcctcggcaaagcgtacgcccagatgtggtccctgatgtatttccatagacgcgacctgcggctcgctagcatggccatttgttctgctgtcccgacagagtggtttcccacgtccagaaccacatggagcatccacgcccatcaccagtggatgaccacagaagatatgctgaaggtgtggaatcgcgtttggattgaggacaaccctaatatgatcgataagacccccattcactcctgggaagacatcccttaccttggaaaaagagaggacctgtggtgcggctctctcattgggctgagctcccgggcgacgtgggccaagaacatccataccgctatcacacaagtgcgcaatcttattggaaaagaagagtatgtcgattacatgcccgtgatgaagagatatagcgccccttctgagtccgaaggcgtgctgtga
